United States Patent 11,549,145 (METHODS AND COMPOSITIONS FOR INHIBITING AND TREATING NEUROLOGICAL CONDITIONS) - sequence listing, part 29

SEQ ID NO: 329 - DNA, 25819 bp, Homo sapiens
gatccagcttgggtaggcggggaagcagctggagtgcgaccgccgcggcagccaccctgcaaccgccagtcggaggtgcagtccgtaggccctggcccccgggtgggcccttggggagtcggcgccgctcccggggagctgcaaggctcgcccctgcccggcgtggagggcgcggggggcgcggaggtgagcgggtcggggaggagcgcgaaagaaggtagcggcggcggagttgagggtcaagatgcagtctgcgccacgcgctgcatccatcctccccgattctgcgccctcaccgggcgtccgccctgagctgcggggtccctcatctcctggcaccttaaggtggaaagtgagaagggtggagaagggtgtctgttccactgattccccctcctcctcctcttggttcctagagctaagggcaagtcctgaggttgggcccaggagaaagaaggcaaggagacattgtcccaggtaggatgtgtcccagcaggaaaggacaggcaggttactttcgcccccttgatagtctccctgctactttgggttgatgcagggcatttcatggaagatcatgcagtgctgctttgcgaacaggtatttctagcagtcatttggtttatttcccagtaatgtaatcgtggtgtttaggccatttctgttagaaagtaattggcctcttctttgactgtcctaaattatctttgaaccctgtgttcagcctcagccaaaacttgttgaaaattatgccctaaaaatcttgctcttaaaatagagcagagagataaagagcatttttgttggaagatttccatttattatctctcccaccccgtggagaaggattggtgtcagtttttactcctcgggcagttagttttttagatggaaagacagtccaggccatagttaattatcgctcatcagtataggagaaaaagaattcagactcctgccccacccccacccccacccccaacctcctgacttagattctggtccttttaacagccccgctgcttggaaccctttttgttttctaaaccacctccccatccttccttttctccactttattatttcttcattttattgatctgtttattttttctttctttaaccctataatttttttactccgattctctcttggttgcttcaaagcttagaggctatttaatggaaaagcaaaacaaaacaaaacaaaacacccgtcctaaataatttgcaggatgtttagaaacataaagagtaactatgtgtgctgccattgggatggctgcactctctgcctcttagctagtcactctgtcagggtatggggaaatgagacaatattgagaatgacaacttgagcaaattgtgcagtaaggaaatgaaaagctttatccaagtcactttttattgtactggtgctatggaaaatgtggtgaatgaacatagttgtattttagtactgaaaaaacaggacaggtgaagacaaatttttaaagaaaggattgtaaatgagttagaaaagtgagaaagaagatacaccaaaaatgtgaaagagtaagactgcaggcgtgataaaggacataggacatcaggagatgtatttatccctgctgggccagaaaccaggacattgaggtaactgagacattaacataacaataacattgataaatcacctaccccttaagggcccacatgtgttttcagcaaaaagagaaatctgatctagagaattattacatgtctttttgtcctgaatttttttgatgtattccataacaaagaatttttattgcatccttagttacactgccagccaatgtggaggcagtgatcacggacaagacaaacatggttcttccctcgtgcagtttattgtccaatgggggaaatagtaaacagtaaagaaacaattatataaaatattacaaaataaatttaacaagggctgagtgaattattctgctatagagatggaacagtatatggaaagctcccaaggtacataaagtggttgttgttttctctttctagaagagaatgctgtgggtggacaatatacagataaggttagagaggggaagcggggactaactcattcaggaccttttacgtgatagtcaggaagatggctgtagttctaagtacaaggagcaccgattttaaggagagacattttatgacgatttacattttaagatgattttagctgctgtggagatgtttggaaagggtcaaaagagaaagtaggctgacccattaggaaatgtttgcagagttcaggtgagatgatagacacctggactagcctggtattggtggagagggatttatgaaatatgttggagaacaggaattggtgcaggattttatgtcaaaagtgagggtcagcaaggacttaagaatgactcccaattttctgattggagcaactggtggataatggtggcatttacacatttccaggcgaatgggaccagctctgggtggaaaaagttcaggtttgaacctgtgaagtttgagatgtcacagaaagaggtcataaccatatccccttgggaagcaaaaagggaggctctccaggacataagtggatagactggtctttgataggtaaaattggtgattgttaatttaaggtgaaactaatgagctcagttttctggtttttctccagcaaccttcaccaacgtggatacagatacagagaaaatggatagctgggtccaggactagagttttgccaagcagatatgatggagagtaagagagctgaggatctttttaagggagtgactacaaatctagcctcggtttaaagagaaaccagagcaggctgaaggagagtgcaggatattaagcaattagagaggtagaggtcaacggatcagatttcttttgctgtttagaattatcagtgtgaatatttaaactaagattattggaagtcctggagacagtgcttggagatttcaggcagtgagtgactgaggtggggtagaggcaaaaattcattgtctccaatgagtaagtcaaggaaataagagcccctgaagttgaatggttcatccacttgaatgataaagtccaggaaaaacatgatagctattagggtagagaggatgaccatgtatatactgggagccagagtctgcagtcataaggaataaactagaagtcagtagaggacagcagtgaggacagcagtaaggacagggagagggtatggtgaagtaccatgagcttcaaaggagctgggtgtttgcaggagagacaatgaagaagagatgttcagatgtgggcttacaaagtgaagattacaccaccccacctcatggccctggagaattatgttttcttgatagcctctccaaatctgcaggttgtgaaatgtcatcaaaacctctgtggacagccctttcagagttgctgtcatccaataataaatgccctatttatgtgtgaaacaaattaggttctatttttcaaaagtaacatagcacaacaggtgccattcagcttcaggaatgttcaggaaatccttctaaactgaaaaccttaagaggctgtccagctgaatgtaactgaattccctatcaaaataatacattctcaagtattaaatgtgtacagcaagtcaaatgcccattcaagaaaacgatgtcattgacacagacttttagattgagctcccgaagttgaagtgttaaatatagggtggtgatattaccattattacacagcttcaagacttatttagtgttggaaactaccaccagagtcaagtataacctatttgtttgctgtttaacaaaggaaattgagactcagagaatcaaagtgattgcagaagcttaggcctgctctttcacccctacactatgaagacaaaactttctataaatgacatagttgttttttgtttttgtttgtttttgtttttgttttgaggctgagtctcactctgttgcccaggctggagtccagtggcgcgatcttggctccctggttcaagcgattctccttcctcagcctcccaagtagctgggattacaggcacctgccaccacccctgcctaatttttgtgcctttttagtaaagatggggtttaatcatgttggccagtctgatcttgaactcctgacctcaagtgatccacctgcttcggcctcccaaagtgctgagattacagacgtgagccaccatgcccagcctataaatgacatagttttatcagttatttaatttggattccttatgaataacttcaaaagaaaaggtatagacactgtggacatcacctgggagcttgtgaaaaaatgcagaatgtctaacctccctctagacctaaagaatctgagtgtgcattttaaagaggtccccaggtgatcatatttgcattaaagtttgacaagtgcctttctagtgagtcattcccttggaaacagtggtctgctcaggtcagcaggatcatgatgcctggagaactggggaggggatccccttgtagaacagaaagaagagatacagtcatggaaatattccgaattttgaatattatgaaacaacaggaacaaagtatgttgtgcaaggagtgacgcattttaaggaatggcattgcctttcccagaaagtgaagagaggaaattggaaaattgtgagtggaccttctgatactgctcctccttgcgtggaaaaggggaaagaactgcatgcatattattcagcgtcctatattcaaaggtaactactactctttcgcaagtgtaatttttcattactacaaacaacaacgtaaaaattaacataagtgagggtcagaaagccacatctactatcgccaaatgatgaaagtattagattgaattctgaatcttttactagagtgattttcaatcttggttgcataataaaacatctgctaatcttttttaaaaaatgctgttgctcaggatgaaccccagaacaattaagtgaaaactgggtggtaggggggtgacccgtcatcactgtgttttaaaacttgccaggtcattggagaatgcacctagggttgagaaatactgctttagtagctcattcagaagcagctctgagattgcagttctgctactccatgtgccaaaacagtgggactttccctcactaccataagcgtagtgccaagccaggtcagcaatattcaggtcaccctcactggccagttttcagaacattgagggaagtaggatttatttcttgaagaagcctgcttagactaacttttaaaacaaattgatacatgttacatatctatggggtacacatgagtatttgttatatccatagaatgtgtaatgatctggttggagtttttggggaatccatcaccttgagtatttatcatatctatgtgttaagaacatttcaagtcatctcttctagctactttgaaatacacagtacattgttactgactataggcaacctactttgctattgaacattagaacttacttcttctaactgtacatttgtatccatgaaccaacatctcttcctcccctcctcccatcaacacatccttccagcctctgatatctctcatgctattctctacctccatgggatccacttttttagctcccacacatgagtaaaaacatgtgatatttgcctttctgtgcctgggttatttcacttaacataatggcctccactcctatccatgttgctgcaaatgacacgatttcattttttaaggctgaataatatttcattgtgtatacataccacattttctttatccatttgttgatggacatgtagattgattccatatccttgctagtgtgaatagtgcgcaaaaaaaaaaaaaaaaaaaaaacatgtgaggacgggtatctctttgatatactaatttcttttcctgtagataatacccggtagtgagattactggattgtatggtagttccatttttagtcttttgagaaacaacccctatactgttgtccacagaggctgtactaatttacatttccaccaataacatataaggattcccttttctctgaatcgttgtcagcatctgtcatttttctcttttaataatagcagttctaattgggataagttgaaatctcattgtggttttgatatgcatttctctggtgattagtgatgcttagcattttttcatatacctattaaccatttgtttgtcttctttggaaaaatgtctattcatgacctttacccatttttatgggattatgtgttttttattgtcagttgtttgagttccttgtatattctgaatattagtcccttatcagattaatagtttgcaaatattttcttctattcaataggtggtctcttcattctgttgattgtttcctttgctgcacggaagtcttttagtttaatatagtcccatttgtctatttttttgttgttgttgctgtgcttttgaggtcctagccataaaatctttgcctagaccaatgtcttcaaatatttccccaatgttttcttcttgaaatgaggggttttgggtcttatgtttaagtctttagttgaccttgcgttgatttttgtatatggtgagggacaggggtccagttttattcttctgcatacagatatccaattgtctaagtaccatatatttgaagaggatatcctttcctcagtgtatgttcttggtgcctttgttgacaatcagttggctgtaaatgtgtggattttttttgtggattatctaatctgttgcattcattgatctgtgcatttgtttttataccggtaccatgttttttcggttactattgccttgtaatatattttgaagtcaggtagtgtgatgccttcagctttgttctttttgcttaggattgctgtagctattcaggatattttttggttctatatgaattttaggattgtcttttctaattctatgaaaaatcacattggtattttgatagggattgcattgaatctgtgtattgctttgggcagtatggtcattttaatattaattcttccaatccataagcatggaatgtttttccattcgtttatgtcatctttaatttttttctacagtgctttgtagttttccttgtagcaaactttcacctccttggttaaatatattcctagttgttttttgtttgtttttgttttttttatagctattgtaaatgggattgccttcttggtgtctttttcagcaagttcattgttggtgtatagaaatggtactgatttttgtatgtcgattttgtatcctgcaactttattgaatttatttatcagatctaagagtttttgtgtgaaatctttaggtttatctagatctaagatcatatcatcagcaaagagggataatttgaccttcctcttttccagtttgggtaccttttattctttctctttcctggttgctctggctaggacttccaatatgatgttgaatagaagtggtgaaagtggcatccttgtcttgtttctgttcatagaggaaaggctttgagcttttccccatttcaaaataatgatagctatattattattatatagatcatataagcccttattatgtgaagcatattttttctatccctagtttgttgcaagttttatcatgaggggatgctaaattttctcaaatgttttttctgcatctattgagatgatcatatggttattgtccttcattctcttcaggtgatgtatcacagttgttgatttgcatatgttgaaccatccttgtatccctgggatgcattcctggaataaatcccctttgatcatgatgtgtgtgtgttttttttatgagttgttagatttggtttgcttctacagacacacacgcgcgcacacacacaatttttaggagacagggtcttgctctgttgcccaggagggagtgcggttatgcaatcataaatcactgcagccttcaacttctgggctcaggtgattcttctgcctcagctcccgagtactaggacttcaggtgtgtaccaccacacctagctattgtttaaattttttgtagagacgagggtctcattatgttgcccaggctgggcttaaactcctggcttcaatccatcctcctgcattggcctcccaaagtgctgggattacaggcataagccatcatgtctggcccttggtttgctagtattttgttgagagtttttgtatctgtgctcatcaggaataatagtatgtagttttcttttttgttgagccttgtttgcttttggtgtgaagataatgctgacctcatagaatgagttaggcagaattccctcctgtttaatgttttggaagagtttgaagagaattggtgttaggtctgttttgaaagtttggtagaattcggcagtgaagccatctggccctggacttttctttgttgggagttttttaattactgcctcaactttttttgttactggtctgtccaggttttccatttcttcccatttcaatcttggtagcttgtatatgtgtagcagtttatccatttcctctaggttttccagtttgttggtgtatagttgttcataatagcttctcatgatcttatgtatttctgtggtatcaattgtaatgtttccttttccatttctgattttttattggagtatttcctcttttttcttggttagtctagcaagtgctttatcaattttatcttttcaaaaaacaaaactttttgtttcatccatcctttgtattgttttttaagtcccaatttgtctagttctgctctgatctttattattactttccttttaccaatttggggtttggcttgtttttgcttttctagttccttgaggtacatcattaagttgtttatttgaaatcgtaatgattttttggtgtaggtgcttgttgatataagcttccatcttagcactgcttttgctgtatctcatgggtttcagtgtgttgtgtttttatttttatttgttgagggaaattttttgatttcttccttaatttattctttgcccccgtagtcatttaggagcatgttgtttaatcatttatttttacagtttcaaaagttcctcatgttgttgacttctagttttattccattgtggtctgaggaagtacttgatatgacttcgatttttaaaaaatttgttgaatcttattttgtgttctaacatggtcattcctagagaatgtctatgtgctgatgagaatttgtattctgtaactgttgtataaaatgttctgtgaatgtttgttaggtccatttggtctaacgtatagtttaaattcaatgtttctttgttaattttctgtctagattatctgtcagatgctggcaggcggtgttgaagtccccaaatgttgttgtattggcgtctgtttctccttttagatctgataacactttatttatattaatatatctgagtggtctgttgttgggtgtatatatgtttagaattgttatatcctcttgctagaatttatctattatcattatataatgaccttcattgtctctttatactgtttttgactcaaactgttttatttgatataagtatagtgacttttggtttccatttgcatggactatctttctccatccctttgctttcagtcttatatgtgtttttatatgttagatgggtttcttgtacccagcatatacttgggttatgattttttatctattactagtccatatcttttcagtggaaagtttaatccatttgcattcaaagttattcaacaatgaaaacttcccaagtctagtgagagatgtagacacccggatacaggtaacttagagatctccaaacagatacaatacaagaaggtcttccccacagcacattatagtcatattgtcaaaagtaaaagacaaagagtgaattctaaaaacagcaagagaatgaccagtcacctataaaggaactcccagcaaaataaaatttttacctgttcacattctgatttacagaagggatttgaacttgctttgtaaaataagcagataattaatgttgttttgtttttgtttctgtttgaaaaagtcttgatcatcatgagtgttagatttaaagattttgcaattcttatattttgggagatgctgcagtatatactcagaagaactccaggctgggatataggaaacttggattcccttgtgtgaatctagcaacctttttcacccttagataatgctcatgattaccattaactttcgaatgaagtgagcatggatttcattacttctggtttttttaaccactcctgattcccagcatagctagtgacatctccaaatggatattgacaggtttttttcctaccctggtacctctgactcctgcctgcctttctgggtgcatggaccacaccaagggagtggtctatcttgaaaggtgtgaaatgaaacatgtaattgatttaaaaatagtaaatgttcttctttcccaggatcgggtgctcctaggtaactctgaggagcaatgaaatgaccaaagaaaaaggaataatatactactttgagtacaactgtaattgttacaccttgatacttataaccccccaaaaacaccctttcctaaactccttacatgcacctaaataacacatgtcttagctggacaactacctggcttccctattttctgtctttatgtccttggataaattaattatcttctgcaggtctcagtttcctcatctacaaagtgggtatgacagtattagcacctgtctcttagggtggttgtggggattcaatcagttaatacataaaaaccacaagagagctgaaatacattatgtcctatataagcattaagtaatattactataattattgtctttctaaagtttaacatactgatgtatttggagttactggatgtgactcatttctagggtaaaaagttgaattttcctggctgtagtcatttcaaatttcatttagtaaaaaccccaacttttttttgaaacattccacctgtgcctgtaaagtccattaaatcctctgaaatggtccacatctgctatgagcatagaagaaattgtgcaatgagggtagaatggaagagtatttttctttcagacccaatttcgacactaattcatggcaacctgatttgtattcttgagcaaattattccaaatatgaacatttcagatgctagtctctcaactaaaaaataatttgagagatttttccaggaagaataactgcatcatagtttatgcagccaacaaatgaaagggtgtcatgttgcggtccaaagggcgtgggtggatgagcagaaagaatacttgaagggctgtaggcaggtgaaagatgattttattcaacagcagctctgatcaacaactttctcacactgtccatcctgtctcagctgcttagtctggtggctcccacacacacagctcccttgccttcagggtcagcagcttaactatttctctctctgggcatgggcaagccaagctgggtcctgactcccccatctgtctgcaaagacagacagctctgactctctgtctctgagcacaagagtgcctctacagtgtccacagggcaattataccttttacagacaatagtggcttagagccaagtgatgagttttccctatgtcatagcgatggtggtgagcttctgttatgtctacatggctatgataacaagtaacaagtgaagttatatgcttgcgctctgaactcactcactctggatgtttacctctgcctgtccttgaccaaagcacagccatgttctttacaaaggggaagaaaaagatttcatacatattatataatttaagatcataaacatgttactaatcctttttccataggtaagctatctttctcaatgatacattgtaagatgtagggtgaatgatagaagtccatggtatttactcttttgttatattttgatgcctatttttcttaagatattatttaagtgccaggattcattgttagctaatttgtctagctctcatttaatgataaagtcactagctactgaagtatatagggaactttataacctctaccccaaatgactttagacagttttggtttaaatggctttttaaaaaatggtttttctttcttctcttgtcttgtgagccatcacttagtatcacagtcctctctgcctccagcagcatttgtgatttgctgcctctgatctgctcaaaagctgggtaatcatacttgttacaagtgtgtttttccaaaaagttctgagtgaaaacctcagtcccttttttcatgtgctctagtgaggtaggaggcagaacttgaatccagaggcaaggttcagacactggaccaaactgaggtcagggcagaagcacctccccataagacatgcccatcagtgtgccatgtcagttcactattgccatggcaacacctagaagttaccacccctttccatggcaacagcccaacaacccagaaattaccaccctcatcctagaaatttctgcataaatcaccccttaatttgcatataaatcaagtaggtttaaatatgactgcagagctgccactgagctgctactctaggcacactgcctacggggtaggcctgctctgcaaggagcagtacctctgctgttgctgtaaactgttgcttcaataaacgttgctgtttaacaccaccagctcgcccttgaattctttcccatgcaaagccaagtagtctcctgggctaagcccccatttgggggctttcctgtcctgcatcactagtgccttgctgctcaaagaggggtctcagaccagcattggtattgctttcattagaaatgcagaatgttgagcctccctccagaactactcaatcagaatctacattttaacgagattccgaagtgatctgtgtgcacattaaaatttgagaagccccactttagcacctcacctttgtgacagttaattttcctattgagatgcttttttaaaagccaaaagatttatgaagagaaaccagaatagtgatccttttttagcttacaaattgtgtcttactgtgctgtatgttaaagtgtggtgaaatattttacctctagaaagacaggacattacaatgtctagaagtgttttaatgttcagtaataggtaactgatgaccattttattttctctcccctaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtatgtattttacatttttattcttatgtatctggtattttgtagttaaacaactaagcaaatatcaaacattttaataccaaactctgacactttccaatgattatcatttgaaaattaattatgagcacctgaagattaatgtcctgaccttgtaagggcacattcccattcccaacatgatgtggaaaactgggaaaataacgtgaaagtcatccagttcaacttgagaataaagcagatggggcactctgtcaacaccattgtggaacaagcttttataagtaaacacataaaatatgttttaaaaatcttttaaatgtgcttatgcattacaattaagcatgattataaaacacttttattgtttttgtccataaagacagttgattagattccttagaaaataagtttcagtattatatcattgtatgctgtatatcagtcatgataaccatttactttccagtctttattttaatgactggtaaaagaacataggctcttctacaggctatttctgaatccttttttctcttttgcatatccaccaaagtttagcagtggatatagaataagcaaattagaaccaggacctgtgagacaaacctgaatttaataatatgcccatatttatgccaattttaaatttttaacagaaaaaaatgtggaacagtgattaaattccaaatgagctacagaaatagtctaaatttgtattatgtagcatttgtgcctttattttgagtgtttggtttatttttagacttattataccgtattataatttatacaaaattttttccaaatgagtttttaaaaaagtttattccaccattgtcacaactgtaataaattaatttagaatacttttttcttatttgtgttataaaaggacctctattttaaaagttcataaatgattatataatattcattcaaataggatttgtcattcatctggctaatgttatccaagattaataatccaaagagtgttatattgtcaccattatgtaaatagaaacatgcaaatatttctatgtggtctattttagagtccttatacaaacatcttcagggatatatttaggaatttgttttccccaaacattacttggagactctgtagcaatatttttctagccctgaatgaggtggcctacccattagtaatagtagctcactccagtaatgaacttggtgctcaataaatacttgttgttgtaggctttcaaactattgaaatctgttagatactataatatagctgaaaattcaacaagtatttattcctcaaggtcatcacaggtgatggtccgtaagtggagcatgcgattgctaccatttttataaacaacaatggtaatgctgagtctttttgttttttccacaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggtactgaatgtgcttgttatttatctgatgctagtaaaatactttttattagtataaattgtaaaacataaaattttacatgccctgtaatggaaatttgattttggtatactgcgggaggggaaagaattgttctttaaacaatgtttttgcaaaataattaggtggctaattcaaaattatttaagtaaaggctgctaccatccttttccatacagaataaaagcagaaaaatagagggttgggttctccccctttttcaatgttataattgcaatgagtgctttcagtattcaacaattcattattttaatgttttataattggctgtgctccacaaaatgatgaggcaattctcagtaaatatatacaataaaattagaaccagtaaaaatacaaaacagaacaggaagacaagatcaggagaaaaaagtcgaatacacctctgctaagagtgtctccacagcttctcttttggctttgagattttcaatacaatgagaagggagaccctattatttacaaagctcttgttatcaaaaaccagaaaagataatagttccacaggtgaagcttttctagcacttagctctaaaaaaaaaaatctcagggagcacttcatggaaggggtttgattatgaggtagactatggttttcctccataattcccaatccacaaatgtaatttaaggggtttccctgaagctgtttggtgtagcatttctccatgaaagccaagaacattgcaccaaaacaaatgtgtaaaagcatctgcattttgtaaggatcgaaggcatcatagtccaagtatgtggcatctagtacttaagcttgtttcaacaataaaacctaaaataatatttttctaattagtagattgataacctttaaaccattcactccctgaaaaaaaacttctcttaatgggatactaaggcttttattgttgctcagtcagctcccttgcctccttccagtcatttgcccagatctcaccttctcagcgagtcctatgctggataccatcttaaatgccgctgcctctgccccaaccagtattcccaatccttctgacttaccctgctctacctttctttttttaataacacttaccatcttctaacacacttgatttccatgttaaaaatacatttaccagtgtctgccttcccccaacagaaagtaagttcatgagaagagggatctttgtctatctttttcactgatgcatacccagtgcctagatttgagcctagacattgtggacactcaaacagcccatttgtggatgaatgaatgaactgggagagcaggtagatccaggttgtagtctccgagtacactgggtagtgctgtttttctgtattgtatagatatcaaataagaagatggtaagaactctgtggcctctttcaagatgatggtatgattgccttagggaactaatagctaagaagcagcttttcgttgttaaatttcaagtatgttttgttaactggaattggacaaagttaaactgttgttaagttagaatctgttttccattaatagatacttatttaaatcaaaaatttcagctgaaggagtccaatacttgatttatactctaattatattctgaatgtaaatagaacttctaaaggtagtccctacacaaaataccacaaattcagagttcaccgtctgacttgattatatacacattatcaatgtaaggaaaagacatttggaaaaaatactgcatataaatgacacaattggatagttggggatcatattaaatgaggcagttcaagtggataaatgagctccattggcctttatagctagggaaatcacagctttctaggaagagaagatgagaagaaagataaaacagagatatattattcatgtgatggaagaagatactgacatagtttagaaattccctgaccggatccaagttgaactaaggccagactatatcccagatattcaaccaagtttaaaccagcttgtaatagtacttcaaaactaagtttaactgtcagtaacttcttttgtgtcaccctagaaccaactactaggtattttatggtgttggattccagagtccctgtaatgatgatggcaaagctttgcccctctattctagcacgtatacaaggaaagagaaagttttgtcctccttttgtttaattctcttttcccttacacctggagcagtatcatccagtaacaggttctctgtaatggtttgttagactaaattagtacaacttaaatacgtccatatatgaccaggttcttcttatgccaagagtgaactctgtgctgaatcagttaatgttctactaaataaaggaaattcacattcgctttcttgttaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcaggtatgtggggttttgtttggtgaaggattgtgcaggataggatttccttgttaagaacaactgcattttaaatatgttccttattaaaagggtgcctttgaggctgtatttatgcatctagatacattatgctggaagccagcttaggattgctctggttaaataagtgaaagaccagtcagtatatgattgtactggaagactttgacagcactgccttccagtatactatgttaagaacaaaaaagttatcttaaaagagaaaaaaaaaatgaaagttgggaaggatgagcttagatcaaatttaatgttgaaagtcaatttattattagccaagtgaatgaaaaattattttatgttttgagtcatcttgatttgtccagaaaaatcttattaatttgaactcaagtggggatgtcaatctgaatattttaaagaaatgtgtgtatatatacacacacatacaaacacaagcagtggcaaactaggtaactagagtaatggattataacatgcaaccagccttaagaattttgttagtatatcagtagtatactaatacgtatggatgtctgtaaagggatttcaaaccaccattgtattctttaataagttaaacattcaccttctccaataatatctaaataataaggttgcatattttaaaaatatataactgaaacatagacccttcctatattttcacaaaatctgtactggttgtatccaaatggtttacagcatagtagacagattcatgtcctttggtggtacacttaagttttgtttcaattcattgcttatttgcttgtttttttttttaaggtcctgtaaaaatctcattcaaagcagggccaaaatgcttatctgaatttatttttcctttttgaagaaaagggagagtactttcccaacagctagtttaatcatacccgaaaagaaatagaaggttctagacagatgcaaattatcattataaatttagatgagtaattgcaaatattttgcctgctggagggttgatattttccagtaaagttagacattacatcactatactgatgtaatattacttttatataacagactattcttcaaagtaagcactcttaaacataataatttagcgaactaaagaatgatgagcttttagaatttaaactgtaaagtgcctaactgaagtattcttaataaactctatattttaattgttgtttatattaatactgcaggatttttcatatttgcctattaaccagtgtgtatatatgtgtgtgtgcccatgaggatgctcatttaattttaatttaatttaattaattttaataattttaaattagtttatttaattttatcatatgtctgtttatgtattaacagtgatgtgttacctaacagtagggaacgttctgagcaatgagtcgttaggcagttttatcatgtgaacatcatagagcatatttatacaaaccatgacctattgctcccaggctacaaacctgtacagcatgttactgtactgaatattacaggcacttgtaacacaatggtaaatatttgtgtatctaaacatatctaaacagagaaaaggtacagtaaaaataaggcatataatcttatgggaccaccgttgtatatgcagtccatagttgaccaaaatgcccttatgtggcacatgactatatttatgtgtatgtgtatacacacacacatacatacacatttctttaatacacaactggtgggaatgtgaataatttttataaagaagagtctagcagtatgtatcagtacccttaaggaaaagctagatgttttgaccaataatcctactattagaaaccagtcctaagaaaataaatcaaaatatggaaaatggcctaacatgacatttatagttgaggaaagttggaaacagtgaattatcaacaaaaaggaatggtttaataaattatgcacatccattcaatagaatattatacagtattaatgtcattttcatatttaatgacatgaggaaaatgttcttgataaaataaatgaagtagtaagaatattaaactgtatgcagtagggccttatttgtgtaacataaggtgtgcatataaataatacatatatatgcatatataaaaatattaatattatttaattcagtagaggacaaaggttaacttgataatttaagacaaaatagttttatcaaaatataaacatggtgtatcttgatagtttaatttatgagtttcagtcatttgtttcttattctttgtttcttttccttcctctcctggcccaagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaacttctgttttgaaatgttgtatacacgtggatttttttctcattaaataataattctagta

SEQ ID NO: 330 - DNA, 25819 bp, Homo sapiens; identical to SEQ ID NO: 329

SEQ ID NO: 331 - DNA, 23859 bp, Homo sapiens
ttctgctatagagatggaacagtatatggaaagctcccaaggtacataaagtggttgttgttttctctttctagaagagaatgctgtgggtggacaatatacagataaggttagagaggggaagcggggactaactcattcaggaccttttacgtgatagtcaggaagatggctgtagttctaagtacaaggagcaccgattttaaggagagacattttatgacgatttacattttaagatgattttagctgctgtggagatgtttggaaagggtcaaaagagaaagtaggctgacccattaggaaatgtttgcagagttcaggtgagatgatagacacctggactagcctggtattggtggagagggatttatgaaatatgttggagaacaggaattggtgcaggattttatgtcaaaagtgagggtcagcaaggacttaagaatgactcccaattttctgattggagcaactggtggataatggtggcatttacacatttccaggcgaatgggaccagctctgggtggaaaaagttcaggtttgaacctgtgaagtttgagatgtcacagaaagaggtcataaccatatccccttgggaagcaaaaagggaggctctccaggacataagtggatagactggtctttgataggtaaaattggtgattgttaatttaaggtgaaactaatgagctcagttttctggtttttctccagcaaccttcaccaacgtggatacagatacagagaaaatggatagctgggtccaggactagagttttgccaagcagatatgatggagagtaagagagctgaggatctttttaagggagtgactacaaatctagcctcggtttaaagagaaaccagagcaggctgaaggagagtgcaggatattaagcaattagagaggtagaggtcaacggatcagatttcttttgctgtttagaattatcagtgtgaatatttaaactaagattattggaagtcctggagacagtgcttggagatttcaggcagtgagtgactgaggtggggtagaggcaaaaattcattgtctccaatgagtaagtcaaggaaataagagcccctgaagttgaatggttcatccacttgaatgataaagtccaggaaaaacatgatagctattagggtagagaggatgaccatgtatatactgggagccagagtctgcagtcataaggaataaactagaagtcagtagaggacagcagtgaggacagcagtaaggacagggagagggtatggtgaagtaccatgagcttcaaaggagctgggtgtttgcaggagagacaatgaagaagagatgttcagatgtgggcttacaaagtgaagattacaccaccccacctcatggccctggagaattatgttttcttgatagcctctccaaatctgcaggttgtgaaatgtcatcaaaacctctgtggacagccctttcagagttgctgtcatccaataataaatgccctatttatgtgtgaaacaaattaggttctatttttcaaaagtaacatagcacaacaggtgccattcagcttcaggaatgttcaggaaatccttctaaactgaaaaccttaagaggctgtccagctgaatgtaactgaattccctatcaaaataatacattctcaagtattaaatgtgtacagcaagtcaaatgcccattcaagaaaacgatgtcattgacacagacttttagattgagctcccgaagttgaagtgttaaatatagggtggtgatattaccattattacacagcttcaagacttatttagtgttggaaactaccaccagagtcaagtataacctatttgtttgctgtttaacaaaggaaattgagactcagagaatcaaagtgattgcagaagcttaggcctgctctttcacccctacactatgaagacaaaactttctataaatgacatagttgttttttgtttttgtttgtttttgtttttgttttgaggctgagtctcactctgttgcccaggctggagtccagtggcgcgatcttggctccctggttcaagcgattctccttcctcagcctcccaagtagctgggattacaggcacctgccaccacccctgcctaatttttgtgcctttttagtaaagatggggtttaatcatgttggccagtctgatcttgaactcctgacctcaagtgatccacctgcttcggcctcccaaagtgctgagattacagacgtgagccaccatgcccagcctataaatgacatagttttatcagttatttaatttggattccttatgaataacttcaaaagaaaaggtatagacactgtggacatcacctgggagcttgtgaaaaaatgcagaatgtctaacctccctctagacctaaagaatctgagtgtgcattttaaagaggtccccaggtgatcatatttgcattaaagtttgacaagtgcctttctagtgagtcattcccttggaaacagtggtctgctcaggtcagcaggatcatgatgcctggagaactggggaggggatccccttgtagaacagaaagaagagatacagtcatggaaatattccgaattttgaatattatgaaacaacaggaacaaagtatgttgtgcaaggagtgacgcattttaaggaatggcattgcctttcccagaaagtgaagagaggaaattggaaaattgtgagtggaccttctgatactgctcctccttgcgtggaaaaggggaaagaactgcatgcatattattcagcgtcctatattcaaaggtaactactactctttcgcaagtgtaatttttcattactacaaacaacaacgtaaaaattaacataagtgagggtcagaaagccacatctactatcgccaaatgatgaaagtattagattgaattctgaatcttttactagagtgattttcaatcttggttgcataataaaacatctgctaatcttttttaaaaaatgctgttgctcaggatgaaccccagaacaattaagtgaaaactgggtggtaggggggtgacccgtcatcactgtgttttaaaacttgccaggtcattggagaatgcacctagggttgagaaatactgctttagtagctcattcagaagcagctctgagattgcagttctgctactccatgtgccaaaacagtgggactttccctcactaccataagcgtagtgccaagccaggtcagcaatattcaggtcaccctcactggccagttttcagaacattgagggaagtaggatttatttcttgaagaagcctgcttagactaacttttaaaacaaattgatacatgttacatatctatggggtacacatgagtatttgttatatccatagaatgtgtaatgatctggttggagtttttggggaatccatcaccttgagtatttatcatatctatgtgttaagaacatttcaagtcatctcttctagctactttgaaatacacagtacattgttactgactataggcaacctactttgctattgaacattagaacttacttcttctaactgtacatttgtatccatgaaccaacatctcttcctcccctcctcccatcaacacatccttccagcctctgatatctctcatgctattctctacctccatgggatccacttttttagctcccacacatgagtaaaaacatgtgatatttgcctttctgtgcctgggttatttcacttaacataatggcctccactcctatccatgttgctgcaaatgacacgatttcattttttaaggctgaataatatttcattgtgtatacataccacattttctttatccatttgttgatggacatgtagattgattccatatccttgctagtgtgaatagtgcgcaaaaaaaaaaaaaaaaaaaaaacatgtgaggacgggtatctctttgatatactaatttcttttcctgtagataatacccggtagtgagattactggattgtatggtagttccatttttagtcttttgagaaacaacccctatactgttgtccacagaggctgtactaatttacatttccaccaataacatataaggattcccttttctctgaatcgttgtcagcatctgtcatttttctcttttaataatagcagttctaattgggataagttgaaatctcattgtggttttgatatgcatttctctggtgattagtgatgcttagcattttttcatatacctattaaccatttgtttgtcttctttggaaaaatgtctattcatgacctttacccatttttatgggattatgtgttttttattgtcagttgtttgagttccttgtatattctgaatattagtcccttatcagattaatagtttgcaaatattttcttctattcaataggtggtctcttcattctgttgattgtttcctttgctgcacggaagtcttttagtttaatatagtcccatttgtctatttttttgttgttgttgctgtgcttttgaggtcctagccataaaatctttgcctagaccaatgtcttcaaatatttccccaatgttttcttcttgaaatgaggggttttgggtcttatgtttaagtctttagttgaccttgcgttgatttttgtatatggtgagggacaggggtccagttttattcttctgcatacagatatccaattgtctaagtaccatatatttgaagaggatatcctttcctcagtgtatgttcttggtgcctttgttgacaatcagttggctgtaaatgtgtggattttttttgtggattatctaatctgttgcattcattgatctgtgcatttgtttttataccggtaccatgttttttcggttactattgccttgtaatatattttgaagtcaggtagtgtgatgccttcagctttgttctttttgcttaggattgctgtagctattcaggatattttttggttctatatgaattttaggattgtcttttctaattctatgaaaaatcacattggtattttgatagggattgcattgaatctgtgtattgctttgggcagtatggtcattttaatattaattcttccaatccataagcatggaatgtttttccattcgtttatgtcatctttaatttttttctacagtgctttgtagttttccttgtagcaaactttcacctccttggttaaatatattcctagttgttttttgtttgtttttgttttttttatagctattgtaaatgggattgccttcttggtgtctttttcagcaagttcattgttggtgtatagaaatggtactgatttttgtatgtcgattttgtatcctgcaactttattgaatttatttatcagatctaagagtttttgtgtgaaatctttaggtttatctagatctaagatcatatcatcagcaaagagggataatttgaccttcctcttttccagtttgggtaccttttattctttctctttcctggttgctctggctaggacttccaatatgatgttgaatagaagtggtgaaagtggcatccttgtcttgtttctgttcatagaggaaaggctttgagcttttccccatttcaaaataatgatagctatattattattatatagatcatataagcccttattatgtgaagcatattttttctatccctagtttgttgcaagttttatcatgaggggatgctaaattttctcaaatgttttttctgcatctattgagatgatcatatggttattgtccttcattctcttcaggtgatgtatcacagttgttgatttgcatatgttgaaccatccttgtatccctgggatgcattcctggaataaatcccctttgatcatgatgtgtgtgtgttttttttatgagttgttagatttggtttgcttctacagacacacacgcgcgcacacacacaatttttaggagacagggtcttgctctgttgcccaggagggagtgcggttatgcaatcataaatcactgcagccttcaacttctgggctcaggtgattcttctgcctcagctcccgagtactaggacttcaggtgtgtaccaccacacctagctattgtttaaattttttgtagagacgagggtctcattatgttgcccaggctgggcttaaactcctggcttcaatccatcctcctgcattggcctcccaaagtgctgggattacaggcataagccatcatgtctggcccttggtttgctagtattttgttgagagtttttgtatctgtgctcatcaggaataatagtatgtagttttcttttttgttgagccttgtttgcttttggtgtgaagataatgctgacctcatagaatgagttaggcagaattccctcctgtttaatgttttggaagagtttgaagagaattggtgttaggtctgttttgaaagtttggtagaattcggcagtgaagccatctggccctggacttttctttgttgggagttttttaattactgcctcaactttttttgttactggtctgtccaggttttccatttcttcccatttcaatcttggtagcttgtatatgtgtagcagtttatccatttcctctaggttttccagtttgttggtgtatagttgttcataatagcttctcatgatcttatgtatttctgtggtatcaattgtaatgtttccttttccatttctgattttttattggagtatttcctcttttttcttggttagtctagcaagtgctttatcaattttatcttttcaaaaaacaaaactttttgtttcatccatcctttgtattgttttttaagtcccaatttgtctagttctgctctgatctttattattactttccttttaccaatttggggtttggcttgtttttgcttttctagttccttgaggtacatcattaagttgtttatttgaaatcgtaatgattttttggtgtaggtgcttgttgatataagcttccatcttagcactgcttttgctgtatctcatgggtttcagtgtgttgtgtttttatttttatttgttgagggaaattttttgatttcttccttaatttattctttgcccccgtagtcatttaggagcatgttgtttaatcatttatttttacagtttcaaaagttcctcatgttgttgacttctagttttattccattgtggtctgaggaagtacttgatatgacttcgatttttaaaaaatttgttgaatcttattttgtgttctaacatggtcattcctagagaatgtctatgtgctgatgagaatttgtattctgtaactgttgtataaaatgttctgtgaatgtttgttaggtccatttggtctaacgtatagtttaaattcaatgtttctttgttaattttctgtctagattatctgtcagatgctggcaggcggtgttgaagtccccaaatgttgttgtattggcgtctgtttctccttttagatctgataacactttatttatattaatatatctgagtggtctgttgttgggtgtatatatgtttagaattgttatatcctcttgctagaatttatctattatcattatataatgaccttcattgtctctttatactgtttttgactcaaactgttttatttgatataagtatagtgacttttggtttccatttgcatggactatctttctccatccctttgctttcagtcttatatgtgtttttatatgttagatgggtttcttgtacccagcatatacttgggttatgattttttatctattactagtccatatcttttcagtggaaagtttaatccatttgcattcaaagttattcaacaatgaaaacttcccaagtctagtgagagatgtagacacccggatacaggtaacttagagatctccaaacagatacaatacaagaaggtcttccccacagcacattatagtcatattgtcaaaagtaaaagacaaagagtgaattctaaaaacagcaagagaatgaccagtcacctataaaggaactcccagcaaaataaaatttttacctgttcacattctgatttacagaagggatttgaacttgctttgtaaaataagcagataattaatgttgttttgtttttgtttctgtttgaaaaagtcttgatcatcatgagtgttagatttaaagattttgcaattcttatattttgggagatgctgcagtatatactcagaagaactccaggctgggatataggaaacttggattcccttgtgtgaatctagcaacctttttcacccttagataatgctcatgattaccattaactttcgaatgaagtgagcatggatttcattacttctggtttttttaaccactcctgattcccagcatagctagtgacatctccaaatggatattgacaggtttttttcctaccctggtacctctgactcctgcctgcctttctgggtgcatggaccacaccaagggagtggtctatcttgaaaggtgtgaaatgaaacatgtaattgatttaaaaatagtaaatgttcttctttcccaggatcgggtgctcctaggtaactctgaggagcaatgaaatgaccaaagaaaaaggaataatatactactttgagtacaactgtaattgttacaccttgatacttataaccccccaaaaacaccctttcctaaactccttacatgcacctaaataacacatgtcttagctggacaactacctggcttccctattttctgtctttatgtccttggataaattaattatcttctgcaggtctcagtttcctcatctacaaagtgggtatgacagtattagcacctgtctcttagggtggttgtggggattcaatcagttaatacataaaaaccacaagagagctgaaatacattatgtcctatataagcattaagtaatattactataattattgtctttctaaagtttaacatactgatgtatttggagttactggatgtgactcatttctagggtaaaaagttgaattttcctggctgtagtcatttcaaatttcatttagtaaaaaccccaacttttttttgaaacattccacctgtgcctgtaaagtccattaaatcctctgaaatggtccacatctgctatgagcatagaagaaattgtgcaatgagggtagaatggaagagtatttttctttcagacccaatttcgacactaattcatggcaacctgatttgtattcttgagcaaattattccaaatatgaacatttcagatgctagtctctcaactaaaaaataatttgagagatttttccaggaagaataactgcatcatagtttatgcagccaacaaatgaaagggtgtcatgttgcggtccaaagggcgtgggtggatgagcagaaagaatacttgaagggctgtaggcaggtgaaagatgattttattcaacagcagctctgatcaacaactttctcacactgtccatcctgtctcagctgcttagtctggtggctcccacacacacagctcccttgccttcagggtcagcagcttaactatttctctctctgggcatgggcaagccaagctgggtcctgactcccccatctgtctgcaaagacagacagctctgactctctgtctctgagcacaagagtgcctctacagtgtccacagggcaattataccttttacagacaatagtggcttagagccaagtgatgagttttccctatgtcatagcgatggtggtgagcttctgttatgtctacatggctatgataacaagtaacaagtgaagttatatgcttgcgctctgaactcactcactctggatgtttacctctgcctgtccttgaccaaagcacagccatgttctttacaaaggggaagaaaaagatttcatacatattatataatttaagatcataaacatgttactaatcctttttccataggtaagctatctttctcaatgatacattgtaagatgtagggtgaatgatagaagtccatggtatttactcttttgttatattttgatgcctatttttcttaagatattatttaagtgccaggattcattgttagctaatttgtctagctctcatttaatgataaagtcactagctactgaagtatatagggaactttataacctctaccccaaatgactttagacagttttggtttaaatggctttttaaaaaatggtttttctttcttctcttgtcttgtgagccatcacttagtatcacagtcctctctgcctccagcagcatttgtgatttgctgcctctgatctgctcaaaagctgggtaatcatacttgttacaagtgtgtttttccaaaaagttctgagtgaaaacctcagtcccttttttcatgtgctctagtgaggtaggaggcagaacttgaatccagaggcaaggttcagacactggaccaaactgaggtcagggcagaagcacctccccataagacatgcccatcagtgtgccatgtcagttcactattgccatggcaacacctagaagttaccacccctttccatggcaacagcccaacaacccagaaattaccaccctcatcctagaaatttctgcataaatcaccccttaatttgcatataaatcaagtaggtttaaatatgactgcagagctgccactgagctgctactctaggcacactgcctacggggtaggcctgctctgcaaggagcagtacctctgctgttgctgtaaactgttgcttcaataaacgttgctgtttaacaccaccagctcgcccttgaattctttcccatgcaaagccaagtagtctcctgggctaagcccccatttgggggctttcctgtcctgcatcactagtgccttgctgctcaaagaggggtctcagaccagcattggtattgctttcattagaaatgcagaatgttgagcctccctccagaactactcaatcagaatctacattttaacgagattccgaagtgatctgtgtgcacattaaaatttgagaagccccactttagcacctcacctttgtgacagttaattttcctattgagatgcttttttaaaagccaaaagatttatgaagagaaaccagaatagtgatccttttttagcttacaaattgtgtcttactgtgctgtatgttaaagtgtggtgaaatattttacctctagaaagacaggacattacaatgtctagaagtgttttaatgttcagtaataggtaactgatgaccattttattttctctcccctaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtatgtattttacatttttattcttatgtatctggtattttgtagttaaacaactaagcaaatatcaaacattttaataccaaactctgacactttccaatgattatcatttgaaaattaattatgagcacctgaagattaatgtcctgaccttgtaagggcacattcccattcccaacatgatgtggaaaactgggaaaataacgtgaaagtcatccagttcaacttgagaataaagcagatggggcactctgtcaacaccattgtggaacaagcttttataagtaaacacataaaatatgttttaaaaatcttttaaatgtgcttatgcattacaattaagcatgattataaaacacttttattgtttttgtccataaagacagttgattagattccttagaaaataagtttcagtattatatcattgtatgctgtatatcagtcatgataaccatttactttccagtctttattttaatgactggtaaaagaacataggctcttctacaggctatttctgaatccttttttctcttttgcatatccaccaaagtttagcagtggatatagaataagcaaattagaaccaggacctgtgagacaaacctgaatttaataatatgcccatatttatgccaattttaaatttttaacagaaaaaaatgtggaacagtgattaaattccaaatgagctacagaaatagtctaaatttgtattatgtagcatttgtgcctttattttgagtgtttggtttatttttagacttattataccgtattataatttatacaaaattttttccaaatgagtttttaaaaaagtttattccaccattgtcacaactgtaataaattaatttagaatacttttttcttatttgtgttataaaaggacctctattttaaaagttcataaatgattatataatattcattcaaataggatttgtcattcatctggctaatgttatccaagattaataatccaaagagtgttatattgtcaccattatgtaaatagaaacatgcaaatatttctatgtggtctattttagagtccttatacaaacatcttcagggatatatttaggaatttgttttccccaaacattacttggagactctgtagcaatatttttctagccctgaatgaggtggcctacccattagtaatagtagctcactccagtaatgaacttggtgctcaataaatacttgttgttgtaggctttcaaactattgaaatctgttagatactataatatagctgaaaattcaacaagtatttattcctcaaggtcatcacaggtgatggtccgtaagtggagcatgcgattgctaccatttttataaacaacaatggtaatgctgagtctttttgttttttccacaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggtactgaatgtgcttgttatttatctgatgctagtaaaatactttttattagtataaattgtaaaacataaaattttacatgccctgtaatggaaatttgattttggtatactgcgggaggggaaagaattgttctttaaacaatgtttttgcaaaataattaggtggctaattcaaaattatttaagtaaaggctgctaccatccttttccatacagaataaaagcagaaaaatagagggttgggttctccccctttttcaatgttataattgcaatgagtgctttcagtattcaacaattcattattttaatgttttataattggctgtgctccacaaaatgatgaggcaattctcagtaaatatatacaataaaattagaaccagtaaaaatacaaaacagaacaggaagacaagatcaggagaaaaaagtcgaatacacctctgctaagagtgtctccacagcttctcttttggctttgagattttcaatacaatgagaagggagaccctattatttacaaagctcttgttatcaaaaaccagaaaagataatagttccacaggtgaagcttttctagcacttagctctaaaaaaaaaaatctcagggagcacttcatggaaggggtttgattatgaggtagactatggttttcctccataattcccaatccacaaatgtaatttaaggggtttccctgaagctgtttggtgtagcatttctccatgaaagccaagaacattgcaccaaaacaaatgtgtaaaagcatctgcattttgtaaggatcgaaggcatcatagtccaagtatgtggcatctagtacttaagcttgtttcaacaataaaacctaaaataatatttttctaattagtagattgataacctttaaaccattcactccctgaaaaaaaacttctcttaatgggatactaaggcttttattgttgctcagtcagctcccttgcctccttccagtcatttgcccagatctcaccttctcagcgagtcctatgctggataccatcttaaatgccgctgcctctgccccaaccagtattcccaatccttctgacttaccctgctctacctttctttttttaataacacttaccatcttctaacacacttgatttccatgttaaaaatacatttaccagtgtctgccttcccccaacagaaagtaagttcatgagaagagggatctttgtctatctttttcactgatgcatacccagtgcctagatttgagcctagacattgtggacactcaaacagcccatttgtggatgaatgaatgaactgggagagcaggtagatccaggttgtagtctccgagtacactgggtagtgctgtttttctgtattgtatagatatcaaataagaagatggtaagaactctgtggcctctttcaagatgatggtatgattgccttagggaactaatagctaagaagcagcttttcgttgttaaatttcaagtatgttttgttaactggaattggacaaagttaaactgttgttaagttagaatctgttttccattaatagatacttatttaaatcaaaaatttcagctgaaggagtccaatacttgatttatactctaattatattctgaatgtaaatagaacttctaaaggtagtccctacacaaaataccacaaattcagagttcaccgtctgacttgattatatacacattatcaatgtaaggaaaagacatttggaaaaaatactgcatataaatgacacaattggatagttggggatcatattaaatgaggcagttcaagtggataaatgagctccattggcctttatagctagggaaatcacagctttctaggaagagaagatgagaagaaagataaaacagagatatattattcatgtgatggaagaagatactgacatagtttagaaattccctgaccggatccaagttgaactaaggccagactatatcccagatattcaaccaagtttaaaccagcttgtaatagtacttcaaaactaagtttaactgtcagtaacttcttttgtgtcaccctagaaccaactactaggtattttatggtgttggattccagagtccctgtaatgatgatggcaaagctttgcccctctattctagcacgtatacaaggaaagagaaagttttgtcctccttttgtttaattctcttttcccttacacctggagcagtatcatccagtaacaggttctctgtaatggtttgttagactaaattagtacaacttaaatacgtccatatatgaccaggttcttcttatgccaagagtgaactctgtgctgaatcagttaatgttctactaaataaaggaaattcacattcgctttcttgttaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcaggtatgtggggttttgtttggtgaaggattgtgcaggataggatttccttgttaagaacaactgcattttaaatatgttccttattaaaagggtgcctttgaggctgtatttatgcatctagatacattatgctggaagccagcttaggattgctctggttaaataagtgaaagaccagtcagtatatgattgtactggaagactttgacagcactgccttccagtatactatgttaagaacaaaaaagttatcttaaaagagaaaaaaaaaatgaaagttgggaaggatgagcttagatcaaatttaatgttgaaagtcaatttattattagccaagtgaatgaaaaattattttatgttttgagtcatcttgatttgtccagaaaaatcttattaatttgaactcaagtggggatgtcaatctgaatattttaaagaaatgtgtgtatatatacacacacatacaaacacaagcagtggcaaactaggtaactagagtaatggattataacatgcaaccagccttaagaattttgttagtatatcagtagtatactaatacgtatggatgtctgtaaagggatttcaaaccaccattgtattctttaataagttaaacattcaccttctccaataatatctaaataataaggttgcatattttaaaaatatataactgaaacatagacccttcctatattttcacaaaatctgtactggttgtatccaaatggtttacagcatagtagacagattcatgtcctttggtggtacacttaagttttgtttcaattcattgcttatttgcttgtttttttttttaaggtcctgtaaaaatctcattcaaagcagggccaaaatgcttatctgaatttatttttcctttttgaagaaaagggagagtactttcccaacagctagtttaatcatacccgaaaagaaatagaaggttctagacagatgcaaattatcattataaatttagatgagtaattgcaaatattttgcctgctggagggttgatattttccagtaaagttagacattacatcactatactgatgtaatattacttttatataacagactattcttcaaagtaagcactcttaaacataataatttagcgaactaaagaatgatgagcttttagaatttaaactgtaaagtgcctaactgaagtattcttaataaactctatattttaattgttgtttatattaatactgcaggatttttcatatttgcctattaaccagtgtgtatatatgtgtgtgtgcccatgaggatgctcatttaattttaatttaatttaattaattttaataattttaaattagtttatttaattttatcatatgtctgtttatgtattaacagtgatgtgttacctaacagtagggaacgttctgagcaatgagtcgttaggcagttttatcatgtgaacatcatagagcatatttatacaaaccatgacctattgctcccaggctacaaacctgtacagcatgttactgtactgaatattacaggcacttgtaacacaatggtaaatatttgtgtatctaaacatatctaaacagagaaaaggtacagtaaaaataaggcatataatcttatgggaccaccgttgtatatgcagtccatagttgaccaaaatgcccttatgtggcacatgactatatttatgtgtatgtgtatacacacacacatacatacacatttctttaatacacaactggtgggaatgtgaataatttttataaagaagagtctagcagtatgtatcagtacccttaaggaaaagctagatgttttgaccaataatcctactattagaaaccagtcctaagaaaataaatcaaaatatggaaaatggcctaacatgacatttatagttgaggaaagttggaaacagtgaattatcaacaaaaaggaatggtttaataaattatgcacatccattcaatagaatattatacagtattaatgtcattttcatatttaatgacatgaggaaaatgttcttgataaaataaatgaagtagtaagaatattaaactgtatgcagtagggccttatttgtgtaacataaggtgtgcatataaataatacatatatatgcatatataaaaatattaatattatttaattcagtagaggacaaaggttaacttgataatttaagacaaaatagttttatcaaaatataaacatggtgtatcttgatagtttaatttatgagtttcagtcatttgtttcttattctttgtttcttttccttcctctcctggcccaagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaacttctgttttgaaatgttgtatacacgtggatttttttctcattaaataataattctagta

SEQ ID NO: 332 - DNA, 65890 bp, Homo sapiens
agcaacgcgctggcttgtgttaacaaccggcccgggatcagaggtctgggtcaactggggggcggcagcggcgctaagcggactgtatggcggtggcctaggcccctggcggaattttgggacctttcgcgactctagcgactctcaggctgccttcccttctcggtggcggggcctctttgggcccagcggctgcgggcgcactgtaggacaggaagatccccccactctccaccccgccgccaccggccatgtggacagaggaagccggggcgaccgccgaggcccaggaatccggcatcaggaacaagtctagcagttccagtcaaatcccggtggttggggtggtgacggaggacgatgaggcgcaggtatgagcaggtgtctgtgctttcagaggtggagggggtgggagtgaagtctcgagacggggtccagacctgggggtggcaagggtggaactggggacaggagtgaagatgggggaagccgcgggatggagattccaagcgcagagctaatcctgatcccccaccccctgcgaactgcaccggttgcgaggggctggctgttgtcaaccatcctgtctggggaccagcgctgtgtggtcctcctggagggtcctagcaaactgagtaggcggggttttgccgcgcttcttcgaaaagtggtcatagagctacagggaggaaaggaatcattcttagcaaaatcttgatttgatgacctgatcagtttgaactgaactttttaatacgtagatccctgttaccgagtgatgttcttgatatagatgtaaattttcccatgcttaaatttgctgcgactaaagcctgcacccagaggggaggaaaacgctgttaaattagaaattaagcatttttaaaatatgaaattggaagctggttgttacacgttgggtcggagagaaccgggagagaatagagttgatttgttttattatgcttgtactgtatttggttttgggtttgcttttgttatgaatacaaaattcactcttggaagttgatctgttgagaaattccatttgaggcccttggatctctattcgaggcggaggtgtttagaaaccccaagttgtttgtttcctactaggattccattgatcccccagagagccctgatcgtgccttaaaagccgcgaattcctggaggaaccctgtcctgcctcacactaatggtgtggggccactgtgggaattcctgttgaggcttctcaaatctcaggctgcgtcaggaaccctgtctcttgcgttcacatcctggagccttggagagttccttgggagtggtcagttgactggggaatagagttgagctctctgaggtctgacatttacgcagtaacctgcggagcaacagcattttgcatgaggagaaataggtgttaggggaatttgcctaatcgattttgtggacctattcccctctgggcggggagaattttgaggaacaatagctctccactccctgggctgcaagaaagatcaacaatacagccatactcccaggcaaggggcaaaactgaaaagtatgtgaatttgataactgatggctctcagtcttcctttacttgctccaagaaaaattgggcaacgttatacaaggcaagcaagcgtggatttttttttttttttagggaaaaatactttttaaaagccattgccaaaatagtccaaaacataccaaatgaaacaagtatacctgtgtatatgtgtgtgcattttctccccattttaattttctttcttttctttcattactactgctctttccagggcctaggattctcttccaagaagaaagcaatcaatttgcattaattcatgtttctgacttgttaattactaattctaagagtagtaacattttcgaagtactgaggaaaaaggtagtttctccccaaagaaatagaataggaactttttatagctgggagaaatcttagtgatcctcagccttcttgttttttgcctgtggttgtttttacaaatgagaaccctaagttcatgagaagttaactgagttactcagtttctttactcatagaatgggggtctagagaccctggaacgaaaaaatgataaccttttaggcctctgccttaggccagtttaggaaagatcctgggaactgtttccagttctttcaaaccactgcacatttgcaaacttctcttctgcctgtgtgtgcttctgagacagtatatcctagtggctaaaggtgagagtatcacaactacttcagttcattgtcagcttcatcacttaccagctatgtgaccaaagaccagtatcttaacctttctatcaaatggagataatgacagtactcatgtccattgtaaagattaaattaaataatatatataggccgggtgtggtggttcacacctgtaatcccagcactttgagaggctggggagggcagatcacgagttcaggagatcaagaccatcctggccaacatggtgaaaccccgtctctactaaaaatacaaaaattaggtgggcatggtgatgcacgcctgtagtccagctacttgggaggctgaggcaggagaatcacttgaacatgggaggcagaggttgaagtgagccaagattgtgccactgcactccagcctggcgacagagtgagcctccgtctcaaaaaaacaaaacaaaacaaaacaaaaagaaataatatataagcaaacttatacaataatatagagaacttatagagagacctatatatataattgaaaacaagcagttatcaacatcatcattgtcattgtcatcatcctttatccagggaactagagctcataaagttatttgggccttaaagctaagggattctctagaattctgattgttcccactggcttccaggatgtgagagtgagactggatgcccctgaaatcttacttgctttaatgcagatttcggtctgctcactttatcccttcagagatgtttctaagttgcagctggatttcctaatatagaaatgctactttggctacctgggcttttgatagctgttttatatcattttctttattacagacctaaattgaacctttcagttaccctaaccttagtttttagtaattaaagaaataggcttgaatattgctgcctaaggcagcaggtaaaatgtacgggttattttgctgatttttctgtgtgtatgctttacttctgcattaagtggtatttttttcctgcatctttcacaaaaataactttgtaaaaggcaatagcgcctataaattctatctaagctactacaaatgatattcacagagtattagatttttctaactttaataactttgaaatgttctctgatagaattatggaaaatgtaaatatagattatgagtaaagttattagtaaatagggaaaacaatagtttaggaatctgggattttgaattgttattttcattccatgttgtgaacttctcatagacatattctatgtaaacattatatcttcaaattttctctctataaaaattttgataatccctactgtagtgattccagcgtcttcttttttaaagtgattatcatacttttccagtttcgaaacaataaaatagtaccagaattttggtggccattttctaattgtgaggaacttaggacatgttgcttgccctttctgtgtctgtttcctcatctgtaaaagatatttttagaaatgcctacctcatcgaattattgtgagaattaaagtatttgtaaggcatttagcacagtgcccagcacatacattccaagtgccccataaatggtaactttctgctattattaatgactctagtcataacagctttattaaattattaaataaattcagatgatatttacagggttatatggtttggctttgtgtccccacccaaatctcatctcgaattgtaatccccaggtgttgagggagggacctggtgggaggtgattggatcatgggggtgatttcccccatgctgttctcatgatagtgagttctcacgagatctgatggttttataagaggttcttcctctttgctctctctctctctgtctttcctgccacctgtgaaggaggtctttgcttcccctttgccttccgccatgactgtttttcttgaggcctctctagccaggtggaactgtgagtcaattaaacctctttcctttataaattacccagtcttgggtgtgtcttcatagcagtgtgaaaacagactaatacactgggtatcaaaacctaccaaataggaagatagttctcagattgtttttctagtattaatcccagtgtttatgtggctctggcttcctacaggaaggtagaggtaatgtagtttaaagggtgctttatcccctggagagtgatgggattggcagtgaaattcaccttaatcatatgttgaaatcacaagatatctaatttatctattttctatttagttttgttcccctcattctaaagtatcccaaccccctttagagcagtgcttctcaaattttaatgtgcatatggagcacatggggatcttattaaaatgtggattctgattctgtaggtcttagatgaaccccagcactccgcttttctaacaggtttccaggtgatgcttgtgctgctagttggaggacctcatttcccactttgaataacaattaatataatgattagttgactggcgtaggtatcatgcctgaacttccttgctcaaatttgctctccctctgagaacccatgagaacttccacaatcttttagttgatatcatatcctgtcactgtcagtaatacttccatgaactgtgtgcttaaaattgtctagccttgtttatagggtttttgcaagaaataacctctgtagttggctgcatgtgtctatagtgccagctacttgagaggctgaagcaggaggatcgcttgagcctaggaattcaaagctagcctgggcaacatagggagacccccactctttaaagagaggagagagagagagagagagagagagagagagagagagagagagagagactccttggttgtccattgaggagtcaggcagagaactaaggaacaaagaaccagagtttctacattagacagacctgctggcccatttattattaatagctacgtggctttaacaagttaggtcccagggcctcagtttcattaagagggataatagtgctacctttacttggtagatttgaagactaattgagatcaaaaatgccagacacatgaaaggaccactataagtgttagtctctttccctgtaactgagtatcaaatgagcaggtttctccctctgaaatgtccctgggtaaagtgggaaataagttcatcctataatttgaatgaagtaagtctgattgtcttcaaagcaatttattaaacttttgatcttaaaaggttttgtgaatgcttttacaatttctccataaacatcttaagatgatagtattttggtatttacatatgtatgttctgttttgtttctattctctgcttgtgtgatctcatttacccaaaatcttcaattgtcacgttaagcctatgattcagaaacctctgccccaaatttttctcatctccaacccccaacacaaacctcttcctccagcattccctgtctcaggaaatggtgaaatcatttatgtaattcctcaagccagggaattgtcttcagctttttccttctttctcccactgcgtccagtaactcattaggtcttgatgaatctacctcttgatgtttttaattccatttgctgttgtctataccagttgctgctacctattcaaggcccaaagttacaatctacctccaacccagtcttctcccagtctacctccaaatcagtctcacacagcatacaagatgatcttttcataattaaattcttctggttaaatcttgtggaaataaatgaaggctaccacaataaacagagactgtttattcagcggttgctatagggagggattcagccactatcactttttggcagagactccaatgcagcctgggaagctttatagtggtaaaaagaaaggtgtgggggaggcttcaggtctactctaattgtaggttgctgacatgggaaagctagaggtggactagctggaagtagggtatcctctgtgattgacttggaaagcatatttggctttctctggttggtcttaagttggaagcagagggacaaaaaccgggaaagctggcagtcattggccaaatcctgacttttctgagccaattgcagcagaggttgttggccagagttattttgtcacatatagtctgaccagttttgtttatatgttcagtctcaaaccattcaatggctttttaagatccttgtgttacatacaaagccttctataaaatcccatgccagaccaatagctgcatgaggtgaggacattgttattccccacacctagcacaattcctgaaacaaaaaaaacctactaataaatagttatagaaggaggaaaagtctagggaaggtagagggagagagagaaatctttaaaaatctgccaagcaggtaaaactagagtaacatgaaatggataatgcaagataaatctaagaggaatctatgctttaatctttactactctctgttcttttaaaaattatacctgctcatttggagaaaaaatctgaaaatacacacaaatattagaaagaaaatcctgcaattggggtggcccaagtgcagtgctctttacagctaattgattacagctagttacggatttcttccttttccattcccactgcttcccttgattagccttaaaaaaaaaaatcctgcattgacatttcattccaatatccttgtctaaccttctaaacaaatatttcagaaaaccagaaaagaaaaacccactgtgtgtgtgtgtgtgtgtgtgtgtgtgtgtgtgtgcatgcgcgtataaaatctgagagtgtaggaggaaaagagaaaagacagctgaggtagtggtggatatcactgccaaatccccaaatcttaaaaggcagaagtctatttaccaaaattttttgtaacagtaaatttaactatttaacagtaatatttaacaatttttaatggtaacataagaccaggtatagattagtatttagtaaatcctttttaaaattattttaaaaagtaaaaatggctgggcatgttggctcatgcctgtaatttcaaaactttgggaggctgagactggcagattgcttgagcccaggcattccagaacagcctgggcaacatggcgacactctatctctacaaaaactacaaaaattagcaaagtatggggtggtgtgcctctgtagtcccagctgctcaggaggctgaggtggaaagattacctgagcctagggaggttgaggtaagcagtgagccgtgattgcaccactgcactccagcctgagcaacagagtaagactctatgtcaaaaataaataaaaataaatataattttgagtaaatgagctcattcagatacttactccacagacttaaagttagcatgtttcattacaaattgtttttgatgccatgacatctcagttaggattaatttctaaaaattgtttttgaaagaaatttcttgagatcagaatatatgaatttgtaatttttaaaggcaaggaaatactaaaactaagacaatgaataatgattatgtagaagtatggaaaagtatgtattgcagatttaaaactcagaagctgccatggtattaactaacactaagtgaaattgtgtaaaatacttatgcatgtaaggaaaaacaaaatatataaaaataaaaatagatgcatttactacatgataggaataagtaggattttttcgcttttgtttgtatcatcattacatcaccttttcaaacatttattttaaagtagaagtaagcgtgaaagcaggaaagaggatacaaaggaaactgggagagcttaactcctgtaatgggggtaagcactgtgacataaccctgaattaagataaaatgtcaggtagcaaggcattaacccccaagataaatatagtcaaaaccacacttagaatttgtagatccctgtatcatcataaatactttacctctgatcggattatttcatttttgttgttgttggggttgtttgttttgttttgttttgctatttgtatttgtttgtttgttttttgagacggagtctcactctgtcacccaggttggagtgcagtggtgtgatctcgaatcactgcaacctccacctcccgggttcaagcaattcttctgcctcagcctcccgagtagctgggattacaggtgcccgccatcacacctggctaatgttttgtatttttagtaaagacagagtttcatcatgtttgctaggctggtctcgaactcctaacctcagatgatccacccgcctcctcctctcaagcgctgggattataggcgtgagccatcacggccggccttgttttgctattgagttgtgttccttgtatattcttgttattaatcccttgtcagatggataggttgcaaatattttctcccattttttgggttgtctcttcactctgttaattgttttctttcctgtgggtacactttttagcttggtgtaatcccgtttgtctatttttgcttttgtggcctgcacttttgaggtcctacccaaaaaaacctgtgcccagactagtgtcctaaagtgtttccccaatgttttattccagtgacttcttagtttggggtcttatatttaagtctttaatccattttgatttgatttttttatttggtgagacataggagtctagtttcattcttctgcatatgtctgtccagttttcctgacaccatttattgaagagactgttctttccccactgtatgttcttggtacctttgtcaaaaatgatttggctgtgaatgcagggacttatttctgggttctctgttctgtttcattagcctatgtgtgtgtttttatgccagtaccatgctgtgttggttactatagttttgcagtatattttgaagtcaggtagtgtggtgcctccaggtcttttctttttgctcaggattgctttgggtgctcgcggtctactacttaaactttggatgatagtacccatttccttccccgtttacctatgaataactttattataatatagcctcttcttggttgcattttccaaatctttattaagcaactaacaatattatatgtcaggcccagtgttggatgccgggagtgcctgaaagcaaaaaaatttttgctcttgagagaactttggggcagggagtggtggggaacgaacatgtagaccctttcagaacaatgtgatgggaattttaatggatataaacttagggtgctatgagagcacggcatttttctagcctttttcatcctttgggaaggtaacacctgagcttcgtcttgaaggacctgtgggaattaaccaaggagaggaataggaatgtaacaacatgagtgacaacagaggagatgtgagaggcattaatggggagtcattgaatagtttagacgggtcatgttcagatttcagttttattgttctgatggtagaatagaggatggtgttgaagggtgcaagagtggagtcgacgagaacagcaggaaccccttgaaattaagtaagagctaaaaactgaataaatcagtaagatggaatggactcaagaaatatttaagatgtaaaatctgtagaacttggaggttcctgtttttttaatgtggatgactggaagaatgctggtactaactgagataaggggatacctagttgagaaaagcaatctcctacctatagtttagaagctactcttaccatgtatctgcataggcaaacttagtgtaatgtgtatacaagataattttatttctcaacttatggaagtactattattctaaatattttcttgggcccttcagggctgatgaaattttaaaacattaagattatacaaaatactagaattcaggaggggttttttactccaaaatctatttattcctgtgagttttcatctactgttcattctccccttactatcgtagtgtcataaaacattttttaagttaccaagggaaagtatcatataaattagtgtgttagatatgacttattgatatagaagatgatctagaatagtaagagttgtatgttttttaggatgttttcaagcctatggaccttaatcgtgtcatcaaactcctcgaagagactgataaagtgagtaagctttgagagaaaattactccgctgcattacttacaaactatttccctgaaaggtaacatatattccttcaaatgtaagtctcatttatctcgttttgttgaaaacattttaaatagtacatatcttatattcaaggactatttaaatttagtatgaatatatttaatgaagtggggagactggaggaagagaatagatttgcttttatgagatagacaaacccatggtggctgtaacagaaggaatcctaagagtacagaaaggatcatctagcctctgttaagtgcttgttacctagtaggattggaggacagaaatggtagaaaacagggtaccgtggtgtactaattatgaaatcaggatagatacacacaaacatgtacacatagataatttattttgagaacaatcatatataagatgtaatggaaattaagttattttagacacaagactcaaaattgggaaagcaggcattgagagaaaagacaacaaatgtatatgcacacatgctcatataccacctgatgttatcaagaatcgactgaatgcctaaaagccagcacacgctaggaacttatgtggtgatttccaaaaaggaatacgtattgttagtaagtagaaaatgagttgaccacaaatgcccatcaatgatagactggataaagaaaacgtggacatatacaccatggaatactatgcagccataaaaaaggatgagttcctgtcctttccagggacatggatgaagctggaaaccataattctcagcaaactaacacaggaacagaaatccaaacactgcatgttctcactgataagtgggaggtgaacaatgagaacacatggacacagggaggggaacgtcacataccagggcctgtcaggggatgggggactatgggaaggatagcattaggagaaatacctaatgtagatgatgggttgatgggtgcagcaaaccacatggcacgtgtatacctatgtaacaaaccttcacattctgcatgtgtatcccagaacttaaagtataaaaaaaaaaaaaaaatttttaagtaagtgggttgaccatagtatagcctatcaaaagaaaacaatgtcctatgaataggaggcacaaaaatttggtcactgttttaacattttttattctctgcttttttacatataaaggagaaaaagtgactattggaataatttatctttttctggctatcattgttgtgaaaagttattttttattgtgactatatctacatttccttaaaaaaccacaactgcatagagtgcctattagctgtttaataaggctacagagaaaaagtatagacaatatcacagcttttcaggaacatttaagattaaaaggacagacagaattcagtcatggaaacacatcactgtgtagaagttttacttgcttattttcatttttaattgacttaagatgtttggcttgcacagaacactgagcatattttagaagttaaaaatacaatctctacagtcagctttccaaatttgtcttctaacaccaccactttttagctgtgtattttggacacgttactttaaaatgtttcagcttgtgtttcctattctggaaaacagagatcatagtagtatcttcctaatagggtcattttggaaattaatgaagtgatatgtatatatggtacccatgtggtacatgacgtagaaaaaatattcaatgtactttagctgttgttaatattatttctggaaacaattactgcttttatattaacctggttttgattcccaatttcctaatcaaatttaaataatagtttatttttgatacataatgtctgtaaatgtttatggggtacttgtgatattttgttacatgcataaaatgtgtaatgatcaagtcagagtatttaggctatctaccacctctagcatttatcatttctatgtgttgggagcatttcaaatcccctcttctagctagtttgaaatatacaatacattgttgttgactttagtcaccctactttgctaacaaatattcactaacacagtcttcctatcttttgtaattatcattctagtctatatctccatgagaacaacttttttagcttccacacatgagtgaaaatgtgtgatatttgtctttctaaacatggcttatttcacttaatatcttctagttccatccatgctgctacaaatgacagaatttcattcttttttatggcttaataggattccattgtatatatagaccatattttctttatccattcatccattgatggacacttaagttgattctgtatctttgctattgtgagtagtgctgcaataaacatggaactgtaggtatctcattgatacactgatttcctttcctttggataaatacccagtagtgagattgctagatcatacagtcgttctgatagtttatttttaccttcactgtttcagaaaacattttataacgtttacattataatatagtaatttaagaattacttgataattttaaagtgtctacttttatgttgaagaattttttaaaatctcaacagatttaaaagcacaaaagaactaaaataggtgatctgttttaggatggcttggaagaaaaacaacttaaatttgtcaagaaactggtacagtgttatcagaatggacttgtatcctttacatatatatgtatgttcatttcatttattctgaaatgagaatttcttttagaaaatgtgttagttttccattgctgttgtaacaaattaccataaatttgatggcttaaaacaacataaagttattatcatacagttttggaggttagaagtccaaaatcagcctcagtggactaaagtcaagatgttgacagggctggtttctcctgaagactctagaaaggaatcatttccttgccttccccagcttctggaggcttcctacattccttgcctcatgccctcttccccccactggcatcactctcacctctgctgctgtcgtcacatcatcttctctgtctgaccctcccttcctccctctttcctttataaggatccctgtgattacggtgggcccacctggataatctagtataattttctcatctcaaaattcctaatcatatgtgaaaagtccctttgctatgtaacatagttacaggttccaggaattaggacatagatatcttggggaaggccattaatctgtctaccacagaaatactggagaggccattattctgtctaccacagaaaatatctaacattttatgttctttataagactgtattttctatcagataatgtaaataaaattgaagaaacaatataacacaagtaactgtggataatgtcagtttttgtcgattcagaaagacaatggatgtagttagagggccaagtcaaagtcattatttctattaatttacatgggcagttgtacctttgataagctctccacccttgtaaagtaatagaagctcatgaggttgttagcaagattagatgagatcatgtacatccaagtgcttgataatctgcaaaatattatataaatatattatccctactaaatatacgaccctgaccagaatacatgaaaaccagtgtgtcttaaaactatctgtacgtaaaagccaggtgtgatggcttacacctataatcccagcactttgggaggccaagacaggaggattgcttgaggctaggagttcaagaccagactggtcaacataccaagaccctgcctctacaaaaaaacaaatagccaggtgtggtggtgtgtgcccatattcctagctactgggaaggctaagacaggaggattgctgaaacccaggaattcaaggttacagtgatcaaagattttgacactatactccagtgtgaacaactgagtgagaccctgtctcaaaaacaaacaaacaaacactacctttggataagaaccagtttgttttgttttgttttggggtgtttgtttgtttgtttgtttgtttgtttttgacacagagtctccatccagccttagttgcccagactggagtatagcggggcagtcatagctcactgcaacttcaaactcctgggcttaagcgatcctctcacctcagcctcccaagtagctgggactacaggaatgcacccaccacacccagttaattctttatttttttgtggagtctcattatgttgtccaggttggtctcaaattcctcagctgaaacaatcctctcgcctcggcctcccaaagtgctgggattacaggtgtgagccaccacagctggccatttttttttaacatttacatatatatgctattgtaaaatacaataaaagtatcccacaaatattagattgttataaaagtttttatatgtccactctcactttatgtattcattttgtcacagactagtaaatatacttccagaactgacagtggtccatagaccacactttgaatagtattcatctaaatcaagcttgtccaaccctcaacctgtgggctgcatgctgcccaggatggcttggaatgcagcccaacacaaatttgtaaactccttacaacattatgatttttttgataattttttttagttcatcagctatcattagtgtttgagtattttatgtgtgacccaagacaattcttcttcttccagtgtgggccagggaatccaaaagactgaacaccctgaaaatgatcttgaacagttgtctgacttggtctaaagaagttatcaagcccgtgcattgtggctcatgcctgtaatctcagcaccctaggagtctgaggcaggaggatcatttgaggccaggagtttgaaaccagcctgggcaacatagcaagaccccatctctaaaaaaaaaaatagccatgtatggcgatgcacacctgtagttttatcttctccagaggctgaggctgaggtggaagggtcgtttgagcccagaaattcgaggctgcagtgagctatgtttgtgccactgtactccaacctgggtatgggtgactgagtgagatcctgtctctaaaaaaaagaaaaaaagaaaagttatcaagctctaatattagctcattccagttcaaaacctcttaagacttccattcaggaaaatgtttcttataatttaatctaaatcttttattatgttttagccttggttttatttggacctgttccatcttagggcttgtgtatatcaagccctatttactggtagctgaaaatgtctactagcagggatttcttttcctattttaacctgacatctcaacacctccattttttttttcttcatgttaaaccgttggtggcaattggctctatttctaaatccctctcataggctggctatagaagttgtaaaacttagcaaagttagagaagtatcttggtcacttctctaggaagttaacagagctttctatttccagtgtaccctgctctcccatcttttcctaaaaggtcctagaaaaaggctaggagtaataagattcaaccaagaagtgtaagtcacatctaccataatttcttagctgtaaaacaaaatcaatgaaatgtgtttatgtgccaataggatttttttttttttttgagacagaatctcactgtgtcactcaggctgcagtgcaatggcatgatctcagctcactgcaatctccgcctcccggcttcaagcgattctcctgcctcagcctcctgaatagctgggattacaggcaccaccacgcccagcgaattttgtatttttagtagagacggggttttaccatgttggtcaggctggtctcgaactcctgacctcgtgatccacctgcctcggactcccaaagtgctgggattacaggcgtgagccagcaggatttttaaatagataaaataaaagatgcttttatctgaatatctagaaagtccatattttgctttcatattagtttcagataaaatcctaaccaatttaagccttaaacacaggaaaatgcatctcagtttaatattaataaaatagtggagtaaagtaatgtttaggttgcttattctgagacagcatatgtttgtgtgggcaggggtagggggtgaagatgaagggtataattgagcctaatcagtaagttaatgttttcaatgtgctattactcattgccagtgggaagttattgatcaactgaatctgtgttgtagcagttggtaatccaattctaaagttgtgagaggaaaaaaattttgagtaggcatttactgaggcaaaaatgaaatggtttttttaaaaatatggttctaaatttccttttttagacttcaaaataagaataattaaaacagtatctaccacatttggcaaaatagttggaattctatagactttcttcacagaaatactataaagaatatgttaataaagatattaatctgaattttatttcttaactaaaaatattaaagccattaagggatttagcacagatatttaaaattctgaatctgtgttcaggaaaaataaaaaaccagcctcgttttatagaatctgcatatgatatcataaaactgtgtgggtaagttatctttctttaactttattttgtagtaacatggagtattttattatgtttcttatatcacaaacatactatgcattatagtgtagcagattgctacagaactcagaaaacttcagttcatcacttgattccagcagttggcatttcaggtaatcagtttgctgtggtctgagattgctagccacaagagattaaattctaagtatattgaaatgctttcttgtaattagttactctgaagtaaatgctaaatattagatgtaaccaaggaattatagtattttcagaaaatctttgagtgaacttatggatatgcttataatttcagtctagtttttttctctgtctttagaaaatttgagtctcaaagatatattaggttatatatgtcatgttttatttgatttttgaaatttgagtgaagaataaaaatcaccaattacatttgatatatattttaaaaatgtaagttagagataagaattgtaaaattaacatgtcttattctttctactgttggttctctaacaagttctgggaactgagtatatggtgcttccttggtgccacatagtggctaatctaggtatatattaaaatatccatttttagttgctaaatgtaatgtagtagggaggaataaaccttttggacaattttaccttctgaacctttctaccaatttaactttttagatagcaattatttattttaatatacaaataatatataaataatagaaaggtttagtagaattatgcatacatgataggttctaactctcacttttagatttactagcaatatttaatatgtaaccacttaaatttgtattttctgatatctgaataaaataaccaaaataatatattgaatgcctataccatgccttgctttttaatagacaggtacaatggaaaataaatggttgctctggtgttttcaaggaacaaattggaaattattattatattgacatacgattatataatgtaaaacttttaaatctcaaggctttgcaaatcctagaatgccaagtttataagaattgctttcaacatctatgctcctacagagctctgcacaaagttcattgtctatgaaaacttgtgactgaatgtttaattgtataatatgataaatcctttttagctgcagtcttcattttccctcatatttcataattattcacattgttaattttttctacttttctaatttcagcttatgtctagataacttctctatgcctcaccctcacttgtttctcttttcaagacatttttggaagataaaaacaataaaaatagaataataatgtcaagcctttccgttttggcctccaagtagtatggttttctcatggcattagaagtataatgctaattttttcataaactttttggttgaaaactcttctgatgctttatcttatagattgtgtcctttgctagaaaaggaaaaagtttgggaacaaaaagtactagttttagagtccttcactttagagatccaaaaagcagctggataacaaatataatacattatttgtttcaaatgacaaattctgacaaacactagaaatgaacttctgtggcatttataaaattgtcctttttgtagcttgctcttcagatatctttaaattcaaattggcctgtatattgctattgatacatcctcatgtgatagttctcaataccattttcaactacttctttaatttttcttgaaaaatatgaattggccaagcgcggtggctcatacctgttaatcccagcactttgggaggccgaggcaggcagatcacgaggtcaggagatggagaccatcctggataacacggtgaaaccccatctctattaaaaatgcaaaaaaaatagctgggcgtggtggcaggcacctgtagtcccagctactcgggaggctgaggcaggagaatggcgtgaacccagaaggcagagtttgcagtgagctgagatcgtgccactgcactccagcctgggcgacagagcaagactccatctcgaaaaaaaaaaaaaatatatatatatatatatatatatatatatatatatatatatatatgaattaaaagtcctgtctctataggatatattgtactttaaatagtacaggaggttcaaattttgaactcatgaaatgtcaagatagtttatatatttaaaaaataacttttatattttctttgaaatttagactgacccaggtttatgtgctggatcttttatgatttataaataagttactttaaaataactttggttatagaagttgtgaaatgcgattctaatataattaatatttgttaacttgaatgccttaatgtctgcaaaaccattctgttattttgtggatagttactaacccagctaataagcaaaaatgcactgatctctaagaatgaataaactatcgattttgcctagagttttgaaaatttcaggaaaagctcttaaccagtttttaagttactggtgagcttagatctatggtttgttccagattatccaatgtcgtactaactttgatataattatagctataatttattactattttgacctctaagagaaagagggttcctaagtttttttattcatgaagcgatgcaaaatggctttcttaacctatgccttttacatccatttcttaattcttataattaatataatattttctttttggtcagttcattagaaacattttttttctttttttctttttgatggaggctcgctcactctgtcgccaggctggagtgcagtggcgcaatctcagctcactgcaacctccgcctccaggattctagcgattctcctgcctcagcctcccgagtagctgggactacaggtgcacgccaccatgcccagtgaatttttgtatttttagaagagacggaatttcaccatgttggccaggatgatctcaacctcttgacctcgtgatccacccacctcggcctcccaaggcgctgggattacaggtgtgagccaccgcacccggccccagaaacatttttaatagttacaatactattaaactgtaatactgtgtattacaactggtagttaataattgtcaatccccagggctaaagaatagaatattattattaatttattctttagaaatgaactctcccccacttacaaatgatgcttcaattaaagactttattaaaaattactgttacaattcttcattcttattgaagcttgccatttttgaaaaagaaagtgtcggatgaaataacttatgctgaagatactgctaattcaattgcacttctgggtaagttaagatttccttaaggtatagggatgtaacatacgacaggtcctactgacaagggaatatctattttccccaagtttcactaagaggactccttctccatgtctaggatcttctcttgttagtgaattaatcacagtgtgcttggtgataattctggtattgtattctgttcaggttgtttcgtgataccaataaaagtccatcttctaagtacaaggacaggctgataatgtagtttgatgaattattatttagtttaatgaagtgtttgttaactatttttgtaaatcagaaagtgtacataccctttttaaataatcacaaaaacatttcaactttgaactctaatattgaattgctgcaatcatagaattattcattaaatgatctaaaattttaaatcaaatcataaaatagcatattaagaacttcagcataatgcacataaagatgcagatgcctatattttgtacacaaaaatatgaaaaatatcataaaagggtaggcacttatgtatgggttatcacttgattttctagagaaagaaaacaatttcctaggaaactagatcagggaaacactggctctttgagtcagctcctgggacatgatggcatgttcccaaaacaaatcctacattaaatctatacttactagtttaggtctttatttgtacaggaggaataaaagatacacaattgatccagtgcatttttaaaaatatttacggaataatgatgttcccagcattatactccatatagaaagatgttagagattcaactggaatgaagaaaaaaaggatttttatttttaacatagacactaacccttttatatctcagtaggttttatagtttttagttactttgggaaaactacctagggttcacctactctatatcctagagtaggtgaaggtgttgttgagattaggttaaacatgaagggggcaatttaaagaaaaacaccttaggaagcaggcaggttcagaaatatgggaatttttaattatgtgaatctctatcatcagcagaaatttacaatgagaagccaacccaaaagaggacatggtagtattaacagataaaaagtgtagtttttgttggtaacattattttttaaaatacccctgttgccattatttttaaatattgcttccaagagtgttgacagtcacttgtattataaatacatggctcactttttactgagtgtcaacttattctttgcttaatgactggtaccctgcctgcagaacatgttactatctcatatgacaacagtatgaactcttaactttaaatgagcttccttcgctgattactgactgcgagtactgctcttctgtttcttggtttttttaatggctggaaacattaatttaaactaaaataattgtatataagatgaaatgttgaacaaaaactcttcatgattttagttagaacttccagtttctactacgtactaataagttatattacattttcttccaaatgatacatagatatttctgactcagaggcaagattctggaaatggatgggggaagaagttggtactctgccctgggattatgaaacaggaagctatgataaattatctaaatttacaggaactaaaacagtggaaaagcagacgaaagaccctagaatttcccataagcctgcatatttggatagtcttgttggaaaagcttagttgttcttgttgcctaatatgttttaaaacctaagtagtgattttgcaactccaaaagaacagtccgaaaaataaataaaatttagagttagaataatcttaaaactgtcttttaagtgatatcttttgcagagattctcctgaagctagggtcaggctttcctttgtgcttcctccttctttccacttgccaccccacttgctgaccacctccagagatgagcgtcttgcaagggctaatgcaaaagaggaattcctaattattcttttactctcagagagtccaaccagttctagtttagttctaaggtcgatattactgactaccgctgtccttgggcattcagagaacctggatcatttccagagtcccacagatcattttcagatacccttggggatcatgtttataggacttcaacagagtagatgcaatccagtttgaaatacaggctgaagccaatttaattgtagtttagatatgactgaaaacgaaccttcctattcgccaaccccatgcagacagcttgaacataaaactattacccttgcatgtggggcagctgcttaaaaactcactctcttccagtctgccaacaaactgaagagcaaagttcacctggaacttctctaagcaaagaatgcattagtaaaggcaaaaaattactgaccctctagttagggagaaaaatgctaacccatatcttgtcaaaataataatagtatctaacacatgtagaacttacaacatgctagatgcttttctcagcccttttctcatattagctaatttaatcctcacaacaatcttaaatgtggtaactattgttatacctgcttaatagatgagaaaagtaaaacacaagtttacatgggtagtaaatggcatagccaggatttaaccttagacagtctggttctagcatttgtattaataatcatcattctttcttccctagaaaggagaggctgaattgattgaggggccaaatgtataaggatggattcagggtactgtttatatgtatgtatgtgtgtgagcatatgtataaaaatatgcatataaattgaacatgatccagtttgaatctctgagaatatttttaataatcatcatattattaacattttatgcctaaattctacaaataagcttatgacagtgttgttaaatagcacctgtttatctttctggcaggtgacttaatgaaaataccaagttctgaattgaggatacaaatttgtaagtgtattgttgatttttatcatgcagaaccaccaaagaagcatattccaggtgaagtttacaatggtctttcagtgataacttgtgtatgtagaaaacagaacattctcatatctctttgaatttgacagacacagtgggctcataaatgtaacacattaaaaagaaaacttttttgtagtcttgagctctttggtcatcttttgaaagttatatatgtatttttcagtttttgatttgcatatttttattctgatgctaaatatgaacaaatttgtaaagtgatgcccaatttagtttattaataattataaatgttactattatgttatttaataccattgataaaattattttttaaacactttataattatttataatatctgcccccactcagttaaatgttaagctaccaatgccagggccattctccatcctgtttgggaaaatagttctatgtgttatagctaagggaccttaatatatagtggtaaatgagccacactgaattggttgggaccaagacagtggcacgtgcactgtgaggatataatgttaagatgtacttcttaccttcatagtttctgtaatttctaatcaatctaggaagggagagaggatataaacaataatttcttaagttatatgattcttaatataggtggaaataagtgtctgtggtagttcaaaagaaagattatttaagactaaggaaaaatgggaaccagaagtcagttaaaaaaagacaatttaaaaaaaaaaaagaaattcagggaaaacagaaggaagtcaaaaagtaaaacaaaaaaatggaacagcacctaaactagagaaatgaataaggagattattaaatgtccagtttgaactgttgatgagatagatggggaaggagtgtcttggtagataaaagatattggatactaaaagcaacaggaccagaaatacaggtttggaatccacccaaatagagttgaaaattgaagccaccagaatggttgagtttgccaagagataaaacatataagcagcaaggcatcaagaatgacatggagagtgtccatattgaggtttggaaaaaatgattcaaagaaattggcagtgaagggaggctcaaagaggaggaagaaaacctaaagactgccatgtcttgtgtgccagtgaatcaaatatttgacaaaggaggagaaagttgtctcagtgtcaaacgctgcagttttctgtaatggaagagttaaaaggccaagttaatgtgacacttgaaaagttgtagttaaatctttgacagatctattgatataaagtggtcagggcagatgcaggattaaagaatcagaggattgtgagagtagaggcactggatttgagagtgagagagtagtggcagttcatgaatgcagacatatcttaagatcagatggtgaagaaaaagaaagaagatggagaacagctcagctagtgcaaagtcagagaaaggttatttgggttttgttgtttttaggataggaagaaatcacatttgtaggcagaggagctagaagctggtaagaaagaaatgggaaggtgaaattctcaaagaaagcacaagaggatggaattaagagcacaagcttagagttaaccttggcaaaatacagacgcccttcaaagaaagggaaaccagtggtgtaggacttaagaaaaaggagtattatggggcaaagacgtgaggttgatttggtcagtctctgaaaattaggagtcagtgctctcactatcacacagttggtttcaagtgatgggtatggccagacatccgggaccacggctgaaaagtcctcagtatggcagttgaaagagacatagccctggagacaggaattaagtccatgagctttaatggtgttatatccctctgttaaaatgtacctgcaatagaaaaagatacagtaagtataaagtacattttggtccatccatatgatagactattatgcacataaaaatcattattttagaaaacactttataggatggggaaaagcttacaataaaagttttagtgagtacagtagaatataaaattctgtatactagtatgttgttaaaattgtatgcatacattaaaaatatcacaagaaatatatgaaaatgttaatgttatctctagattatgaaaatataggcaatttttaccttcctcttcttactttttaaatgctttttataattcatgaggtgagtagctagagcatatcatagaaagctcatcacagcattggacagggccttgtccacagccagagatcatatttacaaagataagacaaactgacagatacctcagaactagggcaaagttaaagaatctagttggactcaaaaatcaaaaagtcagggtgttagataaatgagatcactaagaaaaaataaagcctcatctcagtaaatgaggaccctttggtgtttatttaatccctctagttgaatgtaattaggtatacctgcatcaaaaggagagatagtatttctcacaggtgctaagacagaaggaatttttataagacatgtcaccaagaatcaaacttccctaaaatactattaaattcactcacaattatcagagtagcattacatttttcacctcttattttattgctgacactacgtaattgttgtcccttgaaagtactgaagtaatgcattgaacctgaacagtgaaactgactagtgaaaacattcagtatttgtcattaaatcattttccattattgaaagtcatatctactgacaagaaatattgttcttttttagaatttaggatgtttccaaaattcatcgtcctattttaaatactacaccagggatcagcaaactctgggtcccaggtcaaactaggcctactgaaaacaaaattgtgttagaacacagccatgtccacttatatttgtactgtttattactgctttcttgctacaatgtgctatagagttgagtagttggcaagaaaccttataacctgcaaagcttaaaatactatctggccctttacagaaaaaatgtggcccatccctatgctgcgcaatttttaaattccatatacttttaaaaagtttttcttgctgttgcttaataataaattactcattcttttgtcttaatgatcattctgtgagataactgtatgtatttattaatgaattgttgttaggttaccagcaagcgagttcatcatacaagattcaaatggctgaagttggaggattagcaaaaacaatggtccagtcaatgaccttgcttgaaaatcaacttgttgagaaactttgggtacttaaagttctgcagcatctctcaacttctggtttgtatattattaagtttaaacacttcattgtcaactacttttgtttatgtctaaaaatgtcaatattgtaaagcacaaataatttttaaaatttattttcagaagttaattgtactataatgatgaaagcacaagcagccagtggaatctgtactcacctcaatgacccagatccctctggacagcttttatttcgttcatcagaaatactttggaacttgctggaaaaatcttcaaaagaagaagtcatacaacagcttagtaacttggaatgtttgctgtaagcgtatgtggttagataggaatgttcttttaatcttaaaatgacagccagtgacataactaacatctttgtttgaatctgtgttcaattatgttttagattcatgtaatggctatgtttcaggacatcttttttgttccatggtataaatgaatctgcacaataacaagccacacttttctatgtggaaggctcttgaagtagcttcttaacactaaaatataacttggaatatagataaagtaaaattagactttagaagaactatttcatttatttatccagtgaatctattattgagtgcttactatctcccagatattgcagtaagcattagcaacaaaatgtgcgtaagccttcaagttgcttcttcacttattcaacaaataattgtctgctctatgccagcttcagtattaagccatagaaataccactgaaaacaatatagatattgtctctgctttcgtggaatttacattgtgctaggagggatggacaagtaaatagacaactaaaagagaacatactaaatgttatgaaacagattattgtaagatgctacatgttcttcagaagaagatcagtcagcacatttttgtttgcaagtgactaaaaacccaaatgaccaaagcaatatagaaaatttatggcttatttaactacaaagtcaaggataaaactggtttcatgtgcagctttattcagggatcagcagatactaggacttcgtccctcctctctctacattgtcttccatggtgctggcttcacacccaagcctatgtagtaagacctaagaagtctacgatcacatcatttcaacctcaaatcaagcagaagagaaaccttgctatcctgaaggctcagagaaaagtctttgaattgagtccagtttggccctgaatggtctaatattggtcaaatgcctgttccacagtgatttattagtgccaaaagaaaaaatgctctgactggcgaaaaggcagctgaaggcagcctcacaggagcaaaagtcaggaaggagtaaatgcctaaataaaaataagaatgctgttcttataaaaagggcaagtaggtcccaggaggcaaagcaacaaatatctactattaatacaagggaacctaactcagagttggagaattaataactgcttcctaatgaactcaagtctagtaactgaatgacaaacaggacttggtaacagaaaagttttgcatgcggagagcatcctagacagggaaaacaagtgaaaatataattagcaaaatcagaaaactaaaattcagtatgatgagagcagaaggaacaggctacaatggtgagagatgaggctaacaatgttatcagggaccataacatgaaaggtctaataagccttgttaaggaggtaggacttaatcctaagaacaaagaatagtctttaaatggttttacaaaggaaaatgacatgattgaatgtgttatagagctgtcactttgaccaccatgtgtaatagactggtttagtggattcttatctggtacatagaggattagaggcagatttggaagtgtaaaaaatattagaaatatgttcaaatgaatagtataatataaaaagggagattttgttgatagacattcaggaagtattttcataaaagtgtgtgttttagtttgagctgctataataaagtaccgtaaactgggtggtttataaacaacagaaagttatttttcagtttgggaggctagaattctgatatcagggtgccagtgtggttgggttctgatgagggtgctcttctgggttgcatactgctgatctcttgtattcttacatggaggaaagagagcaagacagctctctggagtcccttttataagggcactaattccattcatgagggctcattacctccctaaggcctcactcctaaaaccatcacattgggggttaggatttaaatatatgaattttggagggacgcaaacatttagtgtataacaatatagtttttaaaatatgattttactttctagggctttgaaggaagtatttaaaaatctgtttatgagaggtttcagtcattatgaccgtcagcttagaaatgacatattagtgatcactacaattatagctcaaaatcctgaagcaccaatgattgtaagtatgaatcaaattgcattaattttaattgtggaagtggtgggcttgggtgaaagaagtcctatattatgttggaatatttgtgtattttcttgtaatgctaagttatgctgtaatatcttgatggtcaccagtgtgcttatcactctgccaattcttctttgcaatcctttggaaatttggaatcttcctcatattgtgtgatttatacatgtatttaccacttatgatgcttttctttccttcctgatgatttgagtttccatctggcatcatttctctttcactggaagaactttgtttacaatttcttgtggtgcaaatctactggctgctggcaacaagttatcttagttttcttttatctgaaaatatatttaattcatcttaattcttaaagtctatgctcattgaatatagaactctaggctgaaaaatgtttttgtttagcatttcaaagataaagttctgctgtcttatggagtctgttgtttctgatgagaaatattcattgtgaggttccatggtgtaatggtgagcaccctggactctgatgagaagtatccattatttcaaatcgttattcccctatgtataatatatcatccttttctctcactgttttcaagattttaactctatctttggttcctagcagtttcgaaatgatgtgctaaggtgagatctcctttgtatttgttctgcttaggtttcatagagcttcttggatatataaatttaagtctttgagaagatttggagaactcttggccattatttcttcaaatattttttcagccccattctctctccccacttcttcagaggctctgattacttttatgtttgactttttgatattgtcccacaggtttgtgaggctctgctcacttttttcaatcatttttctctctattcttcaggttggataatttgtattagtctatatatttaaattcactgacttttttatttctgtcatctccattctgctgttaatctcatccagtgcatttttacttcagatatatttttcagttttagaatttatttttattcctttttatagtgtctctcctgagagttcttatctttctattcattatgagcatctttactgtagattctggtatactcctctgaagaatttttaataactacatatttaacttagctgtactcatccctttttgaggtatggcagcccaaatcttaattcagttcttgcctgggatgcttgagtattctctgcacttgtgtggttcagctatcagccagatatttgggaagagtttgtacacagaatttagcattctctctctctggctctctcctttatgggatttctcccttcactttccaatggctgtggttgcctctgccctctggttcttcaggccactaagaccacagggttactctgagttttagcatttccacgaggtgtagaatacggcctgctctcaggccaaaagcctttttttttttttttttttttttttttttgagacggaatcttgctctgtcgcccaggccggagtgcagtggcgcgatctcagctcactgcaagctccgcctcccgggtttgcgccattctcctgcctcagtctcctgagtagctgggactacaggcacccgccaccacacccggctaattttttcgtatttttagtagagacagggtttcactgtgttagccaggatggtctcgatctcctgacctcaggatctgcccgccttggcctcccaaagtgctgggattacaggcgtgagccaccgcgcccggccccaaaagccttttttaaaatgggaaactcgtgtagtgccattcccttctacaaaattctgacatccttccagtgtctgcttactcttggtcacaagatagttttatttgtcaccagcaggagaatttctctcggagctactactcatctgtaccagaagctgagccttcacatattttataattaaaaatcattgaatgattgaaattatttaatagagatccttggcaacaatattcacaagtcagtcacgtaagttctagttgtgctacaaagaactggctgtgacgacctcagcccactaacagtggacgtcaagtagtcccaagagtcatggaattcatgctgtgcaaatagggaaacagtgctacatagtatcctagttaaagctgcaacttataggtagacctttgtttctctagaatcccctggtcaggtagtaatttctcattagtgtccttgcaaacattcagatgaatttcacgaatgtgagtcaaaggaaataatatcttcagcatctaaagaaaccatatagatcctaaagtaatggggctataaaactacaagctcataagcccagggtttgcccctgtaaactctccctaatgtgcaaaatccaactaggatatctctgtcaggaatgctgatatgctaaaatgtttgcaactctggtgattcttcagggcttttcatgctaagtaggaactactttattatctcttgaccaaacatttgacataacaagaatggttggggtagaagtggaagtgtttaagaagaaaagctgttgagaataactggattttcctcccttactgtgtcatttgaagtataggtaacgaattatagaagtaactataaagacctaatatactttggatccttaacaattttaaacagactattcatagaataatataaaatatttcttagaacctacagaagtaagtttaaaattaaataaatctggcttatttaattttaaataagcttatctggctatatgtttttattttttgcctcactctttattactattcatgctttatgaattcaaatgaatgacagtaggagaatttgataaatgtacttaagtagtaaatatgagcatctgcatcataactttcatcttattcattcatctttctgcttattttatgtatttatattaggaatgtggctttaccaaggatttgatactgtttgccacctttaatgaaggtaaaaagaataaaactttaaacttcttataattatcttgataagtcttgtacaacatttaagctttcattttactttttttccctcacagttaaaagtcaaaatcttttggtaaaaggacttaagctttctaattcctatgaagattttgagttgaagaaattactattcaacgtaattgtgatcttatgtaaagatttacctactgtacaggtaaagagtaatcaaggcaggaaaatcaataaaaattgtcttactttgtagtataactattttaaagtcttgactgtaaatattttatcggttcatatatttaccacagaaagcagtaaaatcttactggcctgaattttagcttttaaattttttctttgcttatctgttagtaaacagtgaagtacttaaatttaaaccacataaaccagagaaaaatagtagaacctaagagatttaataatacagttagatctcttgaattagacagcataaaatgaaagaagcttcacataggcccattccagcctaataatctgtctctgaccataacaaggactgatttaatgctggagaaaattattaacctctgtgatgccaatctcaaactcttatgaacctgctttttcatcacacaaacctaatgtctttaatcacttttactctctatgaatttatcttaatactttgtttcctgcataacagcgtgatataatttgaaaaatattggaactgaatttcacttctggcttatcacctactagctatgtggccttagaaaaattacctcgtctatctgtggttcatttcctcctcctgtaaaggaaagattataatgcttcagctctgctcacaggtctatcgtgaagttgctatgaaggctttttaaactataaagtgacagtaaatgtattattaacaattctgtttagttagttactgcattaagtgaaatttccatttaatctaaaactctaccaagctccaaggattactatgaaaaagaagtaggaattcagtctatcaacttcactaccaataatagaaagatggggtagtctagcagtaaaggctttagtcagacagaatctcagtgctaccgctttctagctatgtggcattaaatgggttgtttgatttctctaaatcccaggtagctcaacttcaacatggggataacacctacctcgagattattatgagcatttaactgagctgaacattttcttagtaatgcaactttaaggaatatatatattttcaaatgctcaggaaaagaaaagttgtctttataattataactttattatttgtgacaaaaaaatacatactgtgtagaacctaaatgtattttccaaaatgcaaatggaaaatcatttggaaaattattccataaagtatggtttattattccaatacagtattatataaatattaaaattagacctataaagataataaaatttatactacagtttataagtcaattctaattaattgaacaacactttataggcaacagagccaagtagcacagattatggtgaggagcttcttaaaacactttgtgagcggtgaaatcaacaatttttatgtgtcacataatttgtggtccagtaatattactagtaatgataatgaatatgtacactatcatttgcaatacacaggggtgttttttgaaacattatatacttaattctagcaagaatgttagaactagtagttattcctgttttctcaactctaaatcttgcattcttttcacatggactagtaaggaactagaaaaattaattgtttttgttaaaatctttatagaataatgccaaattaaaagaaaattaaatatagcatatggtgttttattctcttgtgaatcataaatatgtatccatcagaatcagctgtattaattctgttgtcataatagctatgcattttaatctcatttttattaaaatgatgggttcaataaaattttaaaatactaggcatgtaatgaaacatggcttgtgacctaactgacatttatttggtagaatgtttatgtaagtactgttgcatgtggttaaatattcactgtagtcattacctcagacaaaattcttttttatggtacacaactgagtctgtgagatatttccttttaaaaaaagagtgaggaaagagatgtcagcacttgccccaaaatattctatgttttattgtacgttaaagtaaaatacgttatacgttttattatacgttttattatacgttaaaatatcctatggttttattataagcaggaactacattacatatatgagcagcaaaaacaaaaaattaatacatattttatattattgtcagggagtacatacctcagaaaagaggattataacttatttaatttttggtgttttttttttggtacctatcatagattggggttattttataaaggaattattttgaaataatccccaataaaacatcaaaatgtaaatttttatttaattgccttaaagtatttttggctatgtttctaacaaagtatcctttgttctttctcacagctattaattgatggcaaagttattttggctttgtttacctatgttaagaagcctgagaagcaaaaaataattgactggtctgcagcacagcatgaagaattacaactgcatgcaattgccactttgtcatcagtggctcctttattaatagaagaatacatgtcatgccagggaaatgctcgagtccttgcatttctagaatggtgtgagagtgaaggtgagtggcccttcaagattcttgtcaaaattctaatcttcatatttcaactgaatgctcagtatatgcatagaaataacaatgaagttaattaaagcaatgagaagtaaaaacacacagacctatcttcttaatgtatttatatgttgttttaagaaaaacacagattttaaagtcagacgtcagtaaatgtcatagttgatgcacacccgaaagaaatcatacatgtaatttgaatttttgtattattagacctatctaaaaattatatttgggaagaaaataaatgctggcaatattttatttgctttgtttgtttgttgagacagggtctcaccctgtcacccaggctatagtgcaatggcatgctcatggctcactacagcctcaacctcctgggctctagcgatcctcccaccccagccttcccagtagctgggactacaagttcatgccaccacacgaagctaatttttgtattttatatagacagggtttcgccatgttgccccggctggtctcaaactcctgggctcaagccatctgcctacttcggcctctcacagtgttgcgattacaggcgtgagcctgaaatgaattacaatattgcccagtctggcagtattataatgcattcattcaacaaatatttatgactgcctactgagtactagatactgtcttaactactgaaaatacagttaggcttaaaataaatatccttttctctatggagcttaaaatctagatctctagccagaagtaatgactccagtgtggtctaccaaattagtagagccccaatttatttgtattttgttttagttcttagaaaggaaataagaaatacattccttttttaaaaagttttataaggaagatattgcctcttttctggtagaaattttgctctggcaataattttgtatgatgcattttcattagatcaagaatatcacccatttatgcatgaaggaggaaaaaatgataggctttttattctctagtttctaatatgctgagctactaaatttagtcttgtaaaattattttccactgaataaagcaattcttcagcctatcctttatatcatttatgtttgtagaagactttaaggcaaaaggggaaatgctggctaataagagaaagactgatagctaatagttattcagaacctactatctggtgagctttaaacaccttccaagtattaagtcatttagtcctctcaacaaacctaggaggtataggtactcttattatccctttgtatcagatgggtagaactcagtctaagaagctaaataattattcctggccacaagtggcagagcaaaaatttaacccaggttctataatagaacccacaattttaaccaacatgcaatactcagaacagtattttcaactttttttttttttagctagaaacataaagctacttctaaaagcagcttttaaagaaagcatagcataaagaagggaggatttgccttgctatttatcaagacctacgataaagctatagtaattaaaattatgtggtactgggtcatggagagaccaatggcatggaatatatgaaaggttggctttatgagagatgatactgccaatcagtgagggaagggtggtgttggggcagttggtcctccatgtgaaaaaataaaaattagacctcttcactttgttttttctaaaaatcaattgcaaaagtaataaattaaagatgtaaatatgaaaagtcatacagtgaaactcttagaagaaaacatgggaaaatatctttttgctagatatcagtgtaggaaaggtttctttaaaaagactcatgagttaaaggtataagaaaagatcgatgcatttaactactgtaaaacgtacaaatgtctatttgacaaaatctaagtgaaatactaatttacaaagtgagagatgacatttattacccctgtgactgataatagattagaatccaggttcataaagaactcctatatatcaataagaaaacaactcagtagagaagtatacaaggactagggactgccatgtcacagagaaaaccccaaattttcaaaaaacattgaaaaactctaaatcctgttggcaatcagataaatgcaaattaacagcaataaactaccatttcacatttaacagatttcgtgggggaaaatcaaggccaggtgcagtagctcacacctgtaatcccaacactttcaaggcaggaggatcacttgaggccagaagttcaagaccagcctgggcaacatggtgagaccccatctcttaaaaaaaaaaagcagctggtcatagtggcacacacctgtagtcctagcttcttgggaggctgagatgggagtattgcttgagcccaggagattgagacttcaatgagctgtgatcataccactgcactctagcctgggcaacagagcaagaccctgtctcttaaaaaagaaaaattaactcatcttatacattgtatctgtataaacaccttggaaaacaatttagcacctttagtaaaattcaatgtggatgtatcctgtattattctggtcacatggaaaaactcttctcaatggatataagaggacatgaaccagaatgtttattgtaacagtttatagtagtgaatggataaactataatttatttataaaaatgaatgctgaaacgaattaaaattaataatctagatctacttgtgacaatgtgaataatttttaaaataaacatgttgaataacagaagcaaattacaaaagatacatataatatgatacatttgagtaaaattccaaaacacatacttctattctgagaatagtaagagggaaaagggataatattttatttctctaaaaaaaaactaaagcaaatatgacaaaattttaacatttgtttaaacttttgatagatgtataagatatctgatatatttgctttatttgaaatgtttttgttttaaattatcactttttctccacagatccgtttttcagtcatggtaacagttttcatggtacaggtggccgaggcaacaagtttgcccagatgcgttacagtttaagactcctgagagccgtggtctaccttgaagatgagactgtaaacaaagatctttgtgaaaagggaacaattcagcaaatgataggtaaaatataacatggtggtttactgatgaaagaggaatatttttaatagtagtagttttgtttgaaatgtttttccaaaatttattttgtctttatgactgagaaattcctgaatattttcttgatttttgtttcatattgctgctataaattagtgtgtcttattgaaatatcatacttactaaccctttaagcatttatttcttcaactcaaatatcatttcatttaggattatctttatctttttttaaaatggtctattgttatgttttattcttttagtaataaaggtcaccacttttgaccaaggcttttggagctattttaaaacaggataacatggcatattccaatgcatgtgtcataacagaacactggtacattggtatttacagaaatgtacagaggagtttcttttctgatatgaaatatcagaatatccttgacttttagcttacacttgactatgctagaaaagaaaatggaaattatgtgtatcatagaaatactgcatgtgttaccctatacgtcatcaattagacacttaatgagtatctcataaaataagtacacataaactcagtgtaaaattcagaacccctaaacaaaagctgctttgccttttgttatttaaaaaataaatagttctctagatccttgactttgaaaagagctatttcagtcgttcgtattcagtgattgcttcactagtcaattatataatctgctagatgtcaattaattataaatgcctactcaaaaaatcttctacttgttaaattaaggtggttactcttccatcactagtggagtggagtggtgctctccaataataataataataatataggaaatagcaggaaatcaaagtatattgaaaaggagctaggtgaaaacatttacctttttgcccagtttgtttgggatgaacaaacctgaaagtacagtttatcattcctgtgcacattctgttgcacaaaactcagtctaactagaggaaatccaggaaacgtaatctttcatatgtctaggaagaattcttaatcctgcctgcactagggaatagggtagggaaaagggaaaacaaatagcaatggtttttttcttcttagaaccttttccctttaaccggaaagaagctgatctttatgttaagttcttagaggcagggaccttgtcttattgagtctaacatggctgtgtagtagtaacgtgctcaataagtagtaactagattttaaatgtaaatgtttatacacttcctgggtacagtgtacactgcttggtgacaggtgcaccaaaatctcagaaaccaccaataaagaacttatccatgtaaccaaaaaccacctattccccaaaaactattgaaataaaatataaatgtttatatacttcctgtgtagacactggggttacaaacatgtatagagcaggacaccaaggaccttttccttaatgagaaaatagaaactacatgtatcatagaaagatagcatgtgttagcctacacgtcatcaattagacacttaatgagtaggacagagtaaatgttacagaaactaagaggcttgggtagttttcaaggctaggaagtcttaggattctgtgaggtaaaggtagtttagaggtggaaaagaagagaaggccttcaagcaaggaaataccatgaacagagagacatggtcctgaaatatgcatggtgatgtgttcagaactagtttaagaggagccaaagttttatgaagataaataacacaagataggttaattgtatagtcagaggccaagatggaatgagttttgagtgattgacagtagttcgaacttcatcctcttaaggcatggagagcctcaaagggttttgattagtgaggttatatgtacaatgttatgttttaggaagaagaaactgggagaaatagaatgatctataacaaggagagaataaaggcaaggagttgaagggtacataaatatgagcattatactatgtgttacaggcagcagggaaagtttctgcctgcacccaggtaggaagaagaatgctatgatctagaaagaagaagcagaactatggccagtcaaactggattcccagaagatgttcctgataaagcgatataggcccctctgtccatggcataccccagcactgggcctccagcaggctcagctagcctctcttagggtctgatcccccacctgtaattcatcctaatgggacctagaatagtcagtcgctcagggccagttatggagataggctatgatttccatggcccttctactttggaacatagctccatactttcccactaatgccagttacccctttaaccgagaaaaagtcactttttttctttatttaaagcttaaaaaaatcctttttgaggcaaaagtgtatcatgaatatcatttcgtcagtgttagtggccatcttcagtccttttcaatttcaactggaagcaaaagagggattttaaaggacatggaatactgttacctaaaattgtttaaaacaccttcagttagacatcaaggaaagatgcagaaagcaataacaggaatagaaagcacacctaaagagatctgccacctttgcttagaattgaccctgttaaccatgaggagaggaagagattaggcaaaccacagtcaggaaatttggtcatatatttgcaaaggcactcatttcctacctcatgaaactctgcatatttttaaacccagtttgctgagcaaagtgtcaggttattggggcatcctttaatgacatactgttaattctgaactagaatttctatatatgtgaggctatggattacattcagaaattctatatatgtaggtagggctactgattgtattgaaagctccaggaattcatttatcatcttcttttcacagcctctaggttactatgcaatgaaaatatcctcttctaaaatagtttttctaggctgggcatggtcgtgcacgcctgtaatcccaacactttgcaaggccgaggcaggaggattacttgagctgaggaattcaagattagcctaggcaacataatgagaccctgtctctttataacaaataaaaataaataagtaaataaaataaaagtttctctagccaaataaactttttagaagagatttccaaacagtaattgatcaaaataaaagtagtgtccaataactatacagtctttaaatgttttcataccaggaatctttaaaaatataataagcaagcctaatgaaaaggaagaagccattgttttggaaatccagtctgatatattacttatcctatctggcctttgtgagaatcacattcaaaggaaggtatgtatgcctgtgaaagttttgttcaggtctcccagtcacctaacactataaactatttttggaagtctctataattgtatttaattttgtgaaaatttaatatttttgttaataattagagcataattatataaagtaaaaggtacagaatatacaacagtatacacccatttaactcatacccccaattaaaacagagaatatttctatctctataaaatttcctcatcccattagaagccatgcccctactcacttccagacaaactactgttctgttttctattcctataggttggttttccctattctttaagtttatatcaatggaatcgcacaatatttactcttttatgtctggattctgtcacccagcatcatattttagaaatatatccatgttggccgggcatggtggctcaggcctgtaatctcagcactttgggaggctgaggcaggtggattgcctgaggtcaggagtttgagaccagcctggccaacatggtgaaacctcatatctactaaaaatacaaaaattagccaggcgttgtggtgtgcgcctgtaatctcagttactcgggaggctgaggcacgagaattgcttgaacctaggaggtaggttacagtgagcccagatctcaccactgcactccagcctaggtgacgcagtgagactccatctgaaaaaaaaaaaaaaaaaaagatagaaatatatccatgtcattgcatgtatcaataattcatttctttttattgctaaatagtattccattgtgtgactatgccaaaatgtgtttatctgttcccctattgatagataggcacttgggttgtttttatttacagctataatgaataaagcttcagtgaatattcttgtactagtctttactagtgggtataatgctttcatttctctcgggtaagtatctacaattggaattgatgtatcataaagtaggtgtatctttataagaaactgccaaacagttttccagagtgggctgtaccattttaaatgttgtttggggtttgaattgggttcaaacccaaagccaaaatttagaacgagatcttaatccccttttatcttttttagctccatagtgaactctgagtctcagagattgataatttaaatgttaaatagcaagggatggaattggaaagataaaaacaaaaaaatgatggtttcaatagatagattttaagtgaacgcctgtttagctccaagctttgatgcaatttctcatcatattctaccaccctgtgcctgggctcctctggaaaaataatcataatcttgcttactgggaaccagaactgaacagcaaggcaataagaaaggtaattagtaagagaaaaatattaagtggttaaaacttcacaaaaattattaaatgttttaactacatttatatcttatttctctcggggtcattagaaaatcttgcatgatagttcttactatctaagaattgatctgacataatgctagactgcattgattataatattgaagaaaatcaaggtacaaattttatgacttcttttaggagaaagggaataaaacaaaaaatatcaagggatattattaagctggcatgttgattgatgccccctcttaaaatgattaattttataataatttgttttaaattcctgagaacaagtaagtacggttttttaaattgcagtaaaaatagtatttttctaacaatgttgctgtatttctctggtaaaaaagcaatattaggggaccgataaagtaggaaagggaggaattatttatttatttcaagaaataatttaaaacaaatatcttaaacaggaaattttcggaactgaaggagtagatatcgttcttcatgtgatgaaaacagaccccaggaagttacagagtggcttaggctataatgtacttctttttagtacattggacagcatttggtgagtattgctataatcaaattaggtagactcacagcagtcatgcatcactttacaacagtgaggatactttctgagaaatgtttccttaggcaatttcatcttatgcaaacattataggatgtagttacacaaacatagatggtatagcctactacacacttaggctagatggtatagcctaaaggctacaaactgtatgtcatattactgtactgaagattgtaggcaattgtaacacaatagtaagtattgtgtatctaaacatacctaaacattaaaaaaggtacagtaagactacagaataaaagataaaaaaaaattcttaacgcttgtatagggcacttataaatggagcttgcagtaccagttgctgtgagtgagtcagtgagtgaatggggaatgaatgtgaaggctaggaccttattatacattactgtagactttatcaacactctacatttagattacactaaacttacttttaaaatatttttcttttctcaataaattaaccttagattactgtaattttttttttactttataaatgttttcattttctttatgtttttggctcttttgtaataacatttagcttaaaatacaaatacattgtatagccatacaaaaatattttctttctttatatttttattctataagtttcttctgtttttaaaaaaattacattgtttttacttgttaaacattttgttaaaaactgattcaaacacaaattagcctaggcttatgaaaaaatatttgtgtgcatatattttattaaacatcatagatatttctgtccagtatacacctagatgtaaaaatgcccagatctgggcatttttacgtctgttcagctttaggagataatactaaaaaattttccaaagtacttacatcaattacacctttcccagtagtgtggaggtttctcctttttccacacccttaccaacacactgcgttgtatctttcattgcagccatccttatggacttgtgccagtgtctctttgtagttttaattttcatattcctgattgctagtgagttcatttgccatttaaatagcctttttttgtgtgaaatccctactcaagtctcttgctcatttttctactgaattacctattgttttttagagttctttatatgtcctggatatgagcctttttctgttatatgtttgtcaaatatattctgccactctgaggcttacattttcactctcttcactctctttttgttgaacagatagtcttaatttcagtgtggtccaatttaccagtctttttttatggtcagtacttttagtgccctgtttaaacagtctttccttaccccatagtcatgaagatcactgcctatgtttcttctagaagctttattgttttgccctttacatttagacctacaatctacctggaattgatttgtatgtatggtgtaaggtgaggtacaagttttactttttttgtatggttgtaattcaatgctgtttttggataaaccatcctttacccactgctttgcagtaccttctttgtacaaatcaaatgtccgtatatatttggatctatttctaggctttctgtgctgttctactggtcttttgtctatccttctgtaatgtgctattttaataattaggtcttgataagtctagacatctggtagagtaagtctttctacgttttccttccccattaagattgtcttagcttttgctgaccccttgcatttggatattatattagtcaagattccctagagagacagaaccagtaagaaaaaaacatagagaaagagagattgagatttatcataaggaattggctcacacaattataaaggctgaaaagtcccaagaactaccgtcagcaagtggaatacccaggagtaccgatggtgtagttccagtctgagactgaaggcctaaggaccagaaaacccagtgttctgagtgccaatctgaaagctggatgcttgaagcccaagaagagcaaatatttccatttgagtctgaaaacctgagtcccagctcagcagtcaggcagaggagttccctcttactcagcctttgcattctgtttagatcttcagttgcttgcataaggcccacccacattagtaagggcaggctactttattcagtttactgattaaaatgttaattacatccagaaacaccttcacagacacacccagaataatgtttgcccaaatctctggccaccccaggggtaaaacctgggaccacctgaatgggaggagcaaagctgatggcatttcatataccagcctctaccctactcctactttctatgcactatgatgaaacaggcagtagaaacaatgtcttttgaaacaggcagtagaaacaatgtcttttcttttcttttcttttcttttcttttcttttcttttcttttcttttcttttcttttcttttcttttcttttcttttttaaggggagctatgtttagaaaggggacacaggaaagtgaccacagcaggcttgcaatttctgggaggaactgagaatagtatctgttgcaaccaccagtgatagcttgttcagtccacattccctatcaggaagaagagtgcaagtagccccggcagcagctttaaaccttgattccatgtgagctgcacaaaccaaagtaggcactttagcaaattcttataggaaagggttcctgatccagaccgaaagagagggttcttggatcacacacaggaaagaattcaggatgagtccaaaggataaagtgaaagcaagttaattaggaaagtaaaggataaaagaatggctactccataatcagagcagccctgagggctgctggtttcccatttgtatggttatttcttgatgatatgccaaacaaggagtggattatttatgcctcccctttatagaacatataagttaacttcctgatgttgccatggcatttgtaaactgtcgttgcactggtgggagtgtagcagtgaggacaagcagaggttatttgtgtcagcatattggttttgatgagttttacctggcttattcactgcaacctgttttatccccaaggtcttcatgacctgtatcttttgcgacctcctatctcatcctgtgacttagaatgccgtgaccatctgggaatgcagcacagtaggtctcagcttcattttacccaggccctattcaagatggagttgctctggttcaaatgcatctgacattttccccatcccttttataagagaagccttaatccttagggttgcagagggattaagatccgtcttctgtaacatcttcaggctgaagaggggtgatgatattcctgcctatctattagggtctcttgtgttcagggtacaggggagctcagtcagaaagcactggtatgttgagggtcattcataactcttgagttctgacagaaggtgatatctgaaagagtaacaattgaaaattaattattgattaatattgataaaattgaatagaatatcaattctggttttcacattacctagccctcttgtttcttctgagcagcagtcagagatcactggttggttcccaggaatgagcagcgttagcctaaattgcagaaacaaacttgaaaacagctgatgagactagaatctaacaacaggtgtaccatagttcttgaaacatatttctctctccagtttcccatttatcctaaagacaaattataataaggccaatttgctttattatacttggcctgattatttgtataaggtgcagcaagaataattatttgccatatgggctatttgaattggctttgatggaactctgttccataaggaatctcagataagacttttttaaagccaagcccagccatgggtttgtaccctcacatacctaagagtttggtaaatttctcttctcttgaggtcccaagataacttggggctcctgggcctgtcagaaagtgacattctttacttaccacaggccaggaaccctatacagagactgtgtagacaaagtatcaagttttcccaaaggacttttattggctttacacatcaagtctgattcctcaaagcacaccattccagtcaaagccttagtaaaataatcagtttctccaattgtgtcctgttgcaaaagaaaacagattcttattatacttcttgttgcaaatacctatattgccataaattaagaacactcacgaatagttgtcaaattctggagaaattgggtagaaaaaacaaatatgctccaaattttgttcacacgagcatactttacccaattgttaaaagctgtaaatagctccaaagatgagttgtcttgactctgggcggaaaaaaggatcagcaacattttaagcaacaagttaaaaaagatgattttagacttctgttagtttagtccacaaaattaatttctgtttgatattcatgaacatttcagctctctatgagagttctgaaaggttttttcctctattcagagatcacaatctccaaagttatcagaaacctgcatttaagaatacctgttagagttctatagctgactataaacgaccttttgaagaggatcaaaacaaaacaattgtttgtggatgacaaaacatcgcacagtcaaaaacatgattgacaaagcaatttagttatctcagtggcatacaacgattttatgtagcaattataactattagtgacctatactaagtcatatgagaattgtaggcgtttcccatcattttggaacacataccaataacacatttatgcaaatatagcccaaagaaagctaaatactgtttcacatttgacaatgcttcctgtatgatgtttataccaaataagccaaattttacctttacattagtgtactattaattttacactcaattcttaataaaaccttatagacatatctacccaattttaatgtttgaccataaggtaagattctcataaaccttttataaccctttacaatttctgttaaagagcagatcataaacaggattttgctccaagaaaaacctgttgtcatttatgccaatgttcagtttacagaaaaactgaataatacccctttaattttagccaatggccacacacagaatttcttttacaattttttcacaaatctgccccaacttgcttaaaccttcagctttatcttatctaattgtaaaataccctttaatgtaggaaaaaaaaatccacattcccatgacttcttataatcttttgccaaaaacacatttcactttctttatacaccttacatataaaactgtttctttagtagtctcaaatacttgttacgctgttaactcttggcaacttttgcttttggcaaaaagcttggtaagttcagcattctaattatgtactaggcatggagcctaggacccagacagaagtacagataaggtctgactctttccagcatcttattccatgtgtcccaggccttacctagccataaagcaggcaagttacagtaagagtcatagtggcattttatgaagcattaagggggcctaacgaccttcaaattgtacaacatttcttgcacaaactccctttcactaatcctttcacgacttacatagactatgacatgcttagactttctgacttttcctaaacatccctctttttaagcaaccagttgttttactttaggacaagaatctaccatacaagattgttttttatataacatctgttttctttacaaccttctttgcatagctagggggcatggctaatttcacatgtccccagccctatctacaatctaatgctcctaaataaattgaacaattttcaaaagtcaaagaagccatttatgaccgtaaagtatttggaaaacctgatacctgatctgcataatttacaccaaatgttacatttttgaagaatttttgttttaccaataatctttattaaaactgtcttgatttccctaagattactaaagtcacatgaactgaacatcattctactttttacttttctgaaaaaatatttgatttaagttcttcttattaataaactaattagagctctttcatatataaacatcacacacataatacatttaaatatggagacacgcagaagatgaaggactccttccctaagccaggaattgaaccctggaccggggccgccattgtgaaaagagaaagcatggccacaaggttacaaggtcaagctcccaaggacatacaagacgagggaaacctcgtccagttttagttttttgggggacttgcagcaaagtttgtaactgaccagtttgctgggccatcttgaaagcaggcttacaggtgtcctaaccctatgttctctcctaaggtacccctctttatgacagaacaatacagaaagacaaagtacaccagattggctacaggttaagattaggctttcaaatcatttctcccattaatcaaaactttacagaggagacagtgatttttaccattcattcaactggtttgcacagaggggaagggaagggaaaaagggaagggagcattgcttttggcagtgtggggaaggtgaggtgctcagggaggccagagaaagacctgcccattggtgccaacactgaatcaaaagttcagccagttgcttttcagtcgagacgggatcttttccagcattcccatttgctctcaagtttccccttttagggaggaaaaagcttcctctgtcccacaatcctacatgcgcctaatcctctcacccataaccataagcaaaaagtgcaaggcagattattccaaagagaatagcaattaacatcccatagtgccaaacccattcttagccaaaagggactttactgagaggggcctctaacttcctaaatcttagaagggattctaaccctcctaaatttgccttcaaatccagggtcggtcaagtttccttgctttttaataagaggggcttttaacccactttgacttaaggagagaccctaactcccctaagttgacctctaacccaatgccatccttcagccgagtacccaaccactcacccaaggtcggccaaccagtgctgtcgtctctttcctttggtttggggctgagggctttcttcagtatcgtcccttcggggcttgccagaaagatgttaccagaccccaacacttacccaatattagcctttgagtcgggggttttctcactattgtcccttccatggttgccagaaggatgttacaggaaaggggtcccaatccagaccccaagggaaggttcttggatcaggcgcagaaaataattcagggtgagtccacagagtaaagtgaaagcaatttattaggaaagtaaaagaataaaagaatggctactccataatcagagcagccctaaggactgctggttgcccgtttgtatggttatttcttgatgatatgccaaacatggagtggattatttatgcctcccctttataggccatatagggtaacgtcctcatgttgccatggcatttgtaaactgtcattgtgctggtgggagtgtagcagtgaggatgaccggaggtcacttttgtcagcatcttggttttggtgggttttagccgccttctttactgcaacctgttttatccgcaaagccttaataacctgtatctgtgctgaactcctgtctcatccgttgacttcgagcgccttaaccttctggaaatgcagcccagtaggtctcagccttatttcacccagcccctattcaagatggagttgctctcattcaaacacctctaacaaaataatctcaactgcaaagatgagatataatcaataattatccaatgtttaaagtgcaccaacatcttgaaacagcaatgtcgacaaggcctgtaaatattttacagagtttcattctgagcccaatataattgaccaaggcctgaggcacggttttttgttgttattgttgttgttgttgttgtttagacggggtctcattctgtcacccagcccggggtgcagtggcgtgatctcagctcactgcaacctcctcctcctgggttcaagctattctcctgcctcaggctcctgaataactgggattacaggcgcccaccaccatgcccggctgattcttgtatttttagtagagacctcgttttgccatgttgaccaggctggtctcgaactcctgacctcaggtgatccacccccctcagcctcccaaagtgctggtattacaggctgaccaccacacccagcctgaggcacagttttaagaggtcctgagaaaatgtgcccgaggtggttgggctacagcttggttttatacgttttgtggagatataagacatcagtcagtacacataaggtgtgcattggtttgattcggaaaggaaaggcaactcaaagcaggagtttacaggtcagaggtggattcagaaatttcctgattgctatctgttgaaatgggtaagttattatctaaaaactggggatcaatagaaaggagtatctgagttaaaataagggattgttgagaccaagtttcttattatgtggaatagttggtaaatgtctcttatcagaccttaaaaggtgccggacttagttaaatctctcctggatctggaaaatacttggacaggggaggggattcgctacagaatgtagattttccctagaagagacagctttgcaggaccatttaaaaatatgtcaaaggaatatattttggggtaaaatactttgatttctttcagagcctactgtcatgtgatgctataccagagtcaagttggaatttggtatctcattgctgtgaagagtctgttttttcattcttaagatctctgttttaacgttaatactcactggtcagttgtgcctgaattccaaagggaggaagttataatgaggcatgtccaacccctccttcccatcatggcctgaactagtttttcaagtttactttggaatgccttggctgagagaagggttcgttcagttggttggggggcttagaattttatttttggtttacagcaacaataaatggatatatcttgcaaaaaaagttatgagaccagccagagatgatcactaagaataattaatatcatgaaagcaaaggagaatgttttatttgtaggaaagaaataggcagttatggaaaagaatggatattgatttttaaaaacgttgaaactgaacaacgctggtaaagtttcttcaaagttctatttttttaggtaaaaacattagctacttgatttaagaaaatgaagaaaacatattctttgaaaatgctttgataaagataaagctgtacaaattcagtttaacaataaatgtttgtcaaatgaataactttcttttaatttaaggtgctgtattttgggatgttatccctcagaggattattttcttgaaaaggaaggcatttttctccttttggatttgttagcagtaagtatggctataacaatcataagacaaaagacaaatatgtctattaaaggccgtttccaaactgaatgccacagagcacaagtctatgaataaatgtgccccaaatcatgttcaaaggtacggtcttaaacaaaattgctcctagaaattcataatacacagtgttttaaaggctctgaaaattcctctggttggaaagtcattttaccagtgttttttcagtgttttcaaatacacgggaacaaagaatttgtttttctttgtactccatcaacctgttaagaaacagtttgtgaagagcttgaccatatgaaaacccatagtcatttattaataacttctagtttcttcccctgatattaaaagataagggccacgttagacaaggagcaaagataagcatttttaaagaactatgtattatttggaggtaacctgaagaagtctagtgactcatggaccattgttttgcagaatgagcagatgtgagcaagctaggccttccaatagagacagtgccatctagcagctgtgaagaatatagccccttactagcctcaattctaactggaatccatagtcaggatgatatgggaggaaacgtacaattttgtttcaataaaattttgagagagattctcacacagagttctagcccgctccctgtccgtgattctatgattgccactattcttgattttattaacagaataacaaacctactttgatttagcaaaagtgctaaaattatttgtgccccttaacctccctgaaagttagttcatttctctcttttcgatttctttacctgtaaaacagagataacaacattatatatcttattgtattgttggaaggattaaatgagtgattgtatgtctgtgtgtgcatctaagtgtgcatgcatacatatatattatagattaaatatagtgcctaacatgattcctgtatttactgttattatgaatattattgctagaatatatttaatgctgattcaaccaaattaattgcaaattacagatattatttaatgaagattttatatcaatttcaatctttcacatttgcctgtctcctgaagtagagaaataaaaaaactcatttccttgagtgttttgcttaatacaactctgctgaaatataaagtatgtaatgataactgctaataatggttaaatgttaatgagagctgactatgtaccagggagtctcatataactcataataaccctttgcaggtaatattattatcctttcattttataaaaggaaactgatgatgttcgcaattaaaacaaaagcttacatatttcctttgctatattcaaataacagtatactgtaaaagttaatcaacaaaaagtatttcacatagaagaattagattatggaggccattgctctggatggaattttctatacctaaattttggtgtactgaaaactacttgtagcaaaataaaggaaatatgctttataataggagaatttttttgaatccttaaatactcttttatggatgatgattgccacaaaaccaaattacatcttgttttattttcatatgtgattgtcatttgcagttaccatcagttactctcttaataacaaagagattacagttagtatgaatctttacaagccttaataaagcatataaattggaaagatcctgtaattacagtgaactctgtataacactatcgagcttcgccacttaaaatgaacatcttcacttatttgtgcaaatctttttccaactcagccacatcagtcacattttggtcatgatatatgtttataatgacttcagaattatattaaatcttttactttttatccttttaaatttctaatgtttgaaaatatagtcattacaatgggtgtccattttaacaggagattttcctgactctgagtttagaagaaacttaatgataatagaagtgtttctctcttttttttttgaagacaataattcttaatatttattgcaacttttttccttttctgtttccttgctaaagttgaaccaaaaaaaattctgtaatctaatacttggaataatggttgaattttgtgataatcccaaaactgcagctcatgtcaatgcttggcaagggaagaaggatcagacagctgctagtcttttaattaaattgtggagaaaggaggaaaaagaactaggagtaaaacgtgataaaaatgggaagatcattggtgagtatatttataattgttagtagaagcaattaatgtatatattttaaaagatctttaaatggtattaagaaagcatcaggcctttcacccctttgtctaaagttttttttttttttttacaagggtttgaaaaatttgctatcctaagtgactggaagaaaactaagtaaattagtagtaggttcatatttttagagaatatttttaagaaatggtatttaattatattcttttaactaaaaaaaaaattaaagtagttcctaaagatgcttctttgggttttctgcttttatagatagattcaataatatttcattgagatgtaaatagattgcttcaaaataatattttggtattttatacatttctgttcatttttcctttttctaaatccattaggcaacatgatctgattaatgtttatagagtttactttttatatgaaagaagatattgtttcctaaataaaaatagtccaaatgttcaaaaattttaattactagattctaaattaatgagacttacagtatcataatttttagttcatttacatattccatactgctatattacatttttttcttttttttttcttttttttttgtgagacagggtttcactcaggtcacccagactggggtgtgatggtgcaatcttggctcactgaaacctctgcctcccaggctcaagcgattttcctgccttagcctcccaagtagctgggactacaggcatgcactaccacacccagctaatttttgtattttttgtagagatgaggtttcaccgtgttgcccaggctggtctcaagctcctgggctcaagcgatccactcacctcagcctctgccaagtgttgggattataggcatgagccaccacacctggccaatatattacattttctttttttcttttttttttggagacagagtctcgctctttcgcccaggctggagtgcagtgacatgaactcggctcactgcaacctccgcctcccaggttcaaatgattcttctgcctcagcctcctgagtagctgggtctacaggcacgtgccaccatacccagctaatttttgtatttttttaattagagacagggtttcaccatgttggctaggctggtcttgaactcctgacctcaggggatctgcccaactccacttgccaaagtgctgggattacagacatgagccactgcaccccgcctacatattctaagccttttaagattcttatggtttcatctaaacggttcacttttttttttaaattttattttaggttcaggggtacacatacaggtttgttatatgggtaaactcatgtcacaagggtttgttgtacagattattttgtcacccaggtactaagcctagtacccaatagttattttttctgaccctctccctcctcctactctctaccatctaataggcctcagtgtgtgttgttctcctccatgtgtccatgaattctcatcatttagatcccacttataagtgaagacatgcagtgtttggttttctgttcctgtgttagtttgctaaggataatggcctccacctccatccatgttccctcaaaatacatgatctcactatttttatggctgcatagcattccatggtgtatatggaccacattttctttatccagtctgtcatgatgggcatttaggttgattccatgtctttgctattgtgaatagtgctgcagtgaacattcatgtgtgtgtctttatgatagaatggtttatattcctctgagcatatactcagtcacaggattgctgggtcgaatagtagttctgtttttagctctttgaggaattgccacactgctttccacaatggttgaactaatttacactcccagcaacagtgtataagcatccccttttctccacaaccttgccggtatgttattttttgactttttaataacagccattctgactgatgtgagatactatttcattgtgatttgaatttgaatttttctaataatcagtgatattgagcttttttcatatgcttgttggctgcatgtatgacttcttttgaaaagtgtctgttcatgtcctttgcccacttttgaatggggttgtgttttttcttataaatttgtttaagttcattatagatgctggatattagacctctgtcagatgcatagtttgcacaaattttctcccattctgttggttggcttttcatcctgttgatagtttcttttactgtgcagaagttcttaagtttaattagatcccatttgtcaatttttgcttgtattgtgattccttttgacatctttgtcatgaaatctttgcccattcctaagtccagattgctactgcctaggttgtcttccagggttcttatagttttgggttttacatttaagtctttaatccaacttgagttgatttttgtatatggtataaggaagaggtccagtttcaattttctgcatatggctggctagttatcccagcaccatttattaaatagggagttatttccccattgcttgtttctgtcagctttgttgaagatcaagtagttgtaggtgtgtagccttatttctgggctctctattctgttatattgaactgtgtctgtttttgtaccagtactatgctgttttggttactgtggtcttgtagtttagtttgaacttaggtaacgtgatgcctgtagtgttgctctttgtttaggatttccttggctattggggctctttctggttccatatgattttttgaatagttttctctagttatgtgaagattgttgttgatagctttatagaaatactattgaatctgtaaattgctttgggcagtataaccattttaatgatattgattcttcctatccttgagcatgggatgtttttccatttgtttgtgtcatctctgatttctttaagcagtattttctaattctcatcatagaggtcttttggctccctggttagctgtattcctaggtattttattctttttatggcaattgtgaatgggattgtgtttctgacttggctgttggcttggctgttgttggtgtgtaggaatgctagtcacttttgtacattgatttcgtgtcccgcaactttgctaaagttgtttatcagctaaaggagcttttgggccgagactatggagttttctagatacagactcatgtcatctgcaaacagggatagtttgacttcccctcttcctgtttggatgctttttttttttctttctcttgcttgattgctctggccaagatttccaatactatgtggtgaaagagcgcatgcctgtcttgtgccagtttacaaagggaatgcttccagcttttctccattccatataatgctggctgtgggtttgtcatagatggctcttattatttttagatatgtttccttaagtattgtttatttttaaatgtaaatacttccccttctgatgacttgtatcttcaatccatttttattgtttctgagttttgacctatagcatcataaaatagtttttatatttatagcataatatatagaaaccaaaagtaaacaaggttacatcactgttaaactgacattactcaagttctggatttcaaaattttttaaattatttacatagaagttttacttttaaaaagtaattttgtgaaattttaatattttacataaacaataaaaatgaaggctctaagttttgccacagagtggggaagaaatagctgcttaattattatttcaaaagtgtaaccgtgtaataggcactatttttttgctacaatatttttatatattttatgttatctagactaaaatctcaaaattaagtatttgtttactatggtttttatctgtcccttttctattttcatgctatccaatgattagatacaaaaaaacctctatttactagctttcaagaagagcaaaaaatcatcccactgcctgctaactgcccatctattgcggttatggatgtttctgagaatattagagcaaaaatttatgctatattgggcaaactaggtaagaagttctcttcaaatttgcaagagtctgttttgctaagtatacacactgattttactttggagacagtttttcaaatataatgagcaaaaatctctttatatagagaaattcattttccattgttaccccaattcccaaactgcacccctcaccaattaaatcagaatctctgtgtgtgggatccaggcaatagtattttttaaagctccccaggcaattccaatgtgcagataggattaaggacagttagtttagatgattaagcttaaaatactgacattctgagtcacttgagtttttttttttaagtctttgctgtctattaaggaaaaagtttatcaaacactcttcagcttctgaagtaagatattattgtctgactacaacacagaaagaaatgattcctatatattggatgacctggcagaaatgtgttatagaaagaagcctactcacaagctactcacagaattaactttttcataaatcaagatgaaatcaaaagtaactttgcatttgtttttagataggtagatagatagatagatagatagatagatagatagatagatagattcttagaatcacttgctctgctaaagtaattctgtctttataaactttattttagattttgaaaatttacctggcctatctgctgaagattttgtcaccctttgtatcatacatagatatcttgattttaaagtaagtatctttttaataacctgattattaaaatctagatagcaaaaaattaactggaaaataaaatatctattcatggttgtgagcaatcatctacatactgtatagtttttatttttcattttgcatctgatgctgttgaagaaatacaccatacacccatcccatgattgggtgtttttcatgggataagatttcatccaacttagtttgtgaaagaagatgtacaaaactgatataagccgggcacggtggctcacgcctgtaatcccagcactttgggaggccaaggcaggtggataacgaggtcaggagatcaagaccatcctggctaacatggtgaaaccctgtctctactaaaaatacaaaaattagctggatgtggtggcgggcgcctatagtcccagctactcgggaggctgaggcaggagaatgatgtgaacctggaaggtggagcttgcagtgagccaagattgcgccactgcactccagcctgggcgacagagcgagactccgtctaaaaaaaaaaaaagaaactgatataaaactgttcagaagcctagcaaaaaaaaaaaaaattatttttatgagatggagattttgctcttgtcacccaggctggagtacaatggcatgatcttggctcaatgcaacctctgcctcccaggttcaagtgattctcctgcctcagcctcccaagtagctgggatgacaggcacccgccaccacgcccagctaatttttgtattttttaatttttgtattctcatgcctgcaatcctagcaccttgggaggccgaggtgggtggatcacccaaggtcaggagttcgagaccagcctgaccatacagtttcttctctttggagttgaaattaaataagtttttatttattaaaataaattattaatacttattaaagtattattttatcattactttatattatgatccaatcttgattaaaagatagtaggttacttaccttgctagttatatttgtcagtaaatacttttgaagtctcaagaaagtctttttaagttaacattgtccttctactaatattagtactgtatatttggatgttgtaaatgagtaaacctctattttctttctttccttctttttttttttttttttgaggcagagtctcatcctgtcacctagcctaaagtgcagttgcatgatcacagctcactgcagcctcaacctcccaggctcatttgatcctccagcctcatcttcccaagtagctgggactacaagtgtgtacccccatacccagctttttattgggggggggcggggcggggtagagacaaggtctcactgtgttgctcaggctgccttcaaactcctaggctcaagtgatccacccactccattcagcccaaagatgaattttttccttatcatagatatataatttttttctttaattttatgggtccagcacacttctgctgcacaactctgctcttttttctctaattctaaatacactcaagaacgttaacttctagacagcctagaatatgagatggagccactgacatgatggaaccatggagttaaaagcttgagattccattataatttgccttagctagaaagtgaggggcagggcccctttctcagggtggctgggttctagggtcctagtaatccccatgttcattctcctaaaagttcatcttgacctagccttcaatatagggctttagggaggaaagtaacgatagttcagaaagatcagaataaatcagcagtttctgcagctgtgaaatcaaggtaactataaactagagggcagtgatgatggtgatgatggcagggaactaggcataggagagccttatccatgaataacataccattgaaaaacatttgataaattcctactgagtactcaaatgtagctggtaccctcaatcattcccaatgcacttattcccaggaagtaatttaggaaaagtttaagtgttaacaggagtgactaaccatataaaaaattgtataattgtacaattgcatgatttgtttttggttaatttaactttgttaaactttgttataacagattggagaaatatggaatgaaatatatgaagaaataaaattagaaaaattaagaccagtcactacagataaaaaagctttggaagctattacaacagcatcagaaaatattggaaagatggttgcttctctgcaaagtgatataattgaaagccaagcatgccaagacatgcaaaatgaacaaaaagtatatgcaaaagtaagctacataggtagtgaggagggagaatgaagataggttggttaatgggcacaaaaatacagttagatagaataagttctgttgttcaatagcacagtaggacaactatagtaacaataatttattgtacatttcaaaatacccagaagacttggaatgctcctaacacaaagaaatgataagtgtttaaggggatggatatcccaattaccctgatcattacacattgtatgcacatatcaaaatatcacatgtatgccataaatatgtacaactattatatatcaataagaaagtaagccacagataccattaaggcacaagataataatttcaatgtataaacccagatgaagttatccataagatatatttttcttacttgtgggtgtttcagccttgagttattttgtggttttctcttagagttattttcagtgtctctgtgcagttttaaaagaaactatggagtttgagattgagttactatattcaatgctgtttttttgcattataattttatttctacagtcttaaatttttaaaaggcagagagatacttgagacatgccactggactccagcctgggtgacagagtgaggttctgtctcaaaaaaaaaaaagaaaaaaaagaaactgaaacttaattatctttctcatttcagatacaggccacgcacaagcaaagagagctggctaataaatcatgggaagatttcttggctagaacatcaaacgctaaaacgttaaaggtaggatttttaatgtattatagtatccacaacaaatagccaactcttacagacagactttttcaggaacaaatattcattcattttttcctagtgacctttccgtacaataccagcactattagatgctcatatgcaatttagagtgataagtgaaactgcatttcacagttacagaagatgctgctttgagtttcatttggtttatcagggagaaacaaggctgatgttcttgacctacataaagaagaagatgatagccaggaatgagcaggaaaatgtgttctgctttccattctgaacctgcttattcattgatttcttttctgtgagaggcaaagtaaaggacacaaagagcaactatcttgtattactctgtcccccaagagcttttccctctgtgatcaccaaaagaagcattatgttaaacttaaatgtgaactggggataaatatccctttgtagaaaaatgtggtaagctacttcaactgtaagctagaaactaatctaaaaaatgtatagtgctaatcgttcacttgaaatatgtgagaaacaccatggatttccagaatttcattacttttccccacccttttccattaatatcttggatacactttttaaaaaatctctccttcatttctgatactttggatagactttacctaatgtttcaatacttcctatagatataaaattgctaaatgttaagttagtccacaagacggtggaaccatattaagatagcaaaaccaaatttaagaacaagctcactcaaggtaccaagttatctccctgttcactgaaagttcttcccaattctacttataaaatgtcttcctaactgcctgtatttttagcactagttaatgaaaatcagctcctttcctgcaggtcatttattacttcacatttcacttgtttagtgtagcaaataccttgaaaataacttcaaatagcttaaatataactgcaatgaattacataatttatattattctgaatgcttaaaacatttaagtgtacttaatcagttggtaatttatgcaatatgttttgcaatatgcatcacctgatataaatttaatagcttattaaattatgtgctaaaaattgaacctgatttcttcaggatctgcttgactccttggtcatatatggatttcttggactacttccagaaatctctggaagacttttaggtgactggagtcttcttcaatgtgcaaagtatctaacttactaataactgtctttttagtctaaatgagtaaatgcagatttcagcgctatctaataaacaaccaaagcataagccagacacaattaaatatgtttttcattgtaagtaccatcattactgatttaatagcaattaatattttctttctaatttaaaaatcctcagaaagcaaaaagccttcaagaaaaagctatagaagcctccagataccataaacgaccacaaaatgcaatatttcaccaaacacatattaaaggccttaacacaacggtaagattctttctccataacattttcttaatagacattaaatttagagtgtttgaacaactgtgcaaatatactgaaaaccattgaattttacccattaaatggatggattgtgtggtattgaattatatctcaataaaactgttcaaaaaaaattttaaatttaaaaattagaagttaaaaaaattaataaaaaaaaaacttaggcccccaaaatattatgtcaatgggattttcatctcacattttttctttttgctgttcaaatttcacatcattaaggcatatttatctccaatgtatatccacttttgcccggttctggtttagagtaggcccagccctccaggatttctaagaaactgctataaacactagtcagcttataattgtccttatatctctttaacagaaaagacgcagtgcttccccttttcctggcgagtagatcccaagtgttcctggtatcctctgctagacttaatttgcccccagttacaaagctgataagcaatagaaatagaattcaaacctacttttcctggctccgatgcccttatctttctattataccataactgcctcctagttattcattacatttgtgtcttttcaaaagtaagctgaaggatgaatgagtttttctcttgttgaaaattgtgtaaatggacttttagatatttaccttttgcctttttaggtgccctctggtggagtagtaacagtggaaagcactcctgcccgattagtaggaggacctctggttgatacggatattgctcttaaaaaactgcccattcgaggaggagccttgcagagggtgaaagcagttaaaattgtggatgcaccaaaaaagagtattcctacgtaatatactatagagactttttgaaataaagtcagcttataattttttagctgaatatatctttatacatatgtaaagccaatattttagaataagtattttagtataaatattttagtaaaatactataaaaataaaaggacatataatttatttttatggaaaacatcaacatgtaatatcagaagagttgtcatcagtttctttggaaaggctaccaattttactaagtgaaattgtaaaacatagtacatcagttaggactctgttggttgcatgtgaactattctaactagtttaagtcagaaaaaaaatttcttacaggctctatacctatcaaatctaggaggaatttagactacaggcattgctgaatctaaggactaaaactatatgagtaggatcttctccttccctagcagctcctggcttacattctcttaggttcatgcctgtgtctctgtggtttctgcagctgcctatgcatctcaggacccctgattgcccacatgcctacggtagtcctgagccattcaccatgactttggccatggctgagtactgcctattcctggagccagaagcagggcaactccatccaaaacatatggatagagtggggaatcagggtactattatcagaagcaagtatatatgaatattgggcagcaagataaacaataactctgcaacaagtatgttggtcaaaataaaattatgttttctctgctataaaagcaaatgttagtcatgagccaaatggtaaaaaagaaaaaaaaatgcagctggttttactcttaatatataaatatacaaagcaaactctaa

SEQ ID NO: 333 - DNA, 65890 bp, Homo sapiens; identical to SEQ ID NO: 332

SEQ ID NO: 334 - DNA, 501193 bp, Homo sapiens
gcatccccttgattaaatgtttttcctcctatgcaatcaccattagctgtttggctcccattctgtattcttctgaagcagccctgcattgcaaatcaatatctttctgaaaagacagtgtgttgtgaattgccttgacagcatatgcacggttactttggctgcaatgctgctgcagagcccggttactctgccttcgtgggaactccacaggcaagtccatcgtgtttggaaaaaaaaattagattttttggagaaaataattgagctgttaaagctattgatactgaatgttagcatgtcctttgagttcttctcaacagtttttggtcttattccactgagattagcttctcttaggggatttctgggcttttttttttttgcttgcttatgcatccccctctcttggttgtagtacggccgtaccatttcagcttgctagtgcagaaagatgtgaattcagttgctgtatgagcctggcctggtgcaaacacattgctagagacatgttaaagagttccaggtgaatcaagcctgagggagacaacagcaaaacggtaagacagagcatgcttaaaattacaggaggggttttaatttggagcatctcggcaagtctgaatcctgactcactcatttacaacttaaaaaggattcattttatgcatgtcattttactcacttccttctatttaactgccagaaacatcacagattgataaagggggtatttaaattagagactgactggaggttactcatgggagagtcttttgaggctcccgaggctactgcttgtagtttgtaaacaccagtagcagtgataagatggggaaaaggtttaacgactgcttctttgccatatctgagtcttattccttctgaaactagtctttatttattacagctgaaagagatcttacatttttttttgcctggctgtgcttggctgaatgccctctgagtcaagcaagtgaaggacgagagactactttttccatttgagtaaactgatgtccatgaatttagctggattggatctgagtagaataaatatctctaatatattagagacctggggcttcctccctgctcatcctatttccttcctttttggatcacagaaatacacctgctttaagtgtgtactgctgagcagaggtcagtgtgctggtattttgcatcattacacctgtagtggttatgcttttatgtacagaagtgataattcttcgtgcagttctgcgtgaagtgccagctctaatagtagactattagcattttggatgctaatggagaacccctgcattcatgaaggaccgtggtagcagacagcctactccaatgaggcttacctgcttgtaaagcagataaaattgagagataggaatgtaaaccttgacgtcttcagagactgaatttttgtttcctttgttaattgtcacacagttgacatatttgatgtggcgggggtttgaacttgaaggacatgttttaatagtgttcaaagtgagattaataacattacttagtcctagtgactttatatggatccacctattattatataggtgctgaatgttaaggatgtcagcatttgattttttgctttaaaaatattccacttgtgtatagtttaattaacttagtactttatgtaaaatgtagatggtgaatgttaaaaaaatcagtagcttgcatgttggctattatacagaactggcatgtagccagttctgtataattttgtgacataagtaaatttaagaaagatcgcctgattagttgataggctaattgagagaaatatgggtaactgttgtggttcactatgagtaaatttctttaaatggtgcagtgcttctgtattcactcaactatttactgttgaggttggacattgattgttgggagtgaatatttggattttcttccaaagatagatcaaatttacctctctttttttttaaactttttttttctgtttggaagatgatgcgccctgtgtttactgtttctttttctgagaatcttgtgttttagctattcatatttttacctttactttgtgtgagttgtgaggatttttttttcatcctgtgacagaaggaattgtaagtttgcgaaaagtaatttttaaaaagtagagcaataacgtgactgattttacaatcatacgatatttctctcattctgcaaatattgattagccacccactatgtgtaaaacattgtaagacctgctgtaaaggaagtatggatgaaacagtacattttcctgaagaagcttagatatagttgtgttagtattttcccctggaatacgccccattatactttctcatggatagtcagtttggtgctttttaatcctctccttttaaaaaagcattttttggttaaacatttttggagtctgttgtgtaatagtggtgagtaaaacagatctagtcctggttcttatggaacttatagtctactatgtttttttttttttttttcaattgagccgagggtctcactatgttggccaggtttgtcttgagctcctggactcatgtgaccctcctgctttggccttccaaagtactgggattacaggcattagccactgcacgcagctacagtctacttttaaaaatatttcaaagagaaaatatgtggcaagtttttttttttcattttggtagttatgaaggagatattgtatgctttgatattttttattgtggtgaaatatatataacacaaatcttgccattattaccatttttaagtttataattcagtggcattagatatattcacagtgttttcaaccatcaccactatccatttccagaactttttcatcaacccaaacagaaaccctaccctgctctcattaaatagtaactccccattccccttccccctgcccctggtaatcttattctactttctgtgtctgtgagtttggcattctaggtacctcatagtagattaaattgagtcatatgtattttttcttttgtctctgccgtgttttagcatgttttcaaggttcatccatgttgtatcatgtatcagaatttcattccttcttaatgcattctttgatttttatatgggatagacagcagtttttcctcatatgatgacatgaatcaagttcctatatggacatcgtaataaatactttagatatactaaaatagcctatgggaaagggcaaggaataaggaatagaaatgcactgagaggaagagttatggatatattatatattattttcatatatttatctatggatgtattataattgagatgctaagattttcacatcaattctttgctgatagcagcattcagctgaaataattggaagctgggccatggcttttgtcattattaacatttgaatttcacccactgtacttgtgtctcctttctctattttacttcataagcaaagactgatcatgttgaggtcttcttacagagtcagagactcttagagctggcaggtactttagaaattgtgttatttaattggttcattatcattcattagccaacgtgagagggaaactcagtctcctgctgcccgccatgggccttcttttactccccacccctgttttcagtggaaacaaccagaaaaccccaagtatcctctgagtttgacagaaatagtagagggtgtaaatttgatgccacattaagaagttttccgttggatgaggtaagcctagcttcatcaatacagctttctgtttctcagatttcttcctgatactgcttccataaatccagatggtttttctgaggggaccctttttagaaagccaagttaaggcctcagtgctgttcatttattttctgtcgaccattttgacagttcttacactgggtcagtcagcagtttatatccatgcttttaactcactatccaggggacccaaccatttatagaggaagaagattcaacatagcaatatccaatacctgagtcttcccaaataagcctgctccttcttaatgggtcttgctttctatccccctaactgtttttctgtcctcctaactgtttttctgttatggcctgacttttattatgagactaattcagaatcagattaatcaaatgcatgttaaatttgagtggtaggtttgtggggagagagggaagatgggccagaaaaccttaaaccagtgagcagttattttgcacagctttggaagtactttttttttttttttttcatcaggagagataagagagaatggagagaaatggagagaattgcagataaagttgttttttgtttacttctctcatgatgtaagtcccaggggacatgtacgaaagacaatacagtggtcaagagcttgtgctttgtattcagagtcctgtaatcaatcccatctcctgtgtttattttctgtgtggccttggacatgttacttaattcatgtgtgcctcaatgtaaccatctgcaaaattgagataatactagtcacctttcttatgaggttgttgtagagattaattgggaagctatttttaaagcatttttatagtaatttatgtaataagagctcaacaagttagccatcatcatcattgtcatctcatctagaaatccttgatttccatctcttttctatcagctgcattatatcttgcccaagatccttctgtagtttgactatagagcatatgtaattatttcttagtgttattgagtctgagtggataaaaggaggatgtaacagaaagctccaatatcctgtttatcatctggcagactttggaagggtaaatgttctttagacttacttttcggcccagttgataacacatttgccccagcagcttattcctcaggtaaatgaaatcttgctaaaaatacaaagttgacagtgaaacgcttctggaagcactggggtttgttttccggtgacagacaaacagcaggatgtgtgtatcccactgctgtgctctattcaccttgcatctctcaggcaggatttggtattgacttttctcagctacaggaaaggtttacagaactggtcttcatgaaatcagttaggagtgttattaatgggttactgtcaaatttattattgctgaaattttggctctttataatagatgaatcaattgttaaagcaacattgaaagatacttccattttctcctcaaaggttcattgttcccagtgttcctcttcataagctctgtgtggttagtgacccatatatgattctctgaaaatgttaagagcttcaaaagtcaattctatattgagtgatgccctatattttcctgaacactttgatggagtttgcatctagatttattttataagaagaaaaacattaaacttttaaactttataacatcattcttgacatcaaccactaaattattatccaagcactaataatacatttatattttattaaaaagatggctattgtagatttggagatgtatgttgtatttatatagccatctgtttcggagtaagaagatagtacacaattttatttctcctttagggaaggaatttaaaaatatttataatctttatttttaaacgctgttcatatggttactgggggaaagaattcagatcctaaaggatcagtcatatctccagtagtgttttctcttcagttttcatgttttaatgttattgcaccttctggatgctgtattttacatgagggacagaatagtgagctacagatatttgaaaggtgtagacatgaaggaagaactggcctggtttagtacaaagaagccaggggtggtttagtgaaactcaaaagtgaaaacaaacagaattcagaaggcacttgagactgtcttttgcacggcctttgagacaagtgagcttctgcagtccctgtgatgtttaaaaatacccctcaaacattaagcatatgtgtgtataggtagaaagcgtcctggaccatattattgatttcaagtctatgaatctgagatcagcctcttgtgtttattagtggttagtgcttctgacatggtagacatttttagtttttaaatcagagtagttaacagtcagtccccttcgccagcttagttcatactgctatatgttgtggagtcctttggaaatacactctgttttccccttttcaggtagaacccaaggcaaaacctaaaaaagaaaagctatatttaaacctgtaaatcctgtgggagagggagaaaaagtttttatttgcaggaatagacctttttttttttttttttttctagagtaagagttttaagggaatagtgtcttgatgaagaaactaattagccatgcagtgtgagccactgtgtagcttgatttttctattttgtagagaataggtattccatttccccagtgcagctatgggaattttgtagattggaaaacgctgtgttttgtagaatctcaaaacaaagtcacccgcttgctctgcttggagcttctcatctcttgtgtcccatttctgagccctttggctataaatgttttgttgaggggtggggggaatatagatatcaattttaatatttcacctcttaacacgtaccatttggtcgtatgatatgaattctgcactcctgactctgtcttttttccatgatggcattttaaccagcatataattgtggatgtcaactggaagtcagaaaatgtacataccttcttctttctcttgttgacctttttgggatatttaatgtttttagtggaaacagtgtctgaaagacatctcatctggcttttcacataatcagagtaggatttaactggagtgggaaatgttcagttatgccatttgggccaaagactcccctcacacccacaccaaaggaggacctgttttaggatacatggtactcttcacaaatttaagttccttttcaaatttcttttctagatcctgaggtgacttccttctaagtttttcctccaaagctaccaaataaaccctagtaagtagtaagcaaagcaagattctgaattcaattctacttaggataattttgtagtaattgtttttatagatatgatggctagcagcaaaacaatgttcctatattagagacacatacatctataaatttctatgcaggaagtaatgtcatatatgctgctataacccatgtatattctttcttctctactcatcactcattccaattccatggttgtttaaattcataaacatattggatgtatattattgcacattttatttcagagctgaaaatatattgagttatctgataactaccgtgaacttttgagataagtttgagtaaaatatgttaccgaaggagtagtaaaatttttatcactcattgtacacagagactgaaacaaattttccctctaaatttgccctctctacaatcacaatctcttattggaccataacagcagaatatatcattacatggtttagtgcaccatgtctcaaatttcaaggtgcacacaaatcacccagggatcttgttaaaattcagattctgacttggtagaactgcagtgggtctgagatcccagtgattcccgtgctgccagtctgcaagcagcaaggggttaacttttccagatgaaattctggtcacaatgctaactacattctgaaaaacttatacagacaactaacaatagggctggttgttagtaattctacccttgctatgagtgctcattaaaaccttacgttaaatttatcattatgatttggacaaaatgaagaagtataggcatcaaaatgaagaagtatagaagtcaggaagtataggcatctacctatatgagcctataaacaaaactgtatctcatctgaaatgtgtaattatcacagaagagaaagtgactaaataaaattattttaacaacatataccaaagcttaagcttctggaaagactacctaatattccataatagaattagcaaaacagttatcaagcctattgatggcaagcattgaagtccagtaagggatgtaacaaaactacagtcactgaagcagcgtaaaggtcactgaagcagcataaaggaatgtggtgtcctcaagagtcctccattcagcagtgtccactagctgaggaattcaggatttaagtgaaattgggtcagatgccaaagaaaccatgtagtagaaaaataagcattttaaaactaaatcgcaatgttagacattgaattctgatgaatggaaacatctggtgaagtgttttcatgactggaaaatatctcaactcagaaggtaccttgtttttaatgtagtttctcaggactaatttttttagtggcctatttttagttaaaggggaaagcttataattagtaaaacaatccatcattgagtaaatattaacagaactatttcatgcccggtcttttgtgctttgggaacactaaagaaatagaagatatggtttgtgtgctcaaggtgtttacactctggtcatggaaatacaaacacgtgagaaacagtgctcagcaaagacggagctccccccaccccaccaaaataaaccaaacacttgaaaacaaattctacagtagcttatataagaatatataataacatatatttcagtaacaaattataaaatacaatctaaaaatgatgtagttggtagtgagggcatttttggttgtgacagtgacaatgatataagggcaggactagcatttagtacacagaaccatggttgccagatgctctacaacgtgtactgctgtggaaatgctgcacccaaataattttcagccaaaatgcccaggatgccaccactgagaaacagtgccaggatgtcagagttaaggaaaatctgaaaagactggagacattaagagaagtgtatacatggtatgtacctgtctttgtcctttctaaatcctaaaattctaagggaaagtggaacacaaaggaagcacaaagaagtgaatttatgtgtgagactttactagttgacctatctaaaattatttaccagctgcaaactgctgcctaaagttcatagtagaacattagagctaaaacagatctgtatcattttacagatgagaagactgagatctggggaatttaagtggcttgtcttgaggcacttagttctgacttctatgggcagtatgtttgcatgtatattagataatgttctgaaggtgactttaggcaagatcttggttctcataaaacaaagctgtaagtaaaaaacacattcttgcatatatccttctatatgtgtacatatctttgctctgtgtagccactcttactgccatctctgtgtatacacacatacatacacacgcatactattagggagaaaatagagaagacagcaagcaaagagaggaaagcatacttttagatttgacagatttaagttatagatgaaggcagttatcattggttatgattctagtggcaatgattctaattcttcctacctctctcttctacccaaaactcttgcacatctatccttaatagctgaaattacttttataagggagaaaacttgttgttctgtaacgcttaaagttcagataattctgggagaggtagtactacgatttaagtgctcaaaaacttataaatgactgatgatttttttatattgggagcagattttgagtaggataaagccatcaggccctcctggggtattggacaaagggaaaaaaacaaatgaaagaggttgtcaagatttttgcttatttcatagttttgcattggacctgtgatggatattcctttcatgaatatcaaaagagcatgacctagctacagcctgacgcatgatacatatttgctgtgggttaacctggagtcttttaaaccaattcttttccagtgtctgccttcaactaacagtgtggagtgaagtagtagagaaaatcagactctgaacccagtaaaatgctgatcaccagaaaatgggtgattcaaagggacaattttcagaccgaatgaattcacttgaaatgaatgccaaccttaactgaattaagctgtgctctttcaaatccactgctgtgagttcagtagacagttgtctggattttacatagctctaagctagaatcgtaggtcaaattgtgacttttggagcctcatacactgtttgaatttctaacaatttttactcaggtttgagtttgccagcaaatgaacaagttcctgttaataatgagtagaccaaattaatcgcttcagatgaatatccatatgtgtgggtgcatctcaaagcaagtttgaaattctagcttctattgaatttactggaaaaaaaagtttattttggtatttgtgatgatttcttctttttatatgttttcgaataccaggagacatccctgcttatgtgatttttgttacttcagtttctaaatggaacaagtagtatgaaaaagtacagtcatggagaagactattcttagttctcattgatattagaatttctgtcttgttttcacacgatactgatagcatagctgtctactggaatttgccttgggcagaggtgccaaagatattttcttctggacccatgatttgggaaaaccatttttaacctgtggaagttccttattttccacgagttaatgaacaaatctttactggactcttcaagaggagattcgaagggaaaagtactttagggggctataaaatgaatataagacagtccttgccctgtggaagagataatcaggttgttgacattaaagtatcacaaaaagaataattacagtctaaggtatgcaaaatattggagcagactaaattcactgaagtgaattcttaataaaggattggtccgagtgggtgggatttaatcaacaagtgcatctaggcaaaggcaattttggagacaagtcatggcttggtgggaggaaggttttcaggctgagggcggtaagaaagcatgtgtgaaggacagtgaagctgacggacagtgcgtagaatgtctgagggtctcctgtatccagaatgttcacagctcatggcctttgtatttggccaagtgcccacatctttaagaatgtatgtagctaagaaatgtaattttgaaaaccaatttgtttctatttaagcattgtttactgacctaattaaattcccttaatgtcatatactaatttagtgtgactgattattttgacatattctagatacttttaaacaaagaagacatatgtaaatgtaatgattgcaaattattaatatattactatacttattaacagtgtgggtttatgtaatcttattattatttctctattcttttttatacctttctagggttatagatctacttatttagatttcttccagggagttcagtaataatattttttgtgtctttttgggattttgtaatctttacaggaccacaagtaaaagaattccttctcagaacagccacggttacaggatctgagttattgactgttggggtcctggatgcttttttcaagtcagagattcacatctgagtcacgggttggcagttaagctgagttttctttttaagggttaaatttcatatgtattattaaaatttaacttctttaaaaaaatgctttccacactggttcacataggttttctttttaatcttgtttatctccaccagatgtgtactttgtaatacgttgcttaggcaacatcacctgccctttagcctgttgcattacatccacccacctggtctgctgccattggaacatgctgtgttgcttttctttctacactcatgctgcttggaccctccccacaggccctgatcattcattcctgtccttgatacagttccttggtactttttttctagcacttcttggcttactcacagttctgtatcttaaaatcaaccatattgtattatattcatacttcttttatattatagctgccatttggcctttatagtaacttttctcttttgaaatcataatgaactcatggtctttcagcaactcatcttgttctatttaaccatacttttatttttccttttgatgctcgaataaataatcacagtttgatcgttgggagctcctttaggcagattcctttgtccttctagcacgatccctgacatttttgaaaggatgccagttttctggtaacagctggatgtttcctggctctttcacacttcctgcactgtgaactggaatctattactttccaaagatttcttcctttccttactggagaactggaacataggccaaaatctgggcactaggggtgcacatgaaagttagtagtggataaaagggctactgtttggtggttggaagagtctgtgtttttgaggtttgggttctcagtgattttttccaatttgacattccgtacttctgtctctgagtttttttaatatatgaggttttatcttttactaagaccttttactgcactgaccataagcattttgctgtgggcagaaagattctatttggggtgggaagcatttattcagattgctgacaagttaatataagcattcaactgaagacttgtacgcaggggagtagcgccagtgtatactgcgtcctccagagccctctttcattgctaagacccaggctgctcgcttttctcttcatgcactctggatacttaaatttattctaagagctctcctaccctccccttttctcccctcttacccctcttctcccttctcccctcttacccctcttcccccttttccattttctctttcccttcccccaccctttcccctttcccttttccctttttgagatagggtctcactatgttgcccaggctggagtacatggagcatagtggcacagactctgcagctcactgcagctttgccctccctggctcaagagatctgtccacctcagcctcctgagtaggtgggactacaggtgtgcaccaccacacccgcctaatttttatatttgttttgtagagacagggtttttccacgttgcccaggttggtctcgaactcctgagctcaaatgatccacctgccacagcttcccaaatgctgggactacaggtgtgtatcaccatgcccagctaagttgattgttttctacttttattttgtagtttgctagtagttagcaaaaatggtaaacgtgaaatgtttaagaatatttatgggaaatattttaagttgagaaccttgttaaattttttttttctcaaaaattagggaaaggcggccctcttctgtcttaatgatagaatactttagagatgttggtttttcacaggtgcatagtttccactgatttttataattatcaactgtgccatagtcagatccattaaatgagagactacctgactcaaagtatgtattgtaaggccgttaaggcatgaagatggagagaaagctgtactttgcagtagattctgtaacagtttctcttgcttaaattgtataggttcagaaagccatcagaatttctaattggagttcctctgtttcctgaagccaacaaatgactttttttgctttattgtattttctagaacttaaaatacaatgttaaatcaaagtgtttgtgaaagtggatgtccttgaattttccctgtttttaggtgaaaagcatgtagtttctcagcattaagtatgatgttacatgtaattttttggtagatgctctctatcagtttgaggaagttttactctgtttttagttggttgagaggttttattgtgaatggatgctgaatttatcaaatgcttttttctgagtctattgagatgatcatatgatttttaaaaaactgtgtattaattgcttcataacaaattatcccataacttaacatcttaaaacaacatacatttttaaaaaatcttagttcctatgggtctcttgcagatgctccttagctggctcagggtctcttatgagagtccagtcaagcaggaagctggaactgtggttgtccctgaaaacttgactcacaaggttgtttgcaggccctagtctttctgcacaggtgcctctccacagggctgcctcatggcatggcagccggctttccccaggtctggtgatctaagaggggatactcaaggcagagagagcaccaaaatagaagaaacattgttcttacaatgttttctcagaagcggtatcctatgatttttgccatattatatttatgggatacaagtcaacaaatgcagcccacactcaagagctggggattacataagagtgtgaatacttagaagtgggtgttattgggagccatgttagagactgcctaccactgtattttaaaatggtgaattacagatttgtgaatgttaagccaaccttgcattcgtgggattagtgtgacattgtcatggtttactatcttctttatatattgttgcattcaatttgttgaagatgtaccagtaattttttgcatctgtgttcatgagagagattgatctgtagtttccttacaatgttcttgtgtggctttggtattggaatgacactggccttataaaatgaattgggaagtatatcctcttcatcagtattttgaaagggtttctgtacaattgaagtcatttcttcctttaatgtttgttttaacttcaccagtggtgccacctggccctggcattatctttgtggtaatgtttttgaccacaaattcaattcctgtcatagacacaggcctattcatgttatctatttttttttttaactgagtgagctttggtagtttttgtctttcaaataattggtttcatctaagttgtggaatttattggcacaatgttgtttgtagtatttgtagaacatctgtagtgatatcactgctcccattcctgatagtaatattggcgatgtatattttctacttttttttccccttatctgtctggctagatgttcatcatttaaaaaaaacttctctgaaaaccagcttttggttttattgatttttctttattgttttctgttttctattttatttatatccactttcttatttattatttcactcttcttatcttggtttttatttgctttatttatttattttttttttagtattttaaggtggaagctgaggttattgctttgagacttttcttcttttctctagtcatttagtgttacaaattttcctacagctaaagtactactttagctgaatctcaccattttcgtattttgtgttttcatttttatttagtccaagatgctttctaattgcctttctctattaatttagtcatcaactattttctgtcatccttatcttttagtttctattttaagtaatttgatttcaacgtgcccttacatttttttttctttcaaattttctgtgtttgcagttcattgacttctcaggcccatgtatttataatttaattgctttagtgatgtgggtggtttcttatttactgccttcatgtccttaagaagagcacaaaaacccttaaaaatattgcatgctccaacatacttgtaattcatttttactttttgatcatgactagaggactctgccttgagtcttttaaaaatatcttcagctgttttctcacatgctaaaaagtatgataatatttttctcatttgacttagttagaattcagcctgtgcttagtagttgagacatactcatagggttgatgtttaatgattaaaaactttttgtttcaaaaacttgaaatggcttattttaattatacatgcttttctactttagtggtttttaaaacattacatatgttggaatatttattataaaattcacacaagagtgtaccaaaaattgctaatcttgcccgttcaattccacatgtctggagatatctgatgttaatagtttggtggtgtgttttcctgtatacttttcaccatgctcatacactcacaaatatctatatctatgcatctgtgtctgtatttatatctgtatctgtctatatctatccatatacatagccgcatttataccccacatggagtcattctatacatattagctctgtgtatctgtgggttctgtatgcacatactcaaccaaccacggacccaaagtgtgtattcaaaaacttcgtatttttaccttaacagtgtgggcttttcataaatatcttcggtttttctgcttttgatagcatatagggatgtgggaactttttataagaagaaaagcattctaaaaacaattttatttagagttatattttctttagagagaacaattaaattagttagctttacagacaagccagaggccatcaaattattgaataaagacaacaaagtctccagagtatcgggagaatgacaggcttagaactaaagtaaaaagcaaggagcaaaaatcacagagactgaaataaaatgagagggtggggaaggctgggtgagaagagaatgggtgaagaaggaagaagaagggaaggaggtggaggtctagtggaataatgtaaaccaaattttgaaatgaatgctttttggtgtttttcttttacaatgttatttctttttatccattagctttgaaataaaggaaacccccaccattgtcctcagttcttcagtatctctaaccattagctccattcattccaatttggagatgaaatcaagatggggacagattttaagcatacatattcatgcataaaacttttaaacaacataatgccctttccttctctagcctaggttagctgcttacacgatgacccatcagttaatgtccatctgatttgcctattttttgttttttaaattaaggctagttacccaacctcttaatgattcagaaataaaccacttccagtcagatggtaaaacgtgtgacagagttcaagaatcatgttagggtactactagcagcctgggccttaagtttctcattttagaggtagattttttagtgtaagctctagtgtgagatctaagtgtaaacacaatgattgtgaggatttttttgtactgtaatttatgctgatgcagcttttagaatgtgggctttttgggtatttcctgaaactgaaattggcatgctttctagagttatatattggcatgtttagtgatattaaagttgcagtgaagagttctgaatttaatttcttcttttctcagatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcggtaagtgcagtctttttgtttatcactgggtaaacagaaggaatagccttcttatgatagcatgcggtgctggaagacagcaggaaactttatcagtgccttattatgcattctctcccagggtggttgaatgttttggaagagagagagcaaactatatatggactccttatttataagcactaagcaagcaaatgaatgaaatgattcaacttatttttggaaaaatcatttttcccccttaattgtttctagttagaggaatttataattaaaagtcttttgtatttcaaacccttggagaggttattgaactttactgtgtaggcagtaaggatagttttgaaattagcaaattcacaaggaatttcattgcagaataaatatcaaaatttgttcacttgcgttaatccagttttttttgggggggtactccaccagtctttctcatgtgactctgtaaagtgacaagttgaagttcttttccaggacaaagccctgtactgaatggaaaatgctggagtagaaatctgtgtagggtagattcagtaggaccaaaggaaagaagagaatgtccagaaagaagtgttagagggaaacagactttagatataactagtgatttacaagttagaaaggaacacaccaagagagaatattctctgttatatttctattctcaaatacattttttcctactttttggcttaaattaatatacattatttacaattgtatgataatgtaaattttggtcagggaaaccacaagtatgctatgaataaatttccttccttgcacaacttcttcattttcttagttgtcattgtctacttttccttcattcaaattaagataattttaaacacaatttgaggcctgcaactatatgacaaaactgtaaaatgcctccaaaacaaatcagataatctatcagtttttctcccccactgagattgccctggcagttcttcatagtcctaatttaatatagattggttaacctctaatcctatagtcataaggcgtccttttctgagaattttttcctccttttttaatgttaaatacccattctctgggttacatgtctttcttgttcttggtttatttcattgttttaaagtacatcctcgcagtagcttcttgagaaagggtgatggggggtttgtcatatgactatgattttatctgtcgttgattacttgattaataatctggccaagtatgtgattttagtttagaaaataattttttcttagacttttgaataccttgttttattgttttctaggtgcctagattgtattgaaatccctagactattctggtttcccagttcatcctttatctgctttttttgtttgtggaactttctaggactttcttttcatccctggtgtcatcctttttcttggtatcaatgggtgttttcaatttttgagttaatttctttcagtttcaaaaattttcttatatgtttatttaattttttgtaatcttctcttttacgataacatttttattagttggatgttggcattattggattgatcttctagttaccttttcttttccctattattttaaatcttttttttcctaccttctgggtttttttaacttttaatttttaacccttcaattggatttttaattatactaatatttatttccatgaactctttcttattctttgaatgctcttttaaaaagtatcctgttctatttcaatgaataacatatcacttcatatgtttctgaggatacaaaatgtagcttggggaattttttttccttttacatattctctgaattatttctggatttcctttgagtttcttgtttctgtttatttgttttggtctctgccttacctgttgagatttttggtgggtctatgtcatgcctcttggagagaaactgttggctgtcagtttatgttatgagtaatgtactcagaagttgattggaagctctgtgcctgggtggcttgtcagttggttggcttcagcatagggactcttggtgaagacctagtcgttttatttaagtactctcaaatgtcgctgtctcttgatcttgtttttgttactgggtgtttctcacaaaatggacttacccaatttattttttttaggacatataaacctagctgtcactattctgagatgatcaagaagggactgaggacccttcagttctctatgccaactttctcatgatttttttttttttcattcggtatgactcttcaatctgatatccactctgcctggtatccaagccccagttgaattctctgattcaacctcttcagagaataaatctctggcgggactaggaagggatagggggctggccgagggagactggggcaaagacctccaccttaaattcactccaactaatcatatcatttgtagccccaacttgaacttcagcttccagtttgtgagtatttttgggattctgaagtatgaattgacttatttcttactggcttatgccttggatcatgtaggtatcaaggtttttttttttttttttttttttttttccccactcatcctaggcaatgtgacttctcaaccatttgtgtcctgtctttacatttttatttctatctcgtctctagtgttctctttactcattttgattgcccttatgggttttaattttagtattgttttagtatgaattggtaagggggagagataaatacatgttttcaagccatcaagtttcactggaagttttcacagtttctctattgtattttttagtttctttagatcatcttgggcttaccctttcctggttcaccctgggatgactttttttaatatatattaggtcatttatattactttgtgtgggaactgctttgctttctttttattttaggaatttttgcttcaattcaatgtgccctggaaaaatgtcttttctcttaccttatcaaactggaaatggcttcgttttctctttcagcaggatgctataatatcctgtttttttctgagtcctttctgtttgctgcccttttaaaaaatatattttttctttttttaaaattatactttaagttctggggtacatgtgcagaacatgcaggtttgttacataggtatacacttgccatggtggattgctgcactcgtcaacctgtcatttacattagatatttctcctaatgctatccctcccctagccctggtgtatgatgttcccctccctgtgtccatgtgttctcattgtttaactcccacttatgagtgagaacatgtggtgtttggttttctgttcttctcttagtttgctgagaatgatggtttccagcttcatccatgtccgcgcagaggacatgaactcatccttttttatggctgcatagtattccatggtgtatatgtgccacattttcttaattcagtctatctttgatgggcatttgggttggtttcaagtctttgctattgtgaactatgctgcagtaaacatacgtgtgcatgtgtctttatagcagaatgatttacaatcctttgggtatatacccagtaatgggattgctgggtcaaatggtgtttctagttctagatccttgaggaattgccacactgtcttccacgatgattgaactaatttacactcccaccaatagtgtaaaagcattcctatttcttcacagcctttccagcatctgttgtttcctgatgtttcaatgatcatcattctaactggcgtgagatggtatctcattgtggttttgatttgcatttctctactgaccagtgatgatgagctttttttcatgtttgttggctgcataaatgtcttcttttgagaattgtctgttcatattctttgcctactttttgatgttgttttcttttttctcttgtaaatttgtttaagttctttgtagattctggatattagccctttgtcagatggatagattataaaaattttctcccattctggagtttgcctgttcactctgatgatagtttcttttgctgtgcaggagctctttcgtttaattagatcccatttgtcaattttggcttttgttgccattgcttttggtgttttagtcatgaagtctttgcccatgcctgtgtcctgaatggtattgccaacgttttcttctagggtttttatggttttaggtcttacatttaagtctataacccatcttgagttaattttgtataaggtgtaagcaagggatccagttttggctttttacatatggctagccagttttcccaacactatttattaaatagggaacccttttcctattgctttgtttttgtcaggtttgtcagagatcagatggttgtagatgtgtggtgttatttctcaggtctctgttctgttcattggtctatatatctgtttttgtaccagtaccatgctgtttttgttactgtagccttgtagtatagtttgaagtcaggtagtgtgatgcctccagctttgttctttttgtttaggattgtcttggctatgcaggctccatatgaaatttaaagtagttttttccagttctgtgaagaaagtcaatgatagcttgatggggatagcattgaatctataaattactttaggcagtatggccattttcatgatattgattcttcatatccatgaccatggaatgtttttccatttgtttttgtcctcttatttctttcagcagtggtttgtagttcttcttgaagaggtccttcatatcccttgtaagttggattcctaggtattttattctctttgtagcaattgtgaatgggagttcactcatgatttggctgtctgtttgtctgttattggtgtataggaatgcttgtgatttttgcacattgattttttatcctgagactttgttgaagttgcttatcagcttaaggagattttgggctgagatgatggggttttctaaatatacaatcatgtctctgcaaacagaggcaatttgacttcctgttttcctaattgaatacactttatttctttctcttgcctgattgccctggccagaacttccaatactatgttgaataggaggggtgagagagggcatccttgtcttgtgccggttttcaaagggaatgcttccagtttttgcttattcagtatgatactggttgtgggtttatcataaatagctcttattattttgagaaacatcccatcaatacctagtttcttgagagtttttagcatgaggggctgttgaattttgtcaaaggccctttctgcatcttttgagataatcatgtggtttttgtccttggttccgtttatgtgatggattacatttattgattggcttatgttcaaccaaccttgcattccagggatgaagccgacttgatcatggtggataagctttttgatgggctgctggatttggtttgccagtattttattgagaattttctcatccatgttcatcagggatattggcttgaaattttctttttttgttgtgtctctgccaggctttgctatcaggatgatgctggcatcataaaatgagttagggaggattccctctttttctgttgtttggaatcgtttcagaaggaatggtaccagctcccctttgtacctctggtagaattcggctgtgaatccttctggtcctggactttttttggttggtaggctattaattactgcctcaatttcagaacttgttactggtctattcagggattctacttcttcctggtttagttttaggagggtgtatgtgtccaggaatttatccatttcttctagattttttagtttatttgcatagaggtatttatagtattttctgatagtagtttgtatttctgtgggattggtgttgatatccccctaatcattttttactgtgtctatttgattcttctctcttttcttctttattaatctggctagaggtctatctattttgttgatctttcaaaaaaccagctcctgtattcagtgatgttttgaagagtttttcctgtctctatatccttcagttctgctctcatcttagttatttcttgtcttctgctagcttttgaatgtatttgctcttccttctctagttcttttaattttgatgttagggtgtcaattttagatctttcctgctttctcttgtgggcatttagtgctataaatttccctctacacactgctttaaatgtgtcctggagattctggtatgttgtgtctttgttctcgttggtttcaaagaacatctttatttctgccttaatttcgttatttacccagtagtcattcgggagcaggttgttccgtttccatgtacttatgtggttttgagtgagtttcttaatcctgagttctaatttgattgcactgtggtctgagagactattatgatttccattcttttgcatttgctgaggagtgttttacttccagttatgtggtcaattttagtgtatgtgtgatgtggtgctgagaggaatgtatattctgttgatttggggtggagagttctgtagatatcatttaggtctgtttggtccagagctgagttcaagtcctagatatttttgttaattttctgtctaattgatctgtctgatattaaagtttcctactattgtttgggagtctaagtctctttgtaggtctctaagaactcgctttatgaatcagggtgctcctgtattgggtgcatatatatttaggatagttacctcttcttgttgcattgatccctttaccattagtaatgtccttctttgtttctttttaactttgttggtttaaagcctgttttatcgagtgcaacccttgcttttgttgctttccgtttggttggtaaatattcctccatccctttattttgagtgtatgtgtgtctttgcacatgagatgggtctccttaatacagcacactgatgggtcttgactctgtccaatttgccagtctgtgtcttttaattggggcatttgacctatttacattttaggttattgtattgttaggtgtgaattcgatcgtgttattatgatgctagctggttattttgcccattagttgatgcagtttcttcatagcgttgatggtctttacaatttggtatgtttttactgtggctggtactggttgttcctttccatgtttagtgcttccttcaggagctcttgtaaggcaggcctggtggtgacagtgtctctcagcatttgcttgtctctaaaggattttatttctccttcccttatgaagcttagtttagctggatatgaaattctgggttgaaaatactttccttcgagaatgttgaatattggcctccactctcttctggcttgtagggtttctgctgagagatctgcttttagtctgatgggcttctctttgtgggtaacctgagtcttctctctggctgcccttagcattttttccttcatttcagccttggtgactctgaggattatgtgtcttggggttgctcttcttgaggagtatctttgtggtggtctctgtatttcctgaatttgaatgttgtcctgccttgctaggttggggaagttctcctggatgatatcctgaagagtgttttccaacttggttctattctccccgtcactttcaggtacatcagtcaaatatagattttgtcttttctcacagtcccgtatttcttggaggctttatttgcttcttttcactcttttttctctaatcttatcttcttgttttatttcattgagttgatcttcaatctctgatgtcctttcttccccttgatcgattcagctattgatacttgtgtatggttcacaaagttcttgtgctatgtttgtcagctccattagttcatttatattcttctccaaactggttattctagttagcagttcatctaaccttttttcaaggttcttagctttattgcattgggttaaaacacgctcctttagctcagaggagtttgttattacccactttctgaagcctacctctgtcaattcgtcaaactcattctccgtctggttttgttcccctgctggcgaggagttgtgatcctttgggagagaagaggtgttctggtttttgtaattttcagcctttttgcgctggtttctccccatcttcatggatttacctacctttggtctttgatgttggtgaccttcggatggggtctctgagtggacatcctttttgttgatgttgatgctgttcctttctgtttgttagttttctttctaacaggcgcttctgctgcaggtctgctggagtttgctggaggtccagtctagaccctgtttgcctgggtatcacgagcagaggctgcacaacagcaaagattgctgcctgttccttcgtctggaagcttcatcccagagggtcacccaccagatgccagccagaattatcctgtatgagtttccgtcggtccccactgagaggtgtctcccagtcaggatacatggggttcagggacccacttgaggaggcagtctgtcccttatcagggcttgaacactgtgctgggagatccgctgctctctttagagctgtcaggcagggatgtttaagttctgctgaagctgcgcccacagccgcccctttcccccgttgctctgtcccagggagatgggggttttatctctaagtccctgacttggggctgctgcctttctttcagaaatgccctgcccagagaggaggaatctagagaaggagtctggccaccagcggcctttggcctggccttgctgagctacagtgggctctgcccatttcaaccttcccgatggctttgtttacactgtgagggtaaaaccacctactcaagcctcagcaaaggcgattctcccacccccacctagcttaagcgtcccaggtcgacttcacactgctacgctggcagcgagaatttcaagccagtggatcttagcttgctgggcaccgtggaggtgggacctgccgagccagaccacttggctccctggcttcagccccctttccaggggagtgaacggttctgtctccctggcattccaggtgccactggggtatgaaaaataaactgctgcagctagctcggtgtctgcccaaacggctgcccagttttgtgcttgaaacccaggccctggtggcctaggcaccggcgggaatctcctggtcttccggttgcaaacactgtggtaaaagcacagtatctgggccagagtgcactgttcctcccggtacagtctctcatggcttcacttggctgggggagggaaatccctttaccccttgcgcttcctgggcaaggcgatgccctacccagctttagccctccgtgggctgcaccaactgtccaaccagtcccagtgagatgaaccgggtacctcagttggaagtgtagaaatcacctgccttccgtgttgatctcgctgggagctgcagatgggagctgttcctatttggccatcttgccagcaaatcctgtctgctgcctttttgttctctcccctgttgtgataagaaggggtactttattatgtttttgttttttttttttttttttttttttggtagaaaggttaatttccactggattctgaattgggcagaaaatggaaacattaacactttttgcataacgccattttacatcccctgcagcagtgtaaagatttgatcagttaattcccatgggaagcatgggaaaacaagggagccttatagacacgggtgttatttttaacaatgcttagaggatgtaacaatgactgataagcatcaaaggaagaccctgtttccttaagggtcaccatgatttatgtcatacttttattttatcattatttcttttaaaatattagttatcttttataggctccaagagtagagctgaaaaggaaggaaaatgtgatagaagtgtggcattgcagccactgttttaatgaggaaagcattgttttttggaaatactgtggtagaaactattttaaaatatcatgccttcccagccgtatacatctatatgctcttcacatacaggccattatatattaggagccttgactgaaatcaaggaaccaagaatgccttgacctcagtggccatcatgctaatgtaactggctgattggtttttttcttcagatagtggcactttaaaattcacgcaaaatataaagaatgaggttttatttatagtggtatattttaagagggtgtttaagaggtttttaaatttgtttcagatgtatattgagtgcccacttttcctaggactagttcctgtgtggtgtttaataccgtcactgatgtgacaaaccttccctcccctattcctgccacctcctctaacccagctgtgctcctcagtagctgcagttcttgggagtactacaggagatttcctgtcttgctggaccaatttagaagggatttcattgagttatgctgtcataagctgatcttaaagagggcatattttcagaaactcatatttaggttaaggtcctctctacattccacaaattgctccaaatttacctcttttcatcaccataaaaatctatatcccatgataggcaggcctaatctgggagatgtgggaggagggtgcaaacctgcaaatgagagtttcacttctgtttttagatacttgttcttaaggtgtggttggtgtgtcatcttggcgttacttcctcttctggggagtggaaaattcccagattagaaccaagcccccttgacaggttgttaccatgtgtggtgtttggatccatacctctgcacagcacctagatctattttataaccaagttacctatcaatgatgcattaccttagtgtggctgtaatagggctatcaatgctgggtgataaagcttgttctggagatcaaaggcaaaataaaaattagcccagtcaggtttgactttaaatccttatttaatggagtcacgtggttctgattgaatccttcctctctcaccctcatacccactctcacaattacagtataatgtgctggagaagtgattctccattgtggttttcctcaattcagggggtactcaacaatcttaagcaaggggttatgtgtgagggttaaaatcagttttcaatgaagtcagtatgaagctatggacattcttactggatatcagggtatcattacagtgaacactgaagtatactcatgaagtttataaaaattgcagttcagacacccatccttgcttctgtgagtggggtttcaatagaagatagaccgaagcatgtttaatatttcctctatgtgggtgagggttaggactctgtgtgaatattccaccagtgtaatagtaacaaagaaaataattctcaattctgataatcttggcttgaattctagttctgccagtaactataggattttagatgagttactttatttttccagtctataaattattcatgttcaaatggggatagtaatagaaccaacctcatggtggtattatagagattaagtttatgtaatacatataaaatgattagcttaaggtctgatacataattacttgatattagctagttgttattattattacacagacaatgaactagagctgtcaagggttaagaacacctctatggcagggtgacaaacattgttcagctggaacattatgtgcacttttcattatccatgtcagtgttcccctccgctggcccagataattgacggttctctatacttttattcagttttttaaaaaagtgttaacatcatctcattaaatttcacatctctatgcagttagtgtctgttagaaattgctgattagccctctgtatttccacgtctctaaagtggtatctcaagcctacactctaagtagggaagcgataagcagagaatagttgtcccataaagctgtttctcatccatccacacacctgacatcaaaaagccaaagataatgtttaaggttgactacaccttggtttgatccagtatctttatttaaatgtgatgatttaataaagttgcaaggaaaaaaagacaaaggactccactttaattataaacaaaaatctctccttctgaattattcttttttttttacttatttgatgggaagaattttattattgacctctttaaatatttggcatttggattctttatttatgtgtacagtaattacagatcagaccatttctgcatacttaaaataggagactcactttataagaatctaactctcaaagcggagactgtctcttagatgcatcctattccataggactgttgttttgtagactaggaaaagttttagagagaattacatgcctttgattcttcctatggagtcagcatgattgatttgtaagttacagtgtatttccacaatgtctacctgtcagtttcacagggcagataatattgatttttttaccacaaaatgtggcaaagtattaattttctgccattgtagtgttaacagaatatagaatacaaccgtagcagttaatgcatccaaacccagttagttagatagactactttgtaccattggcatcttcctttactaaatctttcttgtgaatgaatggagattgtttttattaaaattttttttgtttttctaatttcctcagttcagttttttcaagtagtaagtttaatatggtctatgtcttaaaaataactacattaactcttttatacaaaactatctatgtagagtgaatatatcgtttttagaaaattatttgtgcctttccagaaagagaaaattttggcttcctgttctcttgccaagtggtgactgtgtcttatacttactctaagtagtcattagcagtttatctcctaataagaataaaaaggtaattttccgctgctgtgtttttctttaacttagattgcattcattcttaaaggagcacaaaagcaaacacacagacctctcattctgattttaaataatttagagtggaactgtgaacacaatattttccccattgaagatcattttatactgaagtttaatataggtttttaaatttctatttaaaacttgggctcaggagggtgatggtaaagtgtgacattcacaagctgtttcctggtgatgaaaaatgcatgagaacataacccacacaggactagtcaggcgactttgaatgtaattttccattaaattttacttgatttaactcaacacatggtttgtatcttacaaatttcttgaagaaagaaataggtggtcctaagtgaatgtaatgcctaaagagctcatcattgtaatcatagtttaaattacgtggaaccaagttaaattcctaaaaaaaaaaacttacaccctctcctcccttcttctcctccgtttctttctatattaatttttgaaatatctttgtccttcatatacatatacatatatatgtgtatgtatgtgtgtgtgtatatatatatatatatagagagagagagagagagagaaagaaagaaagagaaagagtgtgtgtgtgtgttatgggctgaatggtgttcccttaaaattcatatgttgaagtcccagcccccagtacctcagaatgtaaccgtgtttgaaggtaaggtttttaaagaggtgactaaattaaaattaggtcattgggtgtgaccctaatataatatgactggtgtccttgcaagaagtgtagagacaccagggatcccatcaaccagagggaaggccatgtgaggacacaagagaaggtggccatctgcaagccaacgtgagaggactcaggagaaacaaaccctgccaaaaccttgatcttggacttctagcttccaaaactgtgaacaaataaatttttgttcttgaagccaccaagtatgtgatgttttgttatgacacctctagcaatccatacatatgtataaaataaacccttgttatttggttcggattttttctttaaacactgttaatttgttttctcatactgagtgctagcaaaatttgtgctgctagttttgttttcgcatactgagtgctaaatgggagcagattacttagatgactttaaggcaaaatatttaattgaaattcagtgtatggtcttgggcaaatcggtgtttctgggaggttttcatttttatatatttatattagagtaaatgatgccgacagtgttatgtagctctaggagctctgattttgtgagggcaagaattctatttttggtctatatttcattataaaattagtaatcgtggagcttgaggaggaattgaccccacattgaatgcttggttaggaaatgggttactattgtgtccagctgtgcagattgagtacttgactctgcaagttttcttgaagcacttactaattttccagcagttccctcaacatttgccacagtcattcttccattgaaggtgccactgtctagagataggctggattaatagttgagactctcagagatgaacttgtttcttctctttttattagcattaatgatgagtgagagtagttgcctgataatacctcctcagtctgcacagctttaggctaccttgtgctgtatacacctggaaagatctgactttagattttgcaaaaatctgtttagttccacacataaattaagttctttttcattacacagaatgaggaaacaacctcatggaagtttatgtgcagtgggttgacttcaaccattgagcctttaggatatttacaggtgaattgggtagtagaaaattttaataagtacctgttttctacaatctctgtggcattgattttaagcccttaacatttggacatatttagagacatatttgttattgtaaggattaacataataggttactattttatggaagagattagtatctaaagcacaaatgcttgttaataactgccaaatagtagaagttaggtggtttcctggcttgttcttgcatttaaaagtaatggatcaaatatttcaccatttaatatgaggtttgttacaggtttctatagaaataatattgaatttggaacctttcctttgttactaggttacataattttttgattttatttcagatacacagtatattgaattttaaaaattgtttttcaggatttttctcttatgtagtgaaatatattagtaatttttttgaggttgaaccatttttgaattcatgaaataaatctcatttggccatggtatattattcttgtagtacatttgcagaaattaatttttaaaatatttcttagaatttttgctcctacgtttgtgatacttggccttttgtttaattagttagttaattttggtaatggggttttgctagttaaaagcattttatatttttatgctatctgcttcatacaacttagtatatctgtttcttaaattttagtggaagtagcccttagaagattgtatttttaagattaattctttaaatttattctgtttattgtgtcttagtttttttgtattttgcctaagtcaatttgggtaattaattttttctagaaagtatgtactaaattttgaatattttggtataaagctgttcatagtgttccaggttaattaatgaaaacaaaaacattcgttcttaaactgagttatgttctctttgtatttccagtgtttatttagttctctttttaatgagactttccagataattatctattttaatggtctttacaaacagcatttggttttattaatcatgtttataatacttttgtcttatattttacagatatcttttattgtctttattaatctcttcctaccgtgttctttgttgcttcttttctagctgccattaaaagtctacgtcatactgctttattgttttctattatatgcatatatttaaattttcttttatgtattggtttggctgcatgccataggtcttaaatggtcatgctctcattgacacatatttatgaattttaagttttgatttttttaaacccatgttattaaactattcagctttaatttttttattaaaaaaaaccatttattgtgtatatttaagatacaaagattcagtatcccctatcggaaatgcttggtacggaggtattttggctttaagatttttttggattctggaatatacatgagatatcttaggaaggggaccccaagtctaaacattaaactcacttatgtttcatatatagcttatatgcatagcctgaatgtaattttatacaatattttaaataattttgtgcatctatcacatgaggtcaggtgtggaattttccacttgtggcatcatgctgatgttaaaaaagtttcagatttttggaacattttggttttaaggtttttggattagggattctaacctatatagcgtggtggtatgggatacatatagatagtaaaatgattactgtagtgaagcaaattaatatatctatcatctcatatagttacccattttttgttgttgtggcaagaacagctaaaatctactcatttagcaggaatcccaaatagagtacaatgttgttaattatagtcttaatttctaatttaattgcattgtgttcagaaaaagcaacttgaaatgtttttgcaggtttcaatattgagctcatctttgtgacctaatctatgattttttttggtgaattttagatgtgtgcttgaaagaatataaatatttgaatacatatattaattaagccgctgtttctagtatttgagccccatatatcccttaattattagttacttgcttgctctgtcgattagtagtgtatgcttgtctttcattatcacttctttctcactttattgctaccaacaattgtttgatacatttcaaaactatgttatttggcctttactagtttactagtttattagacttcttggtggatttttaacattcattttttatgggagatattaatttaatctatttattgttttgtaaattctgttttgtctgctatcaatactactataggtattattttaaaaaatgcttactgggctatattttccccttctttattttcagatttactcttttttaatctcttcttaatagcatattgctagattttctttgttttttttattttttaatctgagagcttttcctttaataggggaagttgattcgtgtatgtttattgtaatcattgatatgtttggatttaactttattctttttttttaaattatttatttttattgatcattcttgggtgtttctcgcagagggggatttggcagggtcataggacaatagtggatggaaggttagcagataaacaagtgaacaaaggtctctggtttcctaggcagaggaccctgcggccttccgcagtgtttgtgtccctgggtacttaagattagggagtggtgatgactcttaaggagcatgctgccttcaagcatctgtttaacaaagcacatcttgcactgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacttctctctatacagacacggcaaccatctgatttctcaatcttttccccacttttcccgcctttctattccacaaaaccgccattgtcatcatggcccgttctcaatgagctgttgggtagacctcccagacagggtcatggccgggcagaggggctcctcacttcccagtaggggcggccgggcagaagcgcccctcacctcccggatggggcggctggctgggccgggggctgacccccccacctccctcccggacggggcggctggccgggcagaggggctcctcacttcccagtaggggcggccgggcagaggcgcccctcacctcccggacggggcggctggccgggcagggggctgacccccccacctccctgccggacggggcggctggccgggcggggggctgacgcccccacctccctcccggacgggggctgacccccccacctccctcccggacggggcggctggccgggcagaggggctcctcaactttattcttattttataaaattttacttagcatgctttcttattgaatatgccttctcctctaacctctcactccttaccctcttcctctttcattgcattttttttccattcccctctccccaatttgtttgggatttgtataccttatttatatcaatttactgattaccttttaaaggttaagaaacatcctaaaacatatgcatttggagtttcaatctgtatctgcaatatattctgatttattcaagaaagctcagtgtgcttttatttctcctttcctactgttccttgccttttcccccatcactccaactacatcttatattgagataattttttgtctagatttttttctgtgggtaataaaattgttgtgtttccataattcacttgagggaccgtcttgagtatagtattaattatgcaaaattatttttccttttaattttgaaaatattgcttaactgtctttttgcaccgattacaatctatgacaatatgcttgctgaataatttttctatttagatgtaacctctccctgaagttttctgggagagttctgttcagccattgagcttattacttttttaacctctgaggttcaagcagttctcctgccttagcctcccgagtagctgggactacagacttgtgccaccacgcccagctaatttttgtatttttagtagagatggggtttcaccatgttggccaggatggtctcgatctcttgacctcgttatctgcctgcctctgcctcccaaagtgctgggattacaggtgtgagccaccgtgctcagcctatttaaagttatccttacctttgcagtgttaacttgccttccaaggttttagcttatctgcccactgaattttatccatctctttcaggatattgattttcctaaaatgatttgtgatttttggttgtatactcatatttgtacttgagaatcactgtcagcttattttattttctgtaaattttctctactgattgtgtgaaagggattacagcttgggggatggggagacattgctttttctctgggtattggctatttgagtccttgctctgctcagataccacactctaagctgtctcctgtgcagatgcctccacagcttgcttgggaggacactgcagtctcaactgtttatgtgttgattagtctcatgttcacctagaggttcttgcttcttttatttaatagtcttcccctacatggtcaggcttttctctgaagttttgattctgattaccttctttcagaattcttcaaaatttctgattagatattggcactcttttttgttttctgcttctaattctgatttattgtttttgaaaaataacttttaagtcatgatgggtattttgggcgggaagaaagtaagaaacatgtattcaactggccacataaaatcccaataaatagtgggagtcagaatcattgcccacatattgtgtgttttttgataagtgatacaggtgtatattcaaaagtagtgttcaagcccaacttgaagaatacaagttctaaacttctgaagttggttatttataaagtaccacaaatattagcaactttttatgaattatatgtatatttatattggaataaatctctttaataagatatttttcattccttatataattatcattttctaatatgctttggtattacccttttatataatagcaacagtataataatagatcatgtcttattgaaatagaaggtgaatgcttctccaccatggaggacaacactccccttttcttgttccatagttaaagttggggtgggagttgagtacaataagattgatgaggtcactctctcttagcattttttttggtcctgttgggaagtgacctgtcttaagagttgttttgtggcagctataccttaaggattgatttatgtatatataagagagttccattttgtattagtgatagctgagtgatacatcttctgattatctgtttgaattatcactaaaaggtatcagaagagtacctttatataactgaatattataccatcatgatttacaatgggatacagtaaatattttcagctttgtcagccatatgatctgtattggaactacagctgtgttgtagtttgaaaaccatgaaacaatatgcaggtgaatgaccacgactgtgtttcagtaaaactttatgaacactaaaatttgattttcatattattttcacatatcatgaaactttattcttgttttgctttgcttccttcaaccattagaaaaggtaaaaactattctaaacttatgggatatacaaaaacaggtggtgggctggatttgacccatgggccacagtttgccagctcctaatttagaagatggtataataacatgtaaagtgttcataattgattgaataaaaaaagggaggggcaggtttaaaaacagtagatatagtgcaatttcatttatgtaagaaagcaatcatcagcttacagatagcactggaagaacagctatcaaaatattaacagtggtttcctggttagcttatgggaataatttcgttctacattgtgtttatttgcatttttttttagttttgtatcctgtttattatgttgttttgaaaaataaacatgtatgccagaaaaaacagttatttaaaaagtgacagagaatctgtacatttttagcaaaatcagggtatttgttgttaattaatttgatacaatctgttttgtttaccctgtgcttcatttttagccaacaagtcccaaatttggaaaagctgactcatatgaaaagctggaaaaactaggggaaggatcttatgctacagtatacaaagggaaaagcaagtaagttcattatttttggaatatttcacatgtacagtgtatctgccctcttattactaaatagcattttatttaaataattattatttaatatacaatagattttcctccctcacggtatccttttttttttttttttttggcaagtgtgtaaaactcattggaattggtgtaccctgctagtaaacagtttttcagactgttcaatttatttttctgtttaatgcgcctccccacaacactgctttctctttcaaaggagttggaaccgtctaatgagaattcatttccaggtgaattatgtgattaatttctcatagagatttagtgttgggaataggagtattgatttgacaatgccaaatatattggccattcttggggtctttttaagttaagcttttactccatctttcagaagtctcttagttaaacaaaatggcaaacttttctttttctttcttcctgtctgctttggcatcatgctgcatatattttcatatcgagaaacaactgtctcctccttttcttctttctctccattgctctctgggggtcagggcacagatttggattcttgaaaagcttgtcctcatgtgtttctgattgacctccttactctcccttattaattaaggacagagagttactgtatttagtgacatgtagttgtagataacttaatgcaatctctgcaacaaccacagaagtcacaagctttgttttacctttataactttaccaaatgatgttgcaaaataattttctatactgtccctgttatctcttttcaaaatctttatagaagataggacttttttgtctgagacagcatttcgccctgttgcccaggctggagtacagtggcttgataacggctcattgcagcctcaacctcctgggctcaaacagtcctcttgccttagcctcctgagtaactgggactacaagcccatgccatcatgtctggctattttttttaaaaaactcttttgcagaaacggaattttcctgtattgcccaggctggttttaaactcctgggcttaagtgatcctctggcctcggccacccaaagtgttgggattacaggcatgaaccactgcacccagccagattagaatattgtaacttaagtaattaaataagaagatgtagaagagaaaaattctctgaaggatcattccaaagacatagttggaaattttgattatgtgctaatttaggtaatcttaggattttcaggagtgtggtcttatatctgtttgttcatgtttcttaagtttagaagatgaaatattccttatcaagaaagatatgtaaggcaaaaatactgtgaagtcaaaagtaatagtattaattttgagagttgtaaaaaaaagtttgtaaaaatggtgcagggagccctcttcattccacacccgggcagatctccaggcctttggagcacccgcttgcctcgttctatatcttgagctgccccaccccttctgtccagagatcctggtatagcagagccttcttcactccatgcccagtcagatctccaagcattcaaagcacctgctcacctcatctggattggcaacctcagttgccccacccttcctttgcagacatccaggtgcaggaggggccctttctgctttacatccaggcagatctccaggcagttagagcacctgctcactttgttcagcatcctgagtcactcactcttcctgtgcagagaccatggtgcagctaggcctctgctccacacccaggcagatctccaggcatttggagcaccagttcacctggaatggcagcttaagctgcctcaccctttctacacaaaaactctggtgtagcaggttcctctctcctccatgccccagcaaatctccagggatctggagcacttacactcctggattaggagtttaggctgcctccacttcctctgcagagacttggggctaaggatgtttcccagcttcatgtttaggcacactctgggtgcttggtggctttctactggattctccatcagtgctggtgcttgtgcctgctatcaggggatgaccatcttgcctcatgcccccaggactgagaagggaactcagaacactatgggctccacagatcagcccattgcctaaggcaacagagagcatctccccataaataaggatcaagtatatatccagacacattggctgcagtaggttcttactgataagtgccatctactggctgtaggtcaaaccaaacagccgtatgtaaaagctgctgatagaaatgcatagggctatagaagcaaagccaaaagatcctacccagcattctctgcagttgcaacacagagggagtggggagaagggaaggggaaagaaaacacacacacacacacacacacacacacacacacacacacacacacaccaataatattacagagaaagaaaaagaaaaaatgcaatctgtacaaaaataattacaaaaattatagtgccaacatctccagatgagaaggaaccagcaaaagaattttgttattgtgaaaaatctgaatgtcttggcaccgctgaaggatcacactaactctccagcaataattcctgaccaaaatggaaactcagaaatgacagataaataattgaaagcatggattacaaggaagcttagtgagatccaagacatgattcaaaatctacacaaagaaacttctaaatcaatccaggaaatgaagaaggagatataacatcttaaaaggaaatcagtcagcgtttctagaattgaaaagctcacttaaggaatttcaatacaattgaggccggacgtggtggctcacacttgtaatcccagcactttgggaggccaaggcgagcggatcatctgaggtcaggagtttgaaaccagcctggccaatatgatgaaaccccatctctactaaaaacagaaaaattagctaggtgtggtggcacatgcctgtaatctcagctactccagaggctgaggcatgagaatagcttgaacctgcgaggcggaggttgcagtgagctgagatcacaccactgcactccagcctgggcaacagagcgagactgtctccaaaaaaaaagaaaaaaaaagaaaagaagaaaacagttgaaagcttcaatatcttagaccaagtggaagaaataatttcagagcttgaagaccaatcttcttaacccagacaaaaataatatttttttaaatgaacaaaatctttgagaaatatgggataatgtaaagtgatcaaaccttcaaattattggcattcctaagtgagacagagaaaaggtaaacaacctggaaaacatatttgagggaataatcccagaaaaatcccctaaccttgctagagaggtgaatatccagattcaaaaaatctggagaacatctgggagatactatataaaatgaacaccaccaagacttactcaccaggatgtctaaggtcaatgctaaagaaaaaatgttagaaagaaaaaagcaagatcacatataaagggaacaccattaagctaacagcagatttctcagaagaaaccttacaagccaggagagtttgggggcctgttttcaccattcttaaaataaatctcggccaagaatttcatatcccaccaagataagcctcatacgcaaaggagtaataaaatgttttccagacaagcaagtgctgagggaatttcttaccactagatcagccttacaagagatccttaagggtgttctaaacatggaaatgtaagaacaatacccactaccacaaaaacacacataagtacatggcccacagattctgtaaaggcactatacaatagaaactataatgcaaccaagtaacaacttcatgataggctcaaaatgctatatatcaatattaactttgaatataaactgactaaacctcacacttttaaagggcatagaattgtaagttggattaaggaaagaaaaacaagacctatctctctgctgttttcaggagacccatctcacatgtgattacacaagtaggctcaaagtaaagggttggagaaagatctatcactcaaatggaaaacaaacaagagcaggggtcactatttttatatcagataaaacagactttaagccaacaacaataaaaaaggagaaagaagggcgttacataatgataaagtgttcaattcaacaagaagacttaactatcctaaatatatatgcatgcaacattggaacaaccagattcctgaaacaattacttgtagacctacaaaaggacttagccacacaataatagtgggggcttccacaacgcactgacagcattagacagatcatcaaggcagaagaccaacaaggaaattctggacttaaattctacccctgaccaactagacctaataggcatctacaggatattccactcatcaaccacagaatatacattcttctcatttgcatttaggacagatgaccacatgctcagtcataaagcaagtctcagtaaattaaaaaaaaaaatcaaagtcataccatccatactcttagaccacagtggaataaaaataagaatcaataccaagaggatttccccaaactttgcaattacatggaaattaaacaacttcctcctgaataacttttgattaaacaattaaagcagaagtcaaaaaattcttagacataaatgaaaacagagacaaatcataccaaaatccttgggatacaggaaaaacagtgttaagaggaaagtttacagcactaaatggctacctaaaaaaattagaaagatcttaaattaactaacatcactcctagaggaactagaaaaacaagaacaacctaaccccaaagccagaagaagaaaaaacataactaaaatcaatgcagaactgactggaattgagacctaaaaatatattaaaaataaatgaaatcaaaagttggttctttgaaaggataaagatcaatagaacactaattaaaggaagagagaagatccaagttaacacaatcagaaatgacaaaggtgacattacagctgatcccatggagatagaaaagattgtcagagactattaggaacaactctatgtatacaaagtagaaaatctagaggaaattggtaaatttctggaacacataacctcccaatattgcatcaggaagaaatggaaactctgaacagaccaatatcaagttccacaattgaattaataataaaaacctaccaatcaaaaaaagcccaggactagattgtctcatagccaagttctaccagaagtgcagagaagagatggtatcaattctactgaaactattgcaaaaaattgaggaagatggacaccgccttatcatcgaggatgatgaagccagcatcatcctgatatgaacaactaggaaagaaacaatgaaaacagaaaactaaaagccaatatgcctgatgaacaaaaatcctaaacaaaataccagcaaaccaaatccagcagcacatcaaaaagatcattcaccacaatcaagtaggcttcattcctgggatgcaaggttggttcagaattcacaaatcgatacatgtgcttcaccacataacagaattaagaacaaaaaccatttgatcatctcagtcgatttgcaaaaaggctttgataaaatccaacatcccttcatgataaagaccctcagtaagctaggcattgaaggaacatagttcaaaataataagagccacctatgacaaacccacagctaacatcatactgaactgacaacagctggaagcattcctctacagaactggaaaaagacaaggatacccactctcgccgctcctattaaaacatagtaccagaagtcctggccagagcaatcaggcaagagaaagaaataaaaggcatccaaataagaaatcaagtgaaattatccatctttgctgacaatatgattctatacagagtctaaagagtccgccaaaaagctcctggaattgatgaatgacttcagtacagtttcagaatataaaatcaatgtataaaatccagcattatttctatacaccagcagcattcaagctgagaattaaatcaagaatgcaatttcatttacaatagccacaaaaaattaaaaggcctaggaaaatgtctaaccaaggaggttaaagatctctgcaaggagtactacaaaacattgctgaaagaaatcatagatgacacaaacaaatggaaaaacatttcgtgcttttggattggaagaatcaatattgttaaaatggccatgctgcccaatgcaatctattgatgcagtgctattcctatcaaactgccaatgttgtttttcacagaattagaaaaacatattctaacattcatatggaatcaaagaagagcttgaatatccaaagcattcctaagggaaaagaaccaagacagaggcgtcacactacctgaattcaaactatattataaggctacagtaactgaaacagcatgatactagtacaaaaatagacacatagaccaaaggaacagaatagagaacccagaaataaagccacacacctacagccacctgatctttgacaaagttaacaaaaataagtgatggggaaaggactccctatttaataaatgtttcttgtatagatggctgtccatatgcaggagaatgaaagtggatccctccctttcaccatatataaaaattaactcaagatggattgaagatttaaacgtaagacctcgaaactctaagaatcctagaagaaaatttaggaaacatcgtctgagcatcggcctttggaaacgatttatgactaagttcacaaaagcaattgcaacaaaagccaaaattgataagtgggacctaattgaagagtttctgcacagcaaaataaactatcaacagagtaaacagaatgggagaaaatattcagaaactgtgtatctgacaaagatctgatatctagaatctctgaggaacttacacaatttaacgagcaataaccaaataactccataaaaagtgagcaaaatacatgaacagaaacagacacttctcaaaagaagacattcaagcggccaacaaacatgaagaaatgctccactcactaatcatcagaaaaatacaaatcaaaaccgtaatgagataccatctcaaatcagttagaatggctattattaaaagtcaaaaacaggtgctgggaaggctgtgtagaaaagggaacgcttatacactgctggtgagaatgtaaattagttcagccactgtggaaatcagtttggagatttctcaaagaacttaaaacaggaactgtcattcatcccagcagtctcattactgggtatatatccaaaagaaacgaaattgttctaccaaaaagacacatgcagttttatgttaattacagcactattcacgatagcaaagctgtggagtcaacctacatgcccatcagtagtgaattggattaaaaaaatgtggtacatatacaccacagaatattgcacagccattaaaaagaatgaaatcgtgttctttgcagcatcatggatgcagctggaggccattatcctaagtgaattaacacaggaacagaaaaccaaatattgcatgttttcacttgtaagtgggagctaagcattgggtacacttggacataagttgggaacaatagacactggagactgctgagtggggttgctaaggaagggggaaaagggttgaaaaacctttgggtactatacttactacctgcatgacaggatcattcatatcccatacctcagaatcatgcaatatactaatatgataaacctgtacatgtagccccgtaatctaaaatgaaagttgaaattacttaaaaagtatttttttaagaaaatttgaatgaatagtcagcatgataagggataaaaaacaaaatccagaggactgttaataaccatattgcttgagaattttggaatgtcaaagtaatggtctaaatgattgagttaattttaataggggttgtgccccatattttaattttctttcctaaagaaaaatagcagtactttaccatataaaaattacttgtactaaatttagtgtcaataacatgataactaccctttattaagcaattattttgtgtacaatatagtacatccctttgtctcatttactcctcacaatgccgtatgaggtgggtcccattattgtcatcttcatttaacagtcaggaatcttagggcttagagaggtttagcatcttgcctatgttcacacaggtagttagtggcaaagtttgtttagctcattcccatctggtggcttgaagctatcattttcctaatcagtacaccattactgcttccatagtgcaagaccttggaaagatgtgatcctctctgaatattccaaatagttctcacatatactctgacttgttttaattatgactcaaatagaagcaaacactatttctttataagaaaacgaaccacttggaagttcctatccattgaagatgtgctcagctgatctccagatgtgttaataactctattaaatttttatcttgaagatttatttcaaaatcttggagatagttgaagaatttttcatttattatgcctgaataaaagaaagactttaaaagtacctataatctttgagaaagattgttctggacggttaatagttttcactctagtaggtattaatttatcttgttagcatttcttgagcagtttcaagcctcctggtcacatgtagtacttcctttcctccaggtggagaggaaagccattgcctagttacctgctttaagagatgacaggctccctggctttgcttgctttaaggtggctaagtcaggctgaagaataacagctacatgtcatatagcaggacttgagagctaagtttggtgtgtccctatagtgctatataatttaaatagccaactaattgttgggatccctgttccaatactcctcaccattctctcataaatgtctgcatcccacctgccatctttaaacataatcttttgcatcctccccagaaacagctctcattatcttgcagtgaagctgtctggcatttgtagagatacttgtgattttcagtttgtgagcattttacacatatgtgttggtttacaggtgtcatgtttggattttaccataagcttcattgtattagtttgctagggcttgaaataacaatgtcccacaatctgggtggcttaagctacatgtactttctcagttctagaggctagaagtctgaaatcaaggtgtctgcagggtaggttccttctgaggattgttagggagaatctgttccatgcctctgtcctagcttctggtggtgtgctggcaattttgggcattcctggcttgcaggtgcatcacccctcttgttgccttctccacatggcattcttccagtgtgtgtgtgtgtgtgtgtgtgtgtgtgtgtgtgtgtgtgtctgtgtgtgtctgtgtccaagttttccctttctgtcaggacatgagttatatttgattaaggtccaccctaatgatctcattttgatttgattgcctccataaatgactcatttcaaaaaaaaatgcattctgaggtgcttggggttagaacttcaacatatctttttgaacagttcaatccataacacttactagtgtcaaacctcactaacttggcattgcattcatgacagtgttgttctttttctgcctgtaatacgtgtcattcatcctttacctattggttctttttaaagtacaaacaaaggatatttatttgccccatcaagagatttgtgtaattcttttttttttttttgtttgagacagggtctcactctgtcgcccaggctggagtgcggtggtgcatgcagtcttggctcactgcaacctctgccgctgaggcttaaccgattctcatgcctcagcacccccgagtagctgggactacaggcacgtgccaccacacccagctaattttcatatttttttgtagagacggggttttgccatgttgcccagactggtctcgaactcctgaactaaagtgatccacccacctcggcttcccaaaatgttgggattacagacatgagcaaccatgcccagtgggtgtgtgtaattcttgattgtggagtagttgctattaggcatagtttagaagcttgaggaggaatagaaagtgtttttaattattcttgattcttttggatctcttatccatgtaggaacacatacactggagagaagttaactgagattcctatacaggtagtctgctttgtagtgagcttggcttctaacaaatggctggttaaccctgttcacatcaacatacaaaactcacaaatatgcttttaagaaaaagctttgaacttaccacattctcatatttgagtagaaagtttttgttttttgatcagtgttctccagatttcttctctgtctctctctctgtctttgtctttcactgtctctttgtctctctctctctctctctgtttttatgtttagatggggggtggcagttatcattacttctgactgctgactgctgatctctcttctggtttggttttctgattatgttctctcttctaaattcctgtagcatttaatataggattaaaaaattatgcatcgtataatactttggaaaattaaaatatatggcattttaaaatgtctttaattcagcaccttgaaatcatctttttacctctcagtttaccaaggacttctgtatattcagagatgtgttaatattttttgaacttattcaactagtgatgaatattcattgtattgtttataattatgccttttttatgctgtcggtgaaaaagaggtgactcagatgaggattctgccctcgggaaacttaatcttgaagggagatggtacaaatacataagtaattctatataaatgaagatgtatcaatactatattctatataagctagaacgtagtgagaaaggcccaggtacacagtggctcgtgcctgctatcccagcactttgcaagggcaaggcgggtggatcacctgaggccaggagttcgagaccagcctggccaacatggtgaaagcctgtccctcttaaaaatagaaaaatcagctgggtgtggtggcatgcacttacaatcccagctactcggaaggctgaggcacgagagtcactcaaacccgggaggcagaggttgcagtgagtcgagattgcactattgcactccagcctgggtgacagagcgagactctgtctaaaaaaaaaaaaaaaaatcgtaaaacaaaaacatccaggtaaaatggtgtggggtttcaaagggaatgaagagaggatgatgttgactaaagtattttaaatgttttctctccagtggccactgattgagtttagaagccacatctttgtgtgcttttaaatcaagcttccctcatcactatgtgtctttgtggaatccttggcactgttcccttttggggcttactccttccccccaagcaaatataatgagatattcactcattggttatcagactctccactaaatttgttgaactttgagggccttaagctaaaagtaaacagattcactttgattattgtggtagttttggttaagcaaaagtgttttgtttgagtattgaagtggaattggctttaagcaatatgatctgggaggattggtggtttgcttatgcaagggcacccatgaatacctggttgttgaaaataagagctactacctctcacaacctcaagacccaaagttgagacatagtgggacccatattctcctcaatgtactttgatctgctggtagatcacacctgagtcccccaggttctgcaccctacctcaagtagtgagtgggtatgagtctttgctctccctggggcagggtcctctcctttctttcctactgaatctagggggtatgtgagtctatagctgcttttgattttctcagacttcacatgccatttagaggaaaaacagcttgctctttgttctgcttctagaattggagtattcagactaagttgtcccacagatgatcctgatctctggtcactttctctgcttatgttcagtttctgttgaggtgaagatgccaaagcattacttctgcaggagcctgccaaagaaaagcctgcccacactggtttgtgccagccataaattgttatctcagaggtcaatgagaacaatgaaggaatttgctcactttatgtgacatgagatttatgtgattgaaagtgccaatcttcttttagcatttcatcctgccaatttgtgcagaataattgaacttgaattaaacgaccttataaattgagagactacaccaaaccaagactgaaatatactaaatacagttcaaagagctcttcaaaaccccaggagaaataggggggaagaaatgctattaattaaaacaagcagcagcgcaagaagaaaggcagcagcagttaaccaccttttcacaatatgtgagattaaagatgcagttcttactgcttgcactaaaggtcaagttcattgaaacactatcaggaggagtttgaagaattctagaagtcagtaatccccagatggaaaacactggattcctggttcattgaagctgcaatcttaagtgttgacacctagactgtcatgtggacttcagagtcctgagaggttacctgcccacaaatgggagctttctacaaagagacactagtctgattacattttacaagctctgctgtaggatgctcccgaggcccatgctgtttctccttaggtctgctctgacttcttttagactttgggctcttggaccaaagcttattattacagctcacttcaaagatcaagcctgtaactgcactatttaatcaatgaaaataacatcacagtataatacaatcagtgttagttttataatttaatgaacaaaatacagcattacaatgtataacaggataaactgagggaagaaaagctaacagagtaaatgcagttcacaatatgggattttccgatctgtgttccttcagatctgtgtataggtgaaagtttgaaaagtagggttcctatccttagctagtccaaggaggataatagcccacccaccaacatctgctaattttattttatttttaaaccctaaatcctactcaaattgcagattcagccctgacgtcctttagaggaagaatgcagacattagagtctggttcattggtacagctggtttcatttagcttgcagcagataaacaaacaatgcttaatctttttgatgaaagtgacagtgaggatattgtttaagcaagaagatgattttaattattagactaaattgtactggaataactttcctattagacagtgtttaaacgtattggcctctcttagccatgtttattatcaggttctttgatcatttggacaggagacgctcaatacaatcagtgatatttgctgttgttaaaattgtggtcatatgtcagctatgcccatctggtggaaatggaggcactctttggggtttttttttttttaaagagttagtgtagaaatgttcaattactgaaataattgaaagtcattatgtgaggactcctaaaacccctctcccaaagtggtttttgaggaggacttggggaaggatataattgacttcaggttaaagcatacccatgttcctgagctgctttattgttactgtcatccttttgtttaaaccaggatggtagggaaggagcatttctagtctaaaccagtggttctcaactagggataattttgtttgccaggatatatttgttggtgtctggagacatttttggctttcacaacttgaggagtggtggtgtcactggcatgtagtgggtagaggccagagatgctgcggaatatcctatgaatgaacaggacagtctcctgcaacaaagaattatttggcccaaaatgacattagtgctgagattgagaaaccctggtcttaagaaatgcatggaggcagtgtctgtttaagatagtgcattccttttgaggttgtagtaactctctactgtgttctgtgggctgagtgggccaggcaataggtgtgtagtggtgaacaaaattgacaggtcccctgtttttattaagcatattatccagtgagggaggcagaaattaatcaagtcagcagacagaatctgtaattgtaaattatgtaaaggaaaagagagctgaggaagaattaagaccgagagtagtgggttatgtatatttgcataagagaggggtatagatagtaaatatacattggatggatggaaatggaagccttgttgaggagaggacatttatgcataggtctgaaggaggagatgtcaccaggcaggtaaagagcaggcacaagagtgtttcatgccaggccctgaggtgagaaagagcttggtgtgttttataccaaatgaaggagctaattttattttattttttgaggtatggtaggactcatagttttctcattgtactgggatctgctggtgggtcacatctgagtccctccagggtttggcaccctccctcaagttgtaagtaggtgtgaatttttgctctctctgggatagggtcctctcctttcctcctactgaatcaagggggtatgtgaaaagtgagagagcacaaaaacaatgaacagataagttacaaacgtgacagatattaatacagacatatcaaaatcacttaaaatgtaattggtctaaagataccaattaaaagacagagattgtcagggtggataaaaaaacaagacccaactatattttatctatgaactatcctttaaatacaaaggtgcagattgaaagcaaaaagatagagaaatatatgccatgttaacgcaaattaaaagatagctggaaggcccggtgtggtggctcacccttataatcctagcactttgggaggctgaggcgggcagattacttgagatcaggagtttgagaccagcctgggcaacagggggaaaccctgtctctaacaaaaaacacaaaaattagccaggcatggtggcacatgtacctgtaatcccagctactcaagaggctgaggcagaagaattgcttgaacccggaggcagaggttgcagtgagtaccactgcactccagcctgggcaagagagtgagaccctgtcttaaaaaattaacatagctgcagtagccgtgttaatttcagacaaagcaagtacttctgatgattcagaagatcatcaagattaaagagaggcattacatgatgataaagagcttagttctccaagaagacaaccaactttattgtatacacaccaaacaacagagtgtcaaaatacgtgaggcaaaaattgatagaactgaaaggtgaaatggacaaatccactatggtggttgtgacttcaacaccactttgtcggtaattgacagattaagcaggcagagatatcactaaggattcgatgatctgatcagtactgccaaagtaaacaaagtggaagctgccaatatttcaaggcctggacccagaactggcacagtgctcctttcacctactcttgatcaagtgttcaaagagaccagatccaagcgtaggggccatagaccacacctctcaatgaggagtgtcaatgaatttgggggccgtgttttaaaaccccgtatagagtttggtttttattctaggctgaattaaatctttggtctcatctttgtacacagttctctcagctatctgttctgaacatatatttgctgactcctttttgggttaatttcattagattttagatctctccttgagaacaataaagacacagggtggggaacatcacacactggggcctgtcgtggggtggggggatgggggagggatagcattaggagaaatacctaatgtgaacgatgagttaatgggtgcagcaaaccaacacagcacatgtatacatatgtaacaaacctgcatgttgtgcacatgtaccttagaacttaaagtatacatttaaaaaaaggttctgtttagtataaatggctttgtatagagggggcccttctgtcctagtgtacctggcacagttctggtttatgcttgtcattttcatgattattaatagtgctctttttactctgaatactgtcccatttggatgataaattatatgatcatattatataatttttatttttctggaacttggtaaaatattttgccaaaaaccgaaatttgattggaatatgttattgtgggatccaactgagtatttagagccattaatgtcagtgaatctgtgggagcatttttgaacagtttatgagtgctgttgaatctgtaatgcagatttgtgaattgattttaaaagtttcgtgggaggttaatgaactttatgtacagttcttagacagaaaggtctggcaattagacatgatttttgtgaaataggaactaatcaatctaaaattcaaatgacctactcaggtgccttactactcgtaacataaatgttaggcttagagtaattcaagatagctgaaatgctggaaatgtgaaagaattaacaaggtggggtttgggtgaaattaggtgctgttagagctcaaagctaacaggttgcggtgtcagtgagttttagtcaaatgctcccagtctatttagcactggctcatacaaaggaagtatactgtactactagtaggaattgtaacaatggagagatggcaggtaccttaaaaatctaggattgcaatttgcatagagtaattcagtgcaagattgtatggtagacactgttgatgttggggagatgatctgacagaaaggaaattattttaaagatttcaggcgtaagacttttttttatgcttaatggttgattcttgagcaaatatgttttcccttccttctagagttctgaggaaacagacataacatttgcctgtataaacaaattctttgaatttttaaaagatatctgtctctagttcagaagggtctctttgggattgctgtgtttttaactatctctgttttcagggacttaatgatcctagagatctgcaagcattgtctgagctgagggaaaattgtaaacatcaggcactttggttaatagttgaaagacctgttgtaacccaacagagaataaggtagaagtcattcctaattggcctgatgggtgagacaggagagtgaattctcatgcagcttagcagtcagcataggtattgaaagacaagcccctggggaagcaagagaggaaccaagggcttttgttgtatgtctcatcaaacctcttaggagaaagaagagggaaattgagatattgagaaaccaaacaagtagtgttacaaatgaggcctactgggagtcccaaaggaagccagattcctaatgagaaagcaatggtctaggttaaacagtgacttttttattaaaaaaagttattttttttttactacttgttcttgagaaagtttcatggctaagtgctggagagttgagggcacctggaactgtgcccaaagcagagcataaaggattattaaattaaaagaatgtgtatcatctcagtgaaacagaagggatgaaataacagaccaccaatatttagagctgggcaaagagagaagtgaagaacagaggagagattgtctagagaggtggcgagaaaaccagcaaagtaccaaggaagaaagagagtttcaaagagcatggacgatgatgtcagatattcagaaaagtcaaatcaatgaatcctgaaagtaatttattacattttacaactaggaaggttttttttttttttaagaatgttaagggactggtggggatggatactaattattttgtgttgaagagagaatgggggatgaaaaaatgtagggtaaaatacatataagctactctttttagcagtgaggcagggaaagaaaagagaactagaagaaaggggagaagtgttttgtgttgtttcagttttaaactaaatggggaataatcgagtatgtatatagactatgacaaaggagtcagtagaaagagaaaaagttattaaggaaacacttgaagtatattcttgatggagaaatctgaggagctctattttctctgtcacttgaactttatttcatatgctccatgtaattggtcttcctgtttctttttctaataatgtgtagatatgaaatagctctttttattgtcggcttcatctcatttaggatctagacgtataagaaaattatccttcttaaatatcttttatttttattcatgttcttttgaaattcaggtacatcatggaactctctgtgtagcacatttgtttttcttctttgctccattttcttcattgatactagttgtgattttttttaatgacatctctttttttgtgaattttcttccttgataccacttctctctttgtaatttagagttatgaaataaagctactatttattgaacactccatttttttcacctgtgaaaacagggttaataatagaattgatttcatacagctgtgaagaatgtatgtaagcaaatacatttagtgtttagaacattgtctcacataaatgttcaatgaatatcagctacttctttttcgtttcttataacaatcctagaagagatttgagataatacaatttcccttattttacgggtgaagaaactgagacccataaagtttgagtaatttgcctacaatcacacagctaagttccagggccagaattcagatccagttagtccaactccagagctgagttcttaacttttaccattttttgtaaaacttcaaaatctgctttcttgaaatctattcttaccctacccttctgtcatgccatgactatgccaattgtaaggtccagggtcaggtttgagccccagccgaggtccgaggggagtgggtagatgggcagatagctgaaagaacactcggggggccataggcaggggaatatggttttattcagcagctctctcatcaacagctctctcacactgtccgcctttatcttggttgtctgctccggctccacagctcctctcagcagccagctctgccgctctggctgctcccacacacagctgcacggccagctctcccttgcctgcagtgtcagcagcttaactccttccctctgggcatgagtgtgagccatgtcgagccatgtagtaccctggctcccctctgtccatctgcaagatggacaactccggtactctctttttctctaggtgcaatagccaagccatgccatgccatactgacccatgctaaaccaagccccccatgcacagtgtcagcagggcaattatacctttaacagacaataaataatggcttacagccaagtatgaacttacacaaacaggttatttaacaagtggagtatgtgcctgcatcctaaactcactgagtcatgcaggcctggatgtctgccttggcctatttcttgaccaaagcacatccatgtaccttataccttccttgttaataattaactgtagggtacatagccaatttcttgcataattctcttattttccctctgtatccatgctgttttttctctctagtcatttattattaatattctccactgttctagtcaattccacagtgaaatcatagctattttccccccttgtttcacctaagtgatttgtgagttttggtatagtaggtgcctgcatgaaatagagcgctcactgctcaccttccctttctatcagatagatttattttggacaaggttttctattcctttgctgccttctcatgtggacttcagcccaagatttgatgggctccatttctcttactacctttttattcattgccatataagcatatgacaaacataactcctgactcgccagcacctttcaacccttttattcttctcacaaataacataggaactaatattatagtaagaactatacctgaaaaaataaaattttttctaatacgtttttgagtaaatcagaatctgagccctcttgagcctccacctgaggtatatccccagctcttgctgtgaatgtagttaagttttcaaaattgagttggggagacattgattctctcaacctgttgtgtcctttgaaactcttgccaatttttcattatctttgttctcatgtttttagtcacttccttgtacattcatatctacgtaggtatatttatattgtttacacgtatttattcacataaactgtcagatacaactttcttaaattgctaatcactgttgtgatgattgatgtgacctagactaacttaccattgaccctctgttaaaaaagggctcgtttaattagtaagacctggagagaaccactgtatttaaggttatttcatccaataaacgtggttttgtagaggatgtttatagttgtaaatgtaattattgtagctggcgcagccagatctctatttagagataatattaggagacacttaatgatcagcatgtatagttatgtttctctttctacttttcaaaaacttttcctggatttatatatatttgtgcacatgtgtgtgagtgtgggtgtgtgtatattacaaagaaagttcagagaggtagcagcgattatttttgaaagttggagaaagcagagttggcaggatgaatgatggccctgtgtttacgtatgtcattggtaacagctgcactgaaaagttgggcgtctcagtttctcatctgccactttcttactgtacttcagagttggagccattccattatctgaaatgagtgaattgtcctcttttttcgaatatccgatataatttgtattttctttttagtcactcaaaattggtgatttttatagtataccgattggatgcatatttgacaactaagcaattgtgttctctcacttagattcaaaatctgtgagttcagctgactaattagtggtctggatttttaaaatcatggtaaaacgaagacaataaatgatatgtttcctttaaaaatttgtgtatttgaaaacaaagataaaatgaaaggtaatcctatgtattataagcagactaagttgcttatctaccatggacacaggacattacttttatagtgtcgatttttgatagtaatttttatatagctacattccaggcttttttgaacaaaagagttaatgttaagaggcaaatggtagacagttactaatcagtgattaaaacctttgtttgcagatattttacatacaaaaatttagacatttatattcaatttacctaatttacagatatgctactcttaaaacacttctttttataagctaatatattatacaagccaaagtcctatttattttctgggctagcatttgtatctaaggtgctattatggaaggatgactactgatttcccatctgtttcagttggagaagagtcatgccaattgtattcattgctcattttgggtgaaaactgagcacatatctaactgcttttgagtatatgttgcccctgaagctaggtagtttattcttctaacactcattttcaacttaagtgaaaagcatatcagaatgctttttattagtgactgtaaggattgacacacacacaaaggagaaacatttaggaaagctgacttctgtgatttctttctcttttctttctttttttttttgactgagccctcattctgtcacgcaggctggaatacattggcaccatctcagctcactgcaacctccgcctcctgggtttaagcgattctcctgcctcagcctcccgagtagctggaattacaggcatgtgccaccacacctagctaatttttgtatttttagtagagacggggttttgctatgttggccaggctggtcttggactcctgacctcaggcgatccatccaccttggcctcccaaagtgctgggattacaggcatgatcctctgcgcctggctgacttaggtgattgcttacttattttatgaatggtcctatgaacagagaaagctgatgtaatctgtcctttgtagttgtttgctgttttagtcctcatttgagatagttggacttcattcacttctgaagtgtttattgaagccaacttgtgtgaaaggcatctatccaaggaaaagccatataaacatgaattttcctcaaagtggccaaattcttttttctcacgtaaaaggaaattagatttttttattagatgctagatttggtagctgaggtttaacattactgaatcgcttcttggttaagaccttgccagttggccttactttgtagcactaaacgcagcaaagcagattgctctatagaaaagggatgctaatgtcctgtttgatggtgatgaacacacatgtaattgcttgtaaagccctgaaagtagcttagatgtttttaacaaattgtgtattcaggttttcaaataattacaatgaagatttgctaccagattttgtagtatgtatgtataactataatagtgaagtcttggtcttggaattctaactttttagtatacttatcttttaagtatattaacgttatagtctgttctgaggtttatgtagtggacttaaaaactcagttaattgacctttattgggtaggattaaaaatgtatttttaacttctttaggtgaacattgttgattgttagcttttacttcactggttcttaattatcttcattcaaagctctactttaaaaaatgtagtaatacaaacgtggattgatgtccagcaagatcaaatatcacattacttaactggattaattttgcagcagacccagcatccacatccctctggagtctgctgtctttccccatatccttactgcttcctttgtttctgctctccaggctttaaatgtgctttgctgcctcacttctgcaactttgttcatgatagaccccttcacgcttaagtgacttgtgtctccttttgacatgcctacaactgatcccatcttcaaggtttaactcaagccccatctataccaggaaacttttctgacttctgacaagactatctccatgaccaaactttgtcaggctcctccaggccctcttcttaagtaggcgtcacccttggcccccatccttgacagcgctgcacagaccagttttagcaagagtcttgcttagtcagtctagagagaatcccctcaccctgatgtctgatcaccctgcctgcctcagtaagaatcatgttatgtccgcttagcaagaattccttctagccttgatgtctcctgttagtaattttccatccaccaatcccccagcctgcttctgtctataagtcctcacttgttctttgtatcctgagttgaccctaatctttctttccccatgcaattgtcttgacacctatcacaatagtcttttttactatttaaacaaggatcggaataattttttctttaacacttcttgcatgattcagttactgccttgcttggtatctcttttagttcctcatatatatgaacttattcttcagtacctgttgaaatgttacagcttcttttctcccagagtttggcgagcaggagggagtgttacagctattttactctcacagtttggtgagttctgagttcttgtcttatgaccaaaaggaatgaggtacacagacactggagaatgagtaagtcagagtagaattttattgagcaacagaaggaaagctctcagcagcgagaggggacccaaaaatgggttgctggctgcaagcctgagtctggggtttttatgggcttagaatggtcaaatatgtgctgattggtttatggataggcttgagaagatcaccattcagaaagagagatgatagtgtaaagaaccaattgggggctgaagtgaaggcttggcctgggaccaatcaggagctgaagtgaagccttggcctgggaccaatcaggggccaagtgtactgaacgagaatggacattgtcactctggtcactggactccatctggaactgatagtttggtgttcagacttcaaaatgtccttggcttgaaggtcgagtttcactgggaacccgttcctgtctgcctaggaatttgtctgcctcctattgctatcaacagtactgtaaatagatgctcagttaataaatgttacctgtgtaatgattggaaaatgttttggaacattccaatcaggctaaggttgatgagacaagactaacagatggacttttgggatagagatttgttgtcaggacatggagggtcttcaactgaacatttggatatagtctctgtacctgggttcatagagtaacatctgctagcagaattctcctgaagatgatttgattggttgttttctgtcactgtaaatagagcactcccactgaactgaattccagccaggtaggttctgcctccatgtgcctgccaggcctctacactgctttctcactcagtcttctgttgcctagctagcaagattgctttcaccaataaatcaaaatgcaggagccatgaaacattatgaaagaaataagtgttgggatcattttccttacaaggaaggtgtgtgcttattggaacttgaggcttcctgggtgatatggtttggctgtgtgttcccacccaaatttaatgttgaattgtaactcccaatgtttggggagggaccttgtgggaggcgattggatcatgtaggcagatttccccgttgctgttctcatgatagtgagtgagtctcaggagatctggttgttttgaaagtgagtagcacttccccctttgctctctcttcctcttgctccaccaagtgaggaacgtgcttgcttccccttcgcccttctgccatgattgtaagtttcttgaggcctccccaaccgtgtttcctgaacagcctgtggaactgtgagtcaattaaacctcttttcttataaacaaccgagtttcagatatgtctttatagcatgcaagaacagactaatacactgggtttctacttaagcccatccactaaaaggatatattattaaaccacagcgaaatagatgaccaattattaaagttctgtagaatgttgttcttgggaaaaatttacatatgaaaaaaacctaggaaatagacacacatgttgaagaatttaactctgaatagtaagattactattggtgaaaaatttttctgtactgaccaagtattctgccataaacatgtatcaatcagtgttataattaggataggacttattaatgtcattctaaaatatattggtttattttgacgtttgtaaagaatgattagttgaaaacctccaagaataatgacactactttcagattaaataatttgatcatgagtgtcttgaaagaaaaaacagttataagcagagtacttttgatgaacaaaggagtagtataagagtgtggactacacacctttcttctgtggttcatgctttaattattgcaaccccacagataacttaggaagtctgaccacctagatccaaattgtgaacctgcctcttctagttgtgtgacttacaacaaattatttagctaccctgtgtctcagtttctttataaagtgaagacagtggtagtatctatcacacagaggtattagcgtgattaaatgagacaatgtaaataaagtccttggcccagggcctgccgcatagtggatacctgaacatcagtgctagttttgcttttactttatttttagagacagggtttcactctgtcacctattctagagtgcagtggcaaaattatagctcactacagccttgaactcttggactcaagtgatcctcctgcctcagcttcccaactagctgaaattaaaggtgtgagccacctcgcctggctctatttttgaattaaagactgttatcttgattttaaatttattgactgtgtataaaaccagttcattcaaaatcaggctgatttgtactctggcttgcttggtaggttttagaagtaacactggcataggtcttctcttctcttctctcctctggcataggtcttctcttccctcctctcctctcctctcctctcctctcctctcctctcctctcctctcctcttttctttcttttttttttttttttttgagatggagtcttgctctgttgcccaggttggagtgcagttgtgcgatcccagctcactgcaatatccatctcctgtgttcaaatgattctcctgccccagactccagagtagctggaattacaggcgcttgccaccatgcctggctaatttttgtatttttagtagagatggggtttcaccatgttagccaggctggtcacgaactcctgacctcaagtgatctgcctgccctggcctcccagagtgctgagattacaggtgtgagccactacgccaggccagcacaggtctttcttataccagttatatataacgcttagaatttgttctttttaaaatctatttagctcttcagttatatatgaagtaatataaaacctgatcttcaacatgtgtaggtagttctttttcaactttatatttaattgaataactttttaacttgataatggtcttgcctataagacagttcattttgagtgacacccttatttttagaacagacctttagattcaggtaatcagtgatgccatatagcattgttctctaatccttttttgtcataaaagccttaaagtaaataattttggcttttcttgatattatttttaatttcattttgaatatattcaatggtaacatttcctataagtatgcaagtaatacatttttattggggaaaataaaaatcactcataatcctcttgtcttaatatctctctattactttcaccaggctactgtgaaattttctttctttattctccaagggcctttgcaggcaaccagaaaaagaaaatactcgcttaaaattgtggttataacttaaacttcaggggtgtgtatgtgtgttttggtctctattagaatgggtggagaagagtctgaactctgaatacccctgccttaatgaccctcgagggctgttttaattgtttctcctgctgttctaagcttcacttaatttcatatgactatttttgaatgcgacatgcaaaatctctagttaatactatttggcaatgagtagtacttggggactcctcagagcctcatggtggtgaatcagtgatgtgatttttttggtgcatctcatttcactgctttggagatgcttttttcatgagagtggaaacttgacttttcttgtgtgatcctgggtgtgtatgcctctgttagagaaagagggggcatttatgactctgctcaagaaacagaaacagaatgctttaaacacatctttggaccaagaggcttgaaatgctgtaaagttgagcatctgatttatctgcttttctttaatcctagctcatgcaatgattcattctcatcgcgatgctgtatatggcttttaaaacagaagattaggaatgaatgggtttgactttgatttttagatacagtatgatatgtagtatgtaagaattagcaagagtttaataagtaatcaaagattgaggaaaagtgataatatcaagaagtatatccatttcttttctgcttttctaaaacagtttctgtgggaaaaaaaagctactacagataaaaatctatttgaaatggcaacttgacctcagaatgagaaaatttgatttctctagaaatgtgaaatacaggtttttcaaagacctcagtaatgtgtttctccagacaagtgtgcttgaaagtaggaccagagaaaaacgaaaatacctcctcctccccctcccccttcccctcccccttcccctccccctttctcctcctcctcttctcattttccttctcctcctcctctccttttccttctcctcctcctctcctctcctcctcttctccttctcctcttcctcctcctctttctcccccccacccttctcctacctggcttcctccttccccttttcttccttcttagtttttgttatttggtgtttgtttgccttcacagaattcctttcttcatagttttcagtgtatgtgggtattatatggtacatgtggcattatatggtacatgtgggtattatgtttatgtataaaaactcatagagaactaattaacatagtaggtttcaaatctcagtatgtgtgaaaaatcaatctgaaaaactcataaggatctacatttacttattttttatgaaactatcccatctcatcaaacacggcccttctctagtaatttcaagagtatgtgtaaacaactactttttacctctgtggatgacttggagatttttcctgtgctttgccttcttttgatgtgtttggagttcttccattcctggtccttgataactttgccttacttttgtttagaatttttccttctttcatcattcattttggttgcttggtactttcctgtcttctctgttagctggtaatctcctcaagggctgtatgcatgttatttcttgctccacctggaacaattccttgcatctaggaagtatttctcttcaaagtcctgagaagtatacaacccatagccctaaaactccagaaggttaatgtattaaaatggatgattaaagtctctcaaaaccgaacaatcaaacatcaaagcagataagcacaagtcatctcaatgagagaagtggaagaattagaaaccgagtgtgagctcggctttaaagttcacacacacaggggtcatggggatagaaaggtcacagaagaagtgcaagcactcacctcctgatatcattgtttccagggagagttagtttcaggcatgaaagtgcagaacaaatgtagatgtgaattaaattaacaaatgtcttaggacatttgatagtactttggttctctttggagttctgattgaagacttgagatgactgttgcacagaattttaaagaaatttggagttgaaactgtttcatcactgtccgtgatctttgaggatctatgaaaaattggagaggcattagcagtcttgagatgtccaaacctttacagaagacgataaatctatgaaccagaaccgaaggaaatggtgtgacattccccttgcacgctcttcttgttcccccttctctaatgaaaatactgttccgatggtttctcaacaattagaaagcaaaatagtgacacgaagttagttaaaaaaaaaaaaaaagtcatacttaaataaccttaattccttgtttggatcagatttttaagctagtagacttgcagaacactgtagctattatatatctgcttattttaaaaatgttgctaaatgttcccagttatgttctggtagataagaggatcataggcagttggatgatgtgctgttgctggtggtggatctaaaacaggctgttcagctatacctgagagtagtaagttttccagtaaggtgctgtttcagtatctcttttacgtggtaaggacttggctcatttgtttaccactgagctttcaactatgaggacactcaaaatagttgaaaaacttttgaatgtttatagtaaaaaggcgacttcagttttggagagaccaggcaaaggaagagaggcagtgagaagctggtgttggaacctgaaggtttaacacaatgattttcagtcctggttgcacgttagaatcactgcgggtgtttttacaaatacagatgctaggactttaccccacaccagttaaatcaggggcagagctaggcattgttgtttcaaatctcctctggtgattctgatatgtagccaaggttgaggacctgtaccttgtcatctgtgcagctgcaaaagctcggcccatccctctccatgctttgcctagtgcacataggggcagctgtgccgagcagcagccaaaacagtagcctctattccactgcttccaagagactgccaggatggaatcctctgtgcctcacatcactgtgtcatatcccaggcactatccaaagtaaaaaaactccctgatcatccactatgcctcagactgcaccctcatatttcttcttcccttttgtttttaaccatttgcaagtatcatgtttcttaatgtgtgccccacactgtccctttcctccatcctttaggctctttccatgtgttctagatatagaacatcattctctgatcaggaaattcctacatattttctacctcttctctgagtgtttacttctgctttaacagaaaactggctgtctcttgcagtcccccaagtaactcataaatttatatgtctggcctagatttttctactgagatccagactcataaataccaatgcttcctttatgtctccagttggatgttcccagactaagatctttttcccaaacagaactcttgatacattttgtctaaatctttcatcctttaatttcactcatttcagtaaatgatacctacatccacttagatgctaaaatcaggaagtaatggagtcatcctttataatttccgtatcccaattcagtttatcctaacagcctgtttgttctgtcttcaaaataccattttccttttttcccattgctcttaccagtaccctggtgagaatagccaccaagtttcacccagagccccacaacagctttctgactgcccttccggctcccactgtgtgctcctgcaggaattctccacaccatagcgagtgagctgcagacacagaagttaatcatgctgttacccttcttaagatctttcagtgttttttgtatcagtcctttatgcagcccagaaggcccttcgtgatctggctcctgtcctctctagctcttccacccacacctcactagctctatccttcttcccccattttttctttcccttcctccttctcttctttatttttgtttaacacatcacattctcaccctctgagcttttgtgcaggttgttccatctgcctggaatgttcttggtttattcttttatcttccttttttcagcttaatcctttcctgtggaatgtaaaaattgaccgaccttccttccttccttccttccttccttccttccttccttccttccttccttcttttctctctcctctctcttttctctctttcttttctttctctcttcttttctcttttttaagacatgggcaactggacacggtggctcacgtctgtaatcccagcactttggtaggccgaggggtggatcatagtgagttcaggtgttcgagaccagcctggccaacatggtgaaaccccgtctctactacagatacaaaaaattagctgggcgtggtggtgcatacctgtaatctcagttactcgggaggctgaggcaggagaattgcttgaacccaggaggcagaggttgcagtgagccgagattgcgccattgtactccagcctgggcaacagggtgagactccgtctcaaaaaaagaaaaaaatataaaaagatgtgcatgctgtgttgcctaggctgaagtgcgtggtacaatcatagcttgctataaccttgaactcttgggctctagtggttccccgacctcagcatcctaagtagctgggactacaggcacgtgccaccatgctcaactattttttaaatttttgtagggagaagggattttgctgtgtggcccaggcatgtctcaaacccctggtcagaagtgatcttcctgccccagcctccctatttcttttatatagcgtgctgagattttcccttatcacatttataccaatgcatattgtattctttaaaaaagaacttattatagaaaataactagtagagagcatagtcataaacttccatgaagccatcacccatcttcaaacatgggcaactcatgactgatcatatttcatctatattcattccctgcaattattttgaaagaaaaccccggaccttatattactttatattagatttattttttgaaagataagcattgtgttttaaaacacatgacaatactatatgataacatgtaaaaagttaaatgttccttaatatcaactatacagtattaaaatacactttgtttgaatccagaaaaattgagtctatacattgcaatgaattgcagttacatgtcaatcttttagtccatgggttacccctaccatgccttttttccccttgaagttgatttgttgaagaaacagattaatttctcctatagagctttagaagtctggattttccttattgtttcctaatggtgttatttaacttgttcccttatgccttttaaataagtagttagatttagacttggtcagaatctaactgttgataatctactaagtgattatggttagcaaaatggtgatattcaaattctgtctttccgtcttcatttgttacatgcagtgcatctatagagaaacttcctcaaatcaactacaatatttaattatactgaggtacagtgtatatgaaagggtatgaaagggaaggaaaatgtttgatatattctgtatttagaaagttttaaagtaatgaaatgattctgtaataccctccaaaatgaccaattaggttttttatttcattttaaaacttataaatttatttatttatttttatttttattttattttattattattatactttaagttttagggtacatgtgcacaatgtgcaggttagttacatatgtatacatgtgccatgttggtatgctgcacccattaactcgtcatttagtattaggtatatctcctaaagctatccctcccccctccccccaccccacaacattccccagagtgtgatgttccccttcctgtgtccatgtgttctcattgttcaatacggtgtttggttttttgttcttgcgatagttaatgagaatgatgatttccaatttcatccatgtccctacaaagaacatgaactcatcattttatatggctccatagtattccatggtgtatatgtgccacattttcttaatccagtctatcattgttggacatttgggttggttccaagtctttgctattgtgaatagtgccgcaataaacatacgtgtgcatgtgtctttatagtagcatgatttataatcctttgggtatatacccagtaatgggatggctgggtcaaatggtatttctagttctagatccctgaggaatcgccacactgacttccacaatggttgaactagtttacagtcccaccagcagtgtaaaagtgttcctatttccccacatcctctccagcacctgttgtttcctgactttttaatgatcgccattctaactggtgtgagatggtatctcattgtggttttgatttgtggttttgatttgcatttctctgatagccagtgatagtgagcattttttcatgtgttttttggctgcataaatgtcttcttttgagaagtgtctgttcatgtccttcgcccactttttgatggggttgttcgtttttttcttataaatttgtttgagttcattgtagattctggatattagccctttgtcagatgagtaggttgcgaaaattttctcccattttatgggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggtttgaggtctaacatgtaagtctttaatccatcttgaattaatttttgtataaggtgtaaggaaaggatccagtttcagctttctacatgtggctagccagttttcccagcaccatgtattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtgtagtttgaagtcaggtagcatgatgcctccagctttgttcttttgtcttaggattgacttggtgatgcgggctcttttttggttccatatgaactttaaagtagttttttccaattctgtgcagaaagtcattggtagcttgatgggaatggtattgaatctataaattaccttgggcagtatggccattttcacgatattgattcttcttacccatgagcatggaatattcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctattattggtgtataagaatgcttgtgatttttgcacattgattttatacctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaaaatttaaacatactttatatctttaaattgcaggtattattttactaatgcacaagttgtctaatttgacaaatgggagcctctggaatctctttgacatgcctcagtcgtttttgtacttagatgttctgtgtctgtttccttggctaaactattggctccttaaatggggggacttgtctatattgtttatccttcactccacacacaggctcatagtctctccattaatatttattgaataaggggtgggatattaaaatttcattaagtgaaaggctgtcttatagaggaagacctagtttagtctttgtggattcagatcttgaatcagagagtaaaactcacaggaagcatttttgtctcaacataaggaggaactaaataatttgaatttttatagaggagttggggttccatgaaaatgttttagggactactttgatccaggcagtgagagtacaaggatagactatcaagccagtgaggatctttttgtctccttgggagcctggatgattactgaggttacttttaattgcaagatgataagaccctaaaatccttggttgacagattttatttttagaaaggtgcaaatttgggtggtttaaaattgctgaaatgtacataattttttcctatgaactttatatgccactctaatattatgtttctaaatattatgagtttgtatatttgataaagcattgataatgattaatcatgctttagtagcaatcaattctttttataggtaataattgttgattgaatatgcccttccctcatttcattaaatctttttgcattgttagtcacatcctaataaatagctgttatactattgttttattaatctttgggttttattcaaaaagaaattaatgtgtccatttttgctttggttggttgtacttttgaggttttactgaagaactatttgcccaaccaatgttctgaagcatttcccaatgttttcttttagtagtaagcgtctacaagcaaacaatcaacaaagtgaagagacagcctacagaatgggagaaaatacttgcaaactgttcagcagacaagggattaataaccagaatacataaggaactcaaacaaatagcaaaaacaaaaatccccccaaacccctaaagatcgattaaaaaatgggcaaaacatttgaatagacatttctcaaaagaagagatatgcatgttcaacaggtgtatgaaaaaatgctcaacatcattaaaaatctgagaaatacaaatcaaaaccatagtgagatatcatctcaccccagttaaaatggcttttatctgaaagacaggcaataacaaatagcgatgaggatatggagaaaggggaacacttgtatgctgttggtgggaatgtaaattagtacagctgctatagagaatactgtggaggagcgtcaaaaaactagaactaccatatcatccagcagtcccactcctgggtgtatctatccaaaggaaaggaaatcaatatgtggaagagatacctgcacccccatgtttattgcagcactgttcacaatagtcaaggtatggaatcagcttacaagtgtccgtcagtggatgaatggatgaggaaaatgtgatagatagtacacaatagaatattattcagccataaaaaataattagatattgtcacttgcaacatgggtggaacgggaggacattaacttcgtaaataagccaagcactaagacaaatagcacatgttctcagtcatatatgggaactaaaaaattgttctcatggaggtagagtagaatgatggttactggaggttgacaagggtcgtggagagatggaggataaagaggggttgattaataggcacaaaaacacagatagaaggaataagaccatttggtagcacaataggatgactatagttaacaataatttattgcatatttcaaaatagctggaggagtggatatggaaagttctcaacaaaaagaaatgataaatggttgaggtggtggatgcctcaattaccataatttgatcattacactttatatgtttatatcaatagcatatgtaccctgtaaatatgtacaactattatgtatccataagtttttttaaaaagaaattaatttaagacaaactagttttagtcttcttccacttctctctgtattactttgatatagattatgacaaggtgtaattactgacagtttaccttgaaattttaatttatttttctggaataaagtattgtagttagcacttttaggatattcctgaagagtaaatgttaaacagtgttgagatgacttcttattcacacctgaatcagaattgaatttagatgacagtaacaatgtcatgaatatttagttaagtttaatttttgaaatatgtatgtaatacagtatagtgagcattttaactagcatataaagagggaattaataaatgaaacactattaatataactttaaaaatatttttaataactttgccaaaaatctgtaaattcttctgaaaatattgtccttgccctactccagcattctactgtcactccctccaaagtatctacatttccttctattgcttctagaccaataccgcaaggaaacgagcattgtatatgtctgcacttggtattattttccttcgcagtttctcttgagacaaaatcataatggaagagagaagcagaatatattaaatttcccagattatattaaatttattttgggtatattgctttaatttccttcatatcttgtagacataatttcttctaggtgttagcacatggacactgttttcagagatgacacagataatatttgtaattttgttttcttgtgctaagatagtctattaatttgaagtaactaatggaatagaagacctttaggctttctttgagaatttttttccataaggaagttctctttaagcatcatcttttgaaactggaaaatgtactttgagctaagtggggagttttcctttattgtttttgcagaacattaaatgaacaaatgaatgggtgaaaaaataaataggctgttttctttattgataacttctctcagcactatgggaggccgagatgggcagatcacgaggtcaggagatggagacgatcctggctaacacggtgaaaacccatctctactaaaaatacaaaaaaaattagctaggcgtggtggtgggcgcctgtagtcccagctactcgggaggctgaggcaggagaatggtgtgaacctgggaggtggagcttacagtgagctgagatcatgccattgcaccccagcctgggcggctgagtgagactccgtctcaaaaaaaaaaaaaaaaaaaagagaaaacttctagaccttgctttactcccacaagaaaattttatatttacaaatttagggcacacagatgtgtggacagagtttctgaaattgacagatttggatttgtgctttgtgcttagaaacagtttgaaagttggatcccctttcagcctggctctacctggctacccagtatccccatgtcctgtgcatggagatattctccccactcctgcccagtgcagttcttcctggtacggcactttggagttcatgccgcctgatgggcagactaaagcaatgagtcatggctcctttgggctaagctgggaatgacagttattggaaaaataagagaataagcataaagaatctctgaaataaaatggctctctatacagcttaaagcaactacaggcaaatttggcagtaactgcaatagaacattctgtggtaatattagcacaatttagagccctttttatttacctgaattaacgtctccactggcaatcaagccctgattgccttctattcattagcctttgatttaattaataagacttgttgaagagggatcttcaatgtttttctgtaaacagctctaatttattgattcaatttgaattttgtgattatttcaagttatttaaatcaacgtttgaattatatgtttgaagttttcataaaataggttaaatccacaagataattagaagacacaatgttcattttgtttttcatacagtaatatatctttttgatatctttaaaaatttccattttgtaaatgagttagtaacttagactgtcaaatatttcaggtcatattaaactttaaaataaggctggacacagtggttcacaccttaatcccagcactttaggagggtgaggcaagaggatcacttgagcccaggagttcaagactatcctgggcaacatagtgagaccttttctctaaaatttttttttttaaattagcctgacgtgatggcatggctctgtagtctcagctactctggaggctgaggtaggagaatctcttgagccccggagatggaggctggaggctgcagtgagccatgatcatgccactgcacttcagcctggacaacagagtgagaccctgtctccaaaaaaaaaaaaaaaaaaaggtttaaaatatacatgaacaaaaggtagactattaaaaaatttcttaacgttattttttccacagctgtcttttctaaaagtagacccagtgacttaacatttttaccaggctttagaactgagagactcagtagttgttgagtgttgagacacgtagataaaaagtaattaagaaaggagaaagtcacaatgactcttaggttaaagagcaatttgataatcagtgtaattcttaatgagaaaccaatgaagcagtcgtagaaaagggagatgctgattagtggtctttgctcagattattaaagattagtaaggttagtgagtgttttgaaacatgtctgctggatgcaaaaaggttaattaacaaagcattctacaaattcttaaggaatataaaaacttaaaggaaataaaaacttttctatatgtagatgcagtaaacataaagagaccacaccttttatttataaaaagaaaataaacatttaaacctaacatgaaagatgttgaaaactttataaaatgttggtatttttgaaatttttggaaataatacttttagtaatttattctggacttattttgcaggtatgatgaggaaaatgttagtatactattataacagcattaatattcacccagtgaaatctactctgtgccaagaaggtcctagatactgagcacatatcagttgataaaacaggaaaagtccccttcatttctggaacttatggtgtagtatatattttaaggaaattttagtttgaagtgatgtaatacataaaatctcagtgtcatgaactgttgagatgatcataacttattaaaaacaaacacttggaggttcaattcatggagaattcagaatatgaattccatgaacctaggtcttgtttttttatgcagttaccatagaaaatattttcaaagacctttttcactatgaaaataatacaaattagtcagtgaaattacttagggggaatccatctttagttgcacttaaaaaatgagtgttgattcaattaaaggctggtgtcctttcagtgtgttacaaggcaaacatagtttcatgcctgagaatgtacttcaagtacacaacctacagaagcatgcggttcctatattccagaactcagttcacaatacgtgatatataaaagttaacgctctcaagagaaatggaaagctctgcgggaaaaaggttgtgtgtgtgttttatgggtgaggggaaaatatctgtaaatgaggggaaaattccaagcagttcctggaatcagttactgcctcctcagggagccagtgatgagctcaactgggctgagaaaaattcatgcagttatcagcactaactgcatcccagcctcaagccctgccaaagtgcttagtcctaaaagatgaagtgaagagtacaaggtgcagtctccagctgaaccccatgtgcatagtaattttttttgcctgcatctgggtacctagagcacaaacaggattagaaaaatcaagaaaatatactcaggagaagaagttgcagaacagaaaagcagcaggcctgtcctgtctgctaaagcagaaggaaaaagaaacacaactcctgaccttgaggagatggtacgttgtggagccttataatcaggtctccctatcccattactgtaaccaataataatgtatttccgcaatcagttcaatgagaaatgccactaggatggttcaactatgatgaagtccttgttcttttgggttttatgtctatggcagttttttgagcgaaagcagaccaaatagatgtaggtttaaaaaagagacattcaaattctttcaaactcagacactggattctctggcccacataagttctcctttgctagttctttaacctctagagatttttggtagccatttaaattgcaacaagagaccatttttgacctattaaattggcaaaatcagacactgagaacatatagtgtaggtgaaggaggagaggcaggggagctctatttggtataggaaaggataccaaatatttatattggtatcctctatgtaggatgcttctccaatattcatcagaattggagatcagaaatgcacatacctttgaccttgcaatggcacttttaggaatttaacttacggacatatttttacaggatggaattacacatacaagaatatttattacatcattgtagtagcaaaatttgggaacaagctacatagctatcaacagaggactgggattaaacttagtatgctatactcatacataagaacaccctgtggtttttgaaagcaaaaggcagttttctatgaatttatgtcaccaaaatatgttgttaagtgtaaacaatatagagtgtactctgtattgtataccactatttgtgtatgtgtgtatatttatgtgtatatatatgtgtgatacatatatatgtaagtctatatatcttgtaccttttacatttttaatacagttgtctctccatgtttgaggtttctgcatctagattcaaccaaatttggattgaaaataattgggaaaaaagacataatataacaattaaaatgatatgtgtaaaaaatacagtataacaactatttacatagtgtttatattgtattaggtattataagtactctagagatgatttaaagtatatgggtggtgggcacaggttttatgcaaacactacagcattttgtgtaatagacttacacatcctcagacttggtatcaaaggggatcctggaaccaatccactgaggattatatgtgtgcttttgttttttcctattttaattaacaaacaaaccaaataaagtatggttctaggcccagtgtaggtagaaaatagaacagtcaaggaggggactaatatagatagttatgtctttgattgatggcagaaatgactggataaaaagttaactccatagcacaatcttacttttaattggcgccaacacatatttagaatgtgtctggaaggaccatctgctttggataggtcttgtgtaatcttgtaatggtaaaatattcataacttttttgatgacatactgtaatataaagcacaactagaccaaatataattttaggaggttgtagtaaaaaagaaaaaaaaacaaaaaaaggggaattttttccttttttttttttgagagagagagaagaatgtcaagtttctgtccttgggaattgaatgacctcagctaaagactgaaaatgaagacatttcagcagaaggaacaaagagggagctattggagaaacaaaggaacagagttatttttgattgcatgatttttaattaatctgagactaattatcaagtgtggtgatttggttaaatactagtttcattctggaaggaacacagtgaatcacagaaaaattcagttaaatcttggcctatgcaagtatgaatatttaaaatgtgaatatttatgatgatgatacagaattcccagccgaaaccttgctttggtggtataattgaatcactgacatttttagcataaaagtgaatttatttagttatataaattataaggaagacaattagaactataatgggcacatatttttatgaattcacttatctttcatttctcacagggtaaatgggaagttggtagctctgaaggtgatcaggctgcaggaagaagaagggacacctttcacagctatcagggaaggtaggcacttttccttgttgatattgcttttgtgtttctatggtccccgtagctattttaatattatacacctctgaatatgctgagttttaaaattacaggattgtatctttcattaaaatgtgtaaactgaaatttaaaaatcagtatctcttgcagtcatgtcaaatcatgttaaatgaaacaagattatctgctgtgtgctcagatgtggaataaaatgctgtgcattaatggtgaagctatctaggtaactgaggaattttgtatgtctgctatcatttacagagttccttagatacatattagtttaacattattccgtattgatgatttttaaggaaaaatctttaaaaatggggatttgtcatgccatcttactaggcatttgaatttcttttcttcctttgtttctatcctttactgtacttttactggtttttctgattggaagaagataacatagacattctttatatattagggtcatttatgttgtgatattttcctctagtctgttattttctaaaatttcttttataatgtagttatttgctacatataagattttattttttattaaatcaaatagctctatctttgctttgttacctgcatagaaaggcttttgtattccaagagaataaaatatctttttttttaatcagtgggaacttttcagttcagtttaataagttttaggataagtaggtttacctctactacatttttaaaagtgcagattatcttgacataagacttcagtttatttttgcattgaaaggatcacagctattattctcttcatccataacaagataaattggtggtttgctgcaataatttatcaaggtattgatgaactaaatgtggtctgtcactgctttggtttgtttcccacaactgttgatatgatttacatgtacaactattgatatgatttacatgtatcatttttgaaaatcttgtttctatttctactctctcacctcttattctccttttcattcaattttaattttgtttccatcatttatctttagcggaaactgttcttataaagttcatcagtcacttgcttcttgtcaagtcaaatgtatacctctctgtcttattttacccagccttttagcagattgcatggttgaaacggtctcttctgtgacatcagattttccaagtaggtaggtttttctcttaggctgaccttttctctgagttagggggagtttcaggacaggaaagggcttctttttttttttttttctgggacagaatcttgctctgtcacccaggctggagtgcaatggcacaatctcggctcactgcaacctctgtctccccggttcaagcaattctcctgcctcagcctcctgcatagctgggattacaggcgtgcgccactacgcctggctaattttttatttttagtagagatggggtttcaccgtgttggccaggctggtctcgaactcttgaagtagtgatccactcacctcggcctcccaaagtgctgggattacaggcgtgagccactgtgcctgcctttttttttttttctttctaataagcactctgtcctaggtgatattatttatttcatgagtttaaagagaagctataagttgatatcctacacatgcatctctttagctaagaccttgtcttcatctccatttcatatatccacctgcctatttggcatcttctcttgaatacagtagtatataaaaaggatactacatcactaccaactgagattcatttcaggaatacaaggctagtttaatctttaaaaatcaatcattgtatgacagtcatctcagacttaacacatctgaatggaactcatgatcctcccactataaatgaaaccatgttctccctgtattagtaatagcagcatccagtgcttcctctacccaaatctagccatgaacaagccctgttgattacctctctaaatgatacctgaaatctgtccacgttctgtctctccactgccacccctagtccaggataccatcagttcttccatggacttctgtaatagcttcttaattatacacctcacttctcttgccttattactatcccttctctactctgttagccgtataatatttttgaaaactaaaatcatattatgtcaatccccttatttaaaattgcttcaagtcctatatgactgattttcttcaaacatgctatagagtttcctgtctcaggaattttacacatgttgttccccatggctggaatgctcttccctggctctttttagatttaggggtcaattcaaacatcccatttcagagagagtttctttgtccatttatccaaattagtggctgaccatcattttatgcatctttactctccacatcacaccctatttttatttccattataattcttattggaatgtgaaaatttctttccactctgtatataatcttagtgaggtcagagaccttgtctgattgttcactgctgtaccctcaacatctagcatggtaatcactctacaatagtaagtgacttaaggaaaatcattaggttagaatctataaatatgacagattattagatacagtctgttccctcaaggaacctgccttgcaggtgggaggtagaacatataaatcataagttgaagaataatatgtggtagcatattaatgccaaattatttataaaagattttgaaatctaaaagattgtgaaattatttctaaaagattgtgatttttaaggaaattcttccattagtgatgggaggtaaagtgttagctaggacttgaattaggcataagatagaaaaacagtaaagagtagattgaggagaagtgttccagacaggtatagaaaaggagctgagaccagaaagctcaatgcctttgccaagtgcagtgaacaggaggaatagttaagatcaggagttctcaattgatagagtgggagggatgggtaattattgctccatggaagtggcttttgtcatcacaataattgaacaatgcaaccatgtttagtggatgagagcttggcatttacgtgagaaactcttaatacagagggaggcaaactgtggcttggggcctgctgtctgttttggtaaataaagttttatttgaacgcagcactccaactcatttatgtattgtctatggctgctttcttggagttgagtacttttgacaaactgtatggtcccccaaacttaacagtatatgctatttggccctttcaataaaagtttgtcagtctctgctctaatacaataaacaattgtctatcgggggaaaccagcccacgatattcaacatgagtccttttctatttttcctaagtgtcggatggtctgagaaataaagggaaagagtacaaaagagagaaattttaaagctgggtgtccgggggagacatcacatgttggcaggttccatgatgccccctgagccgtaaaaccagcaagtttttattagtgattttcaaaaggggagggagtgtatgaataggatgtggatcacagagatcacatgcttcacaaggtaataagatattacaaggcaaatggaggcagggcgagatcacaggaccggggcgaaattaaaattgctaatgaagtttcgggcacgcattgtcattgataacatcttatcaggagacagtgtcggggagcagacaaccggtctgaccaaaatttattaggcgggaatttcctcatcctaataagcctgcgagctctatgggagaccagggcttatttcatcccttgtctacaactgtaaaagacagatattccctaggcggccattttagagacctccccttggcaatgcattctctttctcagggatgttctttgctgagaaaaagaattcagcgatatttctcctatttgcttttgaaagaagagcaatatggctctgttctgcccggctgtcaggcagccagacctaatagttatctcccttgttccctgaacatcgctgttatcctgttcttttttcaaggtgcccagatttcatattgtttaaacaatttgtgcagttaacacaatcatcacagggtcctgaggcgacattcatcctcagcttatgaagatgatgggattaagagattaaagtaaagacaggcataggaaatcacaagagtattgattggggaagtgataagtgtccatgaaatcttcacaatttatgttcagagattgcagtaaagacaggtgtaagaaactatacaagtattaatttggggaactaataaatgtccatgaaatcttcacaatttatgttcttctgccatggcttcagccggtccctctgttcagggtccctggcttcctgcaacagttgtctcatgtcccacaagcttttttttaatgtcttactgagcattcatgcaggtgaaaaatctgtttatatttatgagcccaaacccaactattttgcatataaacaaaatatgctgtgcacagatttaatatataccaaactatctaggaatacaactacagtgtaaatcatggaaaaattgtattgtgttttgtttaaaactttacaacttgttcatattttggaaaaattccttagtggcagtgctgcttgtgttatttaattcaataatgcaatatcccacagtctgcatttgtagtggttgtgcttatgctgattctgtacatagatgtgagcaccactcttcagtgtgttccggtatagttgtgtctacttacatatttaaagactttgttttattataaattaatttttatttattttttgtattagttacatatagatataaattaatatatttgaaattatatttatatataaatatttgaaattatgtatgtgtatcttgttatatatgaattccatttcatagtagtaaaggcaaaaaaagtagtaaaatatttgttatataaagagggtattggctttgatgggattgaaaatgactgaggtagaacaataggtttttgttaagctgtggagggagataaggttaaaagtgctactgaatttaattatacagtagaccctgaatatgagagaggagagggacagggactctgggccaaaaaggaaccagaagaaaaatgaaactggccagcaggcaggattcctggtatgcagggtgtgcactagaattaatcaacctaatcttactgttggtgctagtcttggtccaaggtgacaagaaggttcgtagtggtattgaaggaccagtgtgacaagcaggcccatcagtgggaggttcaagggaagaagcaagtaggatcacattgaagttgttgatgatcttcttattcactttggctgggtgtgaggcaagctcctgaggcacattaaaggttagcttctgggaaacacagagaagcggggaatgcaatgaatccttagcacactgagacctggctttgactggcaacataatttcattttaagccttgagatgagcttaggaactggccctcagttgcggttgtgttgtagaatgcagggctgtgtaggtgggatcttgttctgtgggttagagagcctctgaagactttagagttgggcatattagggacaaaaatctgatattcagataggatatcaattagaaaaagaagaaactggaagctgataagtcagtcattcagtgtgttgcagatttgaaattatgggtttattagatgttagtaacaaaaaataatattctatagaaagagatgtcagagctaggtgaagtattgattacagattgagaggaaaatgtcaatggttttgagtttgactgagtgaaaaaatagggccagagatagaaatagttggtgattgcatggagaattgcttttaagactttacagtttaaaaggctgttatccgatataatcttcatatgctagccctttgaaaaagttttaaatttttattttgtagaatttatattgtttatagaacctgtattataaatatggaattaaggctcagaggggttagatgacttgtctaaggagcaggatcttgtacctagaccttgttagatttcaacagggtcattactgacattttggagtaatcaatttgggttttagggattttgagctcatgagacatctgtatgaaaatgtcttgttgggaatgtgggagtgcagctcacaagagtttagcgtaagtagtatatatgtaccatggtcgttaagaagttgaaccatgtataacatttttgtggaagcgaatgttgagtgaaaacagagtcagttacaaggcaaggtagaaactcccatgggaagctggaggtgatttctcttatgttgtacagtgatgaaaaagtcagaatcaaaacctactgatttgtgtatgttgattttgtattctgcaactttactgaatcgacatacacagatcagtaggttttgatcctgactttgtttttcatccatgtacagtataagataagccacctcaattagtttgctagggctgctgaaaaaaagtaccacagcctgggtagcttaaacaacagaaacttaatgtcttgcagtcttggaagctggaagtctgagagtaaggtgtcatggccctccaaatgagggcaatgaggaaagatctgtgccagccactctccttaacttgtagatagtggtcttctccctgtgtcttcacatcatttttcctgtgtacctgtctgcatccaaattttctcttcttacaaggacaataatcactttggtttagggtccacccatatgacatcatttcaacttaattacctttttgaagaccctatctccaaatacagtcctattctaaggtactaaaggtcaggacttcaacatgaattttttggggggacacagttcagcccataacagcacttaatggctttgggccttagtaaccctacgtattaatccattcttgcactgttgtaaagaaatacctgagactgagtaatttctaaagaaaagaggtttaattggctcatggttctgcaggctgtaccagaagcacagcatcttctggagaggcctcaggaaactttcaatcatcctataaggcaaaggggaagcaggcacgtcttacatgctgaagcaggaggaatagagagagggaggaggtcctatacactcttaaacaaccagatttcatgacagctcactgactcactattgatatgacaacacgaagggggatggtgttaaaccatgataaaccaccccagatccaatcacctcccaccaggccccacctccaataatggggattacaattcaacatgagatttaggtgagggcacagactcaaaccatgtcaccctacttgcaaaaaataggagttggattatgccatctcttaagaactactttggcgttgtggttttgatttcccaaagaatctttaaactcagaatttggaatgttctggagatcagggaatgatagaaaaatagttggggccttgatcacaaaatggcattttattttctattgaataaaatattttaatgtctttctaataaagtctgacttctgagtgattttttttttttttgtagcagtaaatgacttcaaggaagagaaattaaactctgggtcagtttttgttatttgtttttttcttgccttctcattctgcctttcatattcttatttttctgctgtttatatctggaagcaaaaggcatcatcattgcttagcctttccccattaatacttctggaagtccagacacaataactcctctgtgtatctaatggtagaatttgaaatatttagggcaatgtgggagacatttgggatatgttcaattttacattgatgaggaagcagcatggtgtgttcaactgagatagaacacctgaatttgaatttgcccctcttctgctgtgttgatcaatttctcatttacaaaatatcaacagcgggaagatttcagaataggaaagcaccatgcacagtaaagtagtttgtaagtggctacttgccactcacaggcttacctagaaacttggattttagggcgtaattttcacctcaagtggaaatacttgaagcaactctaatctaacctagatttatgtccaaagatgtactttgaattttatctctcattgagctagagtgtgtaatggattaattcaagttcaggcgctttgaaactcattctgtcctcgatggcagcttggagaaattaagttgtagtgctcagggtcagcttttctattttaatttagaatcattatatggcatcatcttggtttatgaggaacagataaagggctgggagatacaggagaggtttgaaagacagtggataaaatgtcttaggatattccatctttcaaacaacttttaagtgttaagtgtgtatgttcttactctctgatattgtattctagacttccacgttttttgttgtcttaagattttcttagacaggcatgaggtgaatgaaccagttgtctcttttcatagattcttgaatatgtgatggttttcttaggtgagaattatgcttaaagagaaatctagatactctaatagggaacaaatttaaattaaaatggtagcagtataaatagacaatatttggtgtgtgcttgcacagccagagcctagtctcacttaacactcacaaaaccctctaaggtaggtactatcattattgctattttgaggttagtaaagttaggattggagaagtcactcacctaaggttaacgctagcatgtggtagagctaaaagctgaacctggctgggtgcggtggctcacacctgtaatcccagtactttgggaggcggaggcaggcggatcacctgaggtcaggagtttgagaccagcctgttcaacgtggcaaaaccccgtgtctactaaaaatacaaaaaaattaaccaggtgtggtggcgggcacctgtaatcccagctactagggaggctgaggcaggaaaatcacttgaacctgggaggcagaggttgtagtgagacaagatcgcgccactgcgctccagcctgggtgacaagagtgaaactccatctcaaaaaaaaaaaaaaaaaaaaaaaaaaagctgaacctgagcaatcatacggcagagcctatacttaaacgttatactctgctagattttatgtagaaattttgaatttatgcttcattttcatttcatacagagggttgtgttattgccattaagtcaaggttagcaaaaaagatagggattttgaggggggacatgggaaaaaatttatttataaaagtgataacacatttttcaataaagaaaggaaggcagcatccacataggacaagaaagggtctaaaagaggaaaggaacaaatagattcaacacaatataactcagagacagtagaaacatgtagaggaaaaggggacctctcatggtaaactctgtagtattgaactttttgtttgggtacattctttttaatacatgtctgagtattcccatgtgctttatccaccttctctctcttcctttctccacccttctttatgtatttttttcattattcattctattagaattctatggaaacattttagatttttaatacaaaatgtggtaccaggaaggcagaggtagatataaactgaaaaagagataaaggaaaaagaacaacttcttttatttcaaatatttggaattagttaacctgcttgtaaaatgaataattttatgatttaattgtaaaatttgtactgtataattaaaatattctaatagtacaataaatgttatatgaattattgatattacttttacaaattttttaaagttataaattggaaaataagactgattttaattgagtcattaaaattttggtgtttgactgatacttgattctctaccttacatttttcttttttaatgttatagcctatctgtttttgttgtttttcattaaccataccatttttccttgtaactgtatggtacaattgcttgtgaagtttgtatatgtaattgagttataattcaattgataattaaccagtctagatttcatttcttgcatttcatgtttggggtgttgtattgcttttctagggcttctgtgataaattaccacaaatttgctggcttattcttttgtagtgctggagagtagaagtccaaaatcaggatattggccagttcatgcttcttttagaggctatagggaagaaattcttgctagttttttcctagctcctggtggcttcctacaatctttggtgttctttggcttatcgttacatcacttcgatctctgcctccatcttcacatggtcttctctctctctgtgtcttctcctcttatagggacatcagtcattggatttagagcccacgctaatccagcatggcttcatcttaacttagctaattatgtctgcaaaggccccatttgcaaataaggtcaccttctgaggttctgggctgacataaatttctgagagacactattcaacctgctaccagtgtttatttttctcagtttcacagggagatttgtaggtcataatggactgggacctgcattggacctttgaaagcttaggagaaaaatgtactacatggtggttttgataacactcttctttgttttcttattactgaagtttgcatataatagacaatgaatgaatatagataactttctccaatgtgatttatttttgtttctctccatataggctcttttgttattgttattcatttatttttgttttcaagcaaaatatcattctctgtggattattgaatgacatatgaactgtggcttgtgtggagatagattacatctgtcaagttagtgagtatgattgagacattggtagttagtctgggattggaagcaggaagaactgatataatggagacctctaaagctactaagttgctgtgaaatgataaaggtctacttccacaattctatacgttggccactgggatttcagacacatttacacaaagacaaaatgttccaggctgttctgttggagtctttttttattcagatatgccttttatccaggtatatggacatgtttttttatccagatacatcttttttatctttgagtagattcctgggctgtcccataagagcctttttttatccaaatatatagttttgatgatcaaatacaacctaaatgataagtatataatcatctttggttataactgaaattattttgtcaatatctggatgcctagatacttcttacccctatcaccttcccagtggagagaggacatctgccaaaagagaactcaggtcctctgttccctcccttttccctgacctggagtctcttgcactcaggctcctgaaagctaagttgagagagtgggcacagatgggaagaggggctcctgggacataacctccttctttaatagactggagggctgttgcagggagaggaagaaaggacaaacatttgtttccatttgtgttttgtcaatatcgctgtttggaattgttcatcctcttgtaatgatttcaaaattaacaagttgattatagatggaattttcagtgaaacattatgttaatgcaacatttgaccctgtgtagtaggtgacaggttaaattaggtttcttcaagggtcttaataactttttttaagactcaaaaattctttgctcagcctagacatttctgaattcagctgttttattggcaactgtttttaaagacactatttgtagcatcattgttggaagtacatgaatcctataaaagctaattaggaatctaaatcagactttagagattaccttgtccaggggtttctcagttgcatcctcatggtcttcaagctatgtgtttggtcttacagtaaattttaataaatagtgaccagaaagtggtccagggcctggtttctgaagcctgactgcctggattgcagtttggacttcattctcatctaagtgtatgattttgagcaagtcttaaacttgctgtgcctcattttccatttcttaaagaggatgaaaatacgactcaacttacaggcttcttgggacattatatccatcaaatatgaacatgaggccataaaatagaagcaatcaaggaataatgaaaatttcttcaaaataaaaatacattaacaggtattaaactttcagaagaacatttggattgtgaactcagagaaatctcccaaaaggagatcaagaagagttatcatctcttatgtctttgagaataaataatatagttatttgaattttcttctatattgtcactttcatttatttctgcttgtgtgtttggtctctttcttattggaagcatctttcagctacctggagatcttgttgattgtcagctcatatttaaaagtcagactttaatacgctgtttggaagctctgggtgcttggatagggaatattggttggcagttttgtgatggggtgagttaaccatttttttttttcttgcagtatctaagatgtcagtatttgggggtcgtttcttggaaggaggcttcagtttctacagaaaaggattatttaatctcctgcctggaagatttcagtttgctgcccacattgtggggattgagtaagagacagaggttacaggggagtctcaaccttcaacatgcagatttttattgaatttacctattttcagttcagattatgcagtgttagagagacaaaaaggcacccaaatatttaaggcaaaaaattaatgggcctctaaaaaggttttggcagtagggatagataggagataaatatgtttggaagggacttaagagggacacttggtagggctttgtgtttgactagacatggagcttgatgaaggtggggttagtcagggtgacttccaggattctggattgggtaattaggtagatagtggaaccagtaatgagtaactgtggttggggataggggaggcaggtggagtataagaaagacaatgagttcaattagtgagtttgaaatctggcattcatgtggcagttgtgtgacatggtggtgcagtttagataacaggtgtttgttgtatctaaattgagaactttacaagtcatattcgagtatatgatctagtttaatttttaattccttgaggaaggttgatgttaccatcttcattttactaatcaagacactgaattccttgagggaggttgatgttaccatcttcattttactaatcaagaggctgaggtctaacaagattttttttgtgcaaagtcatacaaataattaagtggtagatatggagttcaccttgaatattctaaccagggcctagaacagtgcctggcacatgataggcactcagggtatgttgaatgactgagtgaatgaatgaataagctcccatgttctttctttgtattctattatatggccttactattgggacagaaacccatatgatgaaaattgtacacagattcttctcaggcttccccagagcaaaaaggcgatattgagaaagctccataagcgaggagctggaaatttttcagtcttgatggagactgtgcccctagctatgtgatcataagcaagtacttaacatattttgtctttagttttttcatttttgaaatggagaccatattattttagagctttataattaaaataatattaccaacatgaatcttttacctggaaaaaagatctataattgtatcactattattctcaatgcatacatgcagtaatatgatgcacatttattgggttaaaatattttttaaaccttctaacaatcaccctttctgtctgtcactgaaaaaattaacatgaattgcttaaagcgtttttataattgacaggcaaaaattttgtaaatggaagataaaaatccatgagtctagactgtaattctaagtatgcttatgtaaattgccacaattgttattctaagtctgagtaatctgatgggtgtctgccaactgatatcaacaaaaacttgtcaagtgttaaatcatgattaaaaactatgaaagtcatatgttttcttttttatattaataattttaaaggataaagtttgttttttaaaatcaagtaactgaattcctggctgttttaaatttgtaaaaaatttatatgacattttgtcctattttgtcaactagaaatataaattgagatatgatacttttatatttaagacatttttaggaggattacataaacagttctaatctgaattcatgtataacttctaaaaatcccatggactttttcagttcctactttgccaatctttaaaaaacgctatcttgtttgattttcaccaaatcttatgttatatgtaggttttaatatatccaagttacaggtgaggaaattgaggcctagacataaataaaatgtcctgtgttacaaaacttgccagtaaatgactgttaggatttacactgggatttttaaattgaggtgtttgttcaaagataatacattcttccattcaaaatttctgggttaattttaaaaaatgatgagaattcgtaatgtacttgtaaacttcttgtcatgatagtaattaacatagctactataagttgctttaaaaaaatgtaacccatgagcaaggggggtatcttaaagttcagtttgacatctcaaaatcatttaatgtaataccatgttaatagaataaagtttaaaaatcacattattattccaatagatgtaaaaaatgttcgttacaaaagctaacacctattcgtgttaaaggcttaacaaactttgaatagaaaggaattttctcaacacacacacacacacacagccatatttgtgtatactagcaatgaacatgtggaaaacaaaatttagaatacaataccacttataatcactttaaatacttataataaaaaagaaatacctagggataaatctaacaaaacatatttagaatttttgtactgaaaattacaaaatcttgatggaaagaaataaaggaagattaaaataaataaaaagatgtaccttgtttatggattgaagatctcgtattgttaagatgacacctcaccccaaatttctctattgatttaatgtcacacctgtcaaaatcccagccagctttttgtagaaattggccatctgagctacaattatatttcatatattacattatatgaaaatgtaatgaactggaattgccagaacagttttgaaaatgaacaaagtaggaagacttacactacttaatttcagaaactttgtaaaaagctacagggatcaagacagtatgttatagttgtgaaaataaacatattgattcacagcatagaatggaaagttcaaaaatgaaccctgacatttgtgggcagttgatttttaataagttgcaaggcaattcaatggagaaataactttttcaataaatggtgctatgacaattggatattcaaatgcaaaaagatatacacccttatataataatatacacaaatttcaactcaaaattgatcaaagacctcagtgtaggagataaaagttaaaacttctggaaggaaatctggtagaaaattttgtgcccttggattacacaaatatttcatagatatgacagcaaaaacgtaatatataaatgaaaatcaataaattggagttgtcctcttaaaaagacaccattaaagaaatgaaaagacaagtcacaaattggtagaaaatatttccaaataatatattggataaaggatttatattaaaaatatataaagaggtccaaaactcaatgatgaaaagacccccacaatttttttaaatggggaatttatttgaatagacatttcagcaaagaaatatatgaatggcgaagatggccaaataggaacagctccagtctacagctcccagcgtgagcgatgtagaagacaggtgatttctgcatttccaactgaggtaccaggttcatctcactgggaagtgttggaaagtgggtgcaggacactgagtgcagtgcaccgagcatgagccaaatcagggcgaggcatcgcctcacctgggaagcacaagaggtcagggaattccctttcctagtcaaagaaaggggtgacagacggcacctggaaaatcaggtcactcccaccctaatactgtgcttttccaatggtcttagcaaacggtacaccaggagattatatcccgtgcctggctctgagggtcctacacccgcggagcctcactcattgctagcacagcagtctgaggtcaaactgcaaggtagcagcgaggctgggggaggggcacccgccattgcccaggcttgagtaggtaaacaaagtggccaggaagctcaaactgggtggagcccactgcagctcaaggaggcctgcctgcctctgtagactccacctctgggggcagggcatagccaaacaaaaggcagcagaaacctctgcagacttaaatgtccctgtctgacagctttgaagagagtagtggttctcccagcacgcagctggagatctgagaatggacagactgcctcctcaagtgggtccctgacccccgagtagcgtaagtgggaggcaccacccagtaggggcagactgacacctcacatggccagttactcctctgagacaaaacttgcagaggaatgatcaggcagcaacatttgctgttcaccaatacctgctgttcttcagcctctgctgctgatacccaggcaaacaggtctggagtggacctccagcaaactccaacagacctgcagctgagggtactgaatgttagaaggaaaactaacaaacagaaaggacatccacaccaaaaacccatctgtacgtcatcatcatcaaagaccaaaggtagataaaaccacaaagatggggaaaaaacagagcagaaaaactggaaactctaaaaatccgagtgcctctcctcctccaaaggaatgcagctcctcaccagcaacggaacaaagctggacagagaatgactttgacaagttgagagaagcaggcttcagacgatcaaactactccgaactaaaggaggaagtccgaacccatggcaaagaagttaaaaaccttgaaaaaacatagacaaatggctcactagcataaccagtgcagagaagtctttaaaggacctgatggagctgaaaaccaaggcacaagaactacatgacgaatgtacaagcctcagtagccaattcgatcaactggaagaaagggtatcagtgatggaagatcaaatgaatgaaattaagtgagaagagaagtttagagaaaaaagaataaaaagaaatgaacaaagcctccaagaaatatgggactatgtgaaaagaccaaatctacgtctgattggtgtacctgaaagtgacgaggagaatggaaccaagttggaaaacactcagcaagatattacccaggagaagttccctaatctagcaaggcaggccaacgttcaaattcaggaaatacagacaacaccacaaagatactcctcgagaagagcaactccaagacacataattgtcaggttcaccaaagttgaaatgaaggaaaaaatgttaagggcagccagagagaaagattgggttacccacaaagggaagcccatcagactaacagtggatctcttggcagaaaccctacaagccagaagagagtgggggccaatattcaacattcttaaagaaaagaattttcaacccagagtttcatatccagacaaactaagcttcataagtaaaggagaaataaaatactttacagaaaggcaaatgctgagagatttctgtcaccaccaggcctgccatacaagagaccctgaaggaagcactaaacatagaaaggaacaactggtaacagccactgcaaaaacatgccaagttgtaaagaccatcgaggctaggaagaaactgcatcaactaacgagcaaaataaccagctaacatcataatgacaggatcaaattcacacataaagatattaaccttaaatgtaaatgggctaaatgctccaattaaaagacacagactggcaaattggataaagagtcaagacccatcagtgtgctatattcaggaaacccatctcatgtgcagagacacacataggctcaaaataaagggatggaggaagatctaccaagcaaatgaaaaacaaaaaaaggcaggggttgcaatcctagtctgtgataagacagactttaaaccaacaaagatcaaaagagacaaagaagaccattacataatgaatggtaaagggatcaattcaacaagaagagctaattatcctaaatatatatgcacccaatacagaagcacccagattcataaagcaagtccttagagacctacgaagagacttagactcccatacaataataatgggagactttaacaccccactgtcagcattagacagatcaatgagacagaaagttaacgaggatatccaggaactgaactcagctctacaccaagtggacctaatagacatctacagaactctccaccccaaatcaacagaatatacattcttttcagcaccacaccacacctattccaaaattgaccacatagttggaagtaaagctccccttagcaactgtagaagaacagaagttataacaaactgtctctcagaccacagtgcaatcaaactagaactcaggattcagaaactcactcaaaaccgctcaactacatggaaactgaacaacctgctcccgaatgactgctgggtacataacaaaatgaaggcagaaataaagatgttctttgaaaccaacgagaacaaagacactacataccaaaatctctgggacacattcaaagcagtgtgtagagggaaatttatagcactaaatgcccacaagagaaagcaggaaagatctaaaattgacaccctaacatcacaaattaaaagaactagagaagcaagagcaaacacattcaaaagctagcagaaggcaagaaataactaagatcagagcagaactcaaggaaatagagacacaaaaaacccttcaaagaaatgaatccaggagctagttttttgaaaagatcaacaaaattgatagaccgctagtaagactaataaagaagaaaagagagaagaatcaaatagaagcaataaaaaatgataaaggggatatcaccaccaatcccacagaaatgcagactaccatcagagaatactatgaacacctctatgcaaataaactagaaaatctagaggaaatggataaattcctggacacatacaccctcccaagactaaaccaggaagaagttgaatctctgaatagaccaataacaggctctgaagttcagtcaataattaatagcttaccaaccaaaaaaagtccaggaccagatggattcatagctgaattctaccagaggtataaggaggagctggtaccattccttctgaaactattccaatcaatagaaaaagaggaaatcctccttaactcattttatgaggccggcatcatcctgataccaaagcctggcagagacacaacaaaaaaagagaattttagaccaatatccctcatgaacatcgatgcagaaatcctcaataaaatactgggaaaccaagtccagcaacacatcaaaaagtttatccaccatgatcaagtgggcatcatcccagggatgcaaggctggttcaacatatgcaaatcaaaaaaacgtaatccagcgtagaaacagaaccaaagagaaaaaccacatgattatctgaatagatgtggaaaagacctttgacaaaattcaacaacccttcatgctaaaaactctcaataaattaggtattgatgggaggtatctcaaaataataagagctatctatgacaaacccacagccaataccatactgaatgggcaaaaactggaagcattccctttgaaaactggcacaagacagggatgccctctctcaccactcctattcaacatagtgttggaagccagggcaattaggcaggagaaggaaataaagggtattcaattaggaaaagaggaagtcaaattgtccctgtttgcagatgacatgattgtatatctagaaaaccccatcgtctcagcccaaaatgtccttaagctgataagcaacttcagcaaagtctcaggatacaaaatcaatgtacaaaaatcacaagcattcttatacatcagtaacagacaaacagagagccaaatcatgagtgaactcccattcacaattgcttcaaagagaataaaatatctaggaatccaacttacaagggacgtgaaggacctcttcaaggagaactacaaaccactgctcaatgaaataaaagaggatacaaacaaatggaagaatattccctgctcatggataggaagaatcaatatcgtgagaatggccatactgcccaaggtaatttatagattcagtgccatccccatcaagctaccaatgactttcttcacagaactggaaaaaactactttaaagtttatgtggaaccaaaaaagagcccccattgccaagtcaatcctaagacaaaagaacaaagctggaggcatcatgctacctgacttcaaactatactacaaggctacagtaaccaaaacagcatggtactggtaccaaaacagagatatagaccaatggaacagaacagagccctcagaaataacgccgcatatctacaactatctgatctttgacaaacctgagaaaaacaagcaatggggaaaggattccctatttaataaatggtgctgggaaaactggctagccatatgcagaaagctgaaactggatcccttccttacaccttatacaaaaaataattcaagatggattaaagacttaaacgttagacctcaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactatcatcagagtgaacaggcaacctacagaatgggagaaaattttcgcaatctactcatctgacaaagggctaatatccagaatctacaatgaactcaaacaaatttacaagaaaaaacaaacaaccccatcaaaaagtgggcgaaggatatgaagagacacttctcaaaagaagacttttgtacaaccaaaagacacatgaaaaaatgctcatcatcactggccatcagagaaatgcaaatcaaagccacaatgagataccatctcacaccagttagaattgcgatcattaaaaagtcaggaaacaacaggtgctggagaggatgtggagaaataggaacacttttacactgttggtgagactgtaaactagttcaaccattgtggaagtcagtgtggcgattcctcagggatctagaactagaaataccatttgacccagccatcccattactgggtatatacccaaaggattataaaacatgctgttataaagacacatgcccatgtatgtttattgtggcactattagcaatagcaaagacttggaaccaacccaaatatccaacaatgataaactggattaagaaaatgtggcacatatacaccatggaatactatgcagctataaaaaatgatgagttcatgtcttttgtatggacatggatgaagctggaaaccatcattctcagcaaactatcgcaaggacaaaaaaccaaacacggcatgttctcactcataggtggtaattgaacaatgagaacacgtggacacaggaaggggcatatcacacactggggcctgttgtggggttggggaaggggggacggattgcattaggagatatacctaatgttaaatgacgagttgctgggtgcagcacaccagcatggcacatgtatacatatgttactaacctgcacattgtgcacatgtaccccaaaacttaaagtataataataataaaaaaagaaatatatgaatggctaataagaccatgcaatggttttcaaagttgttaatcataaaggacatgaaaattaaaaaccacagtgagctattactgcacacccagtataacggttataattgaggggaccaacaataccaagtgtttcatatggaataatggaacccttaaacatagctgttgggaatatctgcttgtggtacccccactttggaaaatagtttgactgttttttaaaggttaaatattaaattatcatatgacccagtgacttcactcctgggtattgtctacccaagagagatgaaaacatacttccacatgaagacatttacctaagtgtttccagtattattatgcagaatagccaaaatctggaaacaagttaaatgtccatcaactgttgagttgataaataaaatatggtatatttgtacagcagtaaaaaggagctaactactgataacatgtttgaacctcataaacactgtgctaagttaaataacacttggttgtatataccaagcgtattttgtttgtttgtttcttttgagatggaatcttgctctgtcgcccaggctggagtgcagtggcacaatctcagctcccagaactttccagaaaaagttgcctgggacgagctgggagcaaggattgacagtgaactgttacaactctctggtgtagggaaaatgtgtcagttctggattgtgcttatagttgggcaactgtataataatttactgaaaactattgaattgtatgcatacaactggtgggttttaccatggataaattatacttcagtaaaattgtttaacaaaaatgactgatctggctgggcgtggtggctcatgcctgtaatcccagcactttgggaggctgaagtgggtggatcacctgaggtcagacgtttgagaccagcctggccaacatggcaaaaccccgtctctactaaaaatattgtaaattagctgggcacggtggcatgtgcctgtaatcccagctacttgggaggctgagacagaagaattgcttgaacccaggaggcagaggttgcagtgagctgagatcgcgccactacactccagcctgggcaacaaagcgagactctgtctcaaaaaaaaaaaatgatcttaatgtaatgtaatataaataatagttagggtccgaagaatgtaaaacaaacaaatctgagttatggcattggttgcagaactctgtgtagttactaaaaagcactgaattttatacttacgggtggtatattttatggtttgtaaattatacctcacctacattttctcctaattttattaaaataccgatttataggtttagccaaaaaagaagaaaattcaagtgtcaacattagtgatttaatatctttatctatttctctttcttccaaattctctaaatatgtgttacttttattatcagaaataaaacttttgttgactctaaacttctgtaactgatacctcctagtctcaaagatcttaaaatttattagtaaagaaagatgtataattggttgaattataggactgtaattgccaaagtctgttgaagggaaagagtgagatagaaatcgtgggtaaattaaaagagctttgaaactgatagaagaggtggcccttgagtaagtactcttacagtcggaaggaaagtttcaggggtctcttgttgatgctatccagctgtcctgtcattacaaaaaacatgagccacattttacatcagagcttttttttaaaaaaattatcattcctgtcaatttttgacaaataattttaatcacaaaatacttgtttagcgagagaaaataacccaatatgagcaaaaaacaaaaataaaaactacattgtggccgggcgtggtggctcaatcctgtaatcccagcactttgggagcctgaggcaggcagatcgctgaggtcaggagttcgagaccagcctggccaacatggtgaaaccccatctttactaaaaatacaaaaattagccaggcgtggtggctcacacctgtaatcgcagctactagggaggcaggagaattgcttgaaccgaggaggtggaggttgcagtgagccgagattgtgccactgcactccagcctgggcgacagagcaagattccatctcaaaagaaacaaacaaaacttattgagtaacttatgcagccaggaagctgattgtaaatggcaactgacaagctgaacttttatgattccatagtggagaagcagccagagaagctacatctcagaagaaggactctcttgcctttttaaaatttgagtcttcctcagctctgctttgagcatccttcaaggtcatgttagtgctgcctcttccctgaaatctttctggctttcatagaaacaatctttttccttctttttactttttgttcatttttgttgttgttgttttatttgtgtacacttaccttttagcacttactacattgtactttatgatacagtcaattgtgttcaattataaactattgccaacttagggctttatgttctaagggttgtggtgtgaaccaagcactgactagtaatatccaaactcttttcctattgccatcaaaatggaactaaaccagagtgcagtttgtgtttcaatataatttaagcagtaatgaaaatggccatatcaacaaacatatgaaaaaaagctcatcatcactggtcattatataaatgtaaatcaaaaccactatgagatatcatctcatgccagttagaatggcaatcattaaaaagtcagggaacaacagatgctggtgaggctgtggagaaataggaacacttttacactattggtggagtgtaaattagttcaaccattgtggaatgcagtatggcaattcctcaaggacctagaaccggaaataacatttgacccagcagtcccattactgggtatatacccaaaggattataaatcattttactataaagacacatacacacatatgtttattgtggcattattcacaatagcaaagacttggaaccaatccaaatgcccatcaacgatagactggataaagaaaatgtggcacatgtataccatggaatactatgcagccataaaaaagaatgagttcatgtcttttgcagggacatggatgaagctggaagccatcattctcagcaaactaacacagaaacagaaaaccaaacactgcatgttctcactcataagtgggagttgaacaatgagaacacatggacacagggagggtaacttcacacactggggcctttccggggatggggggtaaggggagggggagaatcaggacaaacacctaatgcatgcggggcttaagacctagaagatgggttgataggtgcagcaaaccaccatggcacgtgtatgcctatgtaacaaacctgcatgttctatacatgtatcccagaacttaaaatttttttaaaaaaagggccatagtggtttctgaatgaaaagagttagagatcactgatgtggtcatggcagacatgggatttgggctgagccttcaaacgtagataaaattcctataaacataaatgaacagagaaagacataactgccagggcagctggctggagtaggactagtacttccactccacatcaaccaacaccaccaccagtttggctggcatagagagaattaaatatcttgctagtagggtgtgtgggttgctcctgaaagttttctaatgaaaactcgagctgctcagatgttcactgttattctactaaaaagataatctgggtattgttctgtgcggtgtcagtttctaggacttattttctttatacttgttgtttgttactattccttttgttactttggcatgaatttaattattgacactggatcattaatgtggccagggcatttgggatgattggtcaggagacccagggatctgtaagaaaatgtcatcctgggaaagaggagatataacaagatattgaagattgtgtccagttcagggatattagtaaattctgagaaagatttgagtatcttcagcgagggtgagtttgaggttgataggactacgtacagaaacagggaagtcagacgtggcaacagttttagggccaaagtgactgaattcatgtggtatgtactgaaactgaggtgataaccatttatcccagtaaatcactgaatctgaggatataaaagctgaaaagagcattagtggtgatgtaatctgttcccaccattttacaagagaacaagtgagtcctagagcgagtaggtagtttgaactaccaagatcaggagtgaaagtcgtatgagtcatcactgcagagaagatggtcagagatctggcagtgaatcacttagttaaaatacagctctcaccacagattatatctgatcttggtgtgaagtgccaaaaaacacgtcattcagatctctctgtattttatattttctcctgacattttggaatgtggtggaactcttcaaaagactatcaaataattcctattttaattttataaaaggaaaattaatagcatatgtggggaaaatgtaccatatagtacattgtgggaaaagtgtagaagtagagaattaagggaaattttagtatgggtcatttatatattttggacacatgccatttcagtcaagtccttgagtatacccgtaagaatcgaattgataatcgtacttttaaaaaccctagcaacctgaacaggacccaagaaatagaattaaagaaaataataagccagaacttggcggtggttctgttatctgtgagcttgacactctttcctttttgtcctaaagtttcagactggaatgggcaggaatcaacagcaggggtcagttttaatgatgctaacttggtgtaacaaaattatttaggattataaaattttcttgatagagactgagattagtttttctgtaggaatttttgtttgtttgtttgttttaagaattgatccagtttctgtgatgaacagcagattggtggagctggcttatttagaatgacctgtgtaatattttttaaaagttctaaatgcatagtagtctcttagtaagtggttgtctctgttgttactttctaaatgcctttgattaaattgtaagattgtaagccgttaggaagcagttcaacatttctactctcagggacttccaaggttgatttggatctggagtagctcttctcctctgcctgttttatgttaatacatttggattattccggatggttcatggtgggtaagggaaccaatctcccaccatctaccctttctaaccagcagactgtaagcccacagaattgattaccagacagattcacacctaagcccatctgactcttaaagcacagctcttaacactaggaagtgctgcttcccggaggcaggattatagaagttaagacttaaccctgaagtgatttgctagttgattggccaggagctgcagactgttaccccaactcctgctccagatttcctttcttagtcaaatgcacacagtcctctctagcataactgtgaatgtgttagaaaacaatcaaaacttgtctggcaatgattcacacataaccaattaagtcctggaaaaatggattaaccagatattaaacattttgctgtttcatgggcagttaatatagtggaacttatttacatcacacgatggaaaaattagtgcaaaaaatatttttaagttgttgccttatcaggagagctaaatcaaactgaaaatgggaaaacatgaaagttcaactgccaaccacacaaatttgttttcaaatgcatgcttaaatgttttcagaactgaggaatcactggcagtttagttacaacttgaataactatacttctggatacttcttatattcccagaagatttctgcctcactaatagcttatggaaaatacttggccaataagctcatgctattataatttcagatttactgaaactattaaaaatgaagtaaaaaatattctgaataagcaacgagtaatagtaaatttggtttattaggaataatttcctctcaactttgaaatttatgtatgttatggaaaaattactggcattgaatttgcagtgtgtttaataggaagtcctgccttctttaagtaacacattcattaatctgatatgttttcagtaaaacaaaatcttaaaacccacaaagagcaaatgaccaatattttctctctctctatgtgtgtgtgtatatatatgtgtgtgtgtgtgtgtgtgtgtatatatatataatttgttactgaaactttttatttgctgccataatattatacatattgctgtatttggagtaaaaatatgactagagaaatatatgggcatttttttagtgatttgataaacccgtgtgttgcttttgggcttcatgaagcatctaggcaaattctttaagtacagtgatatattgttttggtctgtgcatggagttgttactggaaacttcatgtgtcattggagagcaatatatggccttttctatttcagagatgaagtataatgcaaaagcagatttgagatgacagtcaagaactgagattttcaaacctctagactttttaaatgaagaatatttatttttctttgtttacaaggaagtaactgaaatgatttgttatgcatatgtgatccagaaggtatctagcaagtgttctttaatgctagtatttccaggttacagttcctttctgtttacatgcacataaatatacacattgacacatttctgcaaatgaaatgcctattttagataactcatgtttactaactgcaatttgtgttttacatttccctttggagtttttttttttttaaatttcatggaaagaaacatgtagaaaattgtgttctttttaattactgtaggcctggttgagttcatggaatgaccctaagcaatttgtagtctttaaagaaaagagagaagacattacttgaagattttaaatcatgtaaaatgcatatattaatgtagaaaaccagttttttgatagctttcagttttgtgagaaatgttagccttcctccagtaggaagaagaggatttgcaatacttaacatttccttttctctggatgggcaacagaattatcatcttttagacaattttggtaaaataataattcaatcaggactcaataagttaagaaagtacacagtaattcaagcataggaattaatcttctgtagaatttttcaaataaatactagaatgttttaaaggttatcagttacctttccaaatttttggtcatccttaacatcattttgtcatttgacaccatttgctactaccactgaacaactgtctctttctgtagtttcattatgccacacattcctgaggtttttgcgcccccaaccccacttttttgtatttgaagttccaagggttgccagattagattttgtatgcccagttaaatttgaatttcatataagaagttaatatattttttagtatgagtatgacccttgcagcacttaactgggcatcctgtatttttatttgctaaatatggcatcttgaagtcctctgtcttctctaagaaggttttcctctctttctgcttccttgggcatcccaccaatccaagaccttgattctctttacctcctgatgagagtgcattgatgtggtttggctctgtgtccctacccaaatctcatctcaaattgtaatccccacatgtcagaggaggggcctggtgggagatgattggatcatggggtggatttctcccttgctgttcttgtaataatgagtgacttcttatgagagcttttggtttaaaagtgacatttccctgcctcgctctgtctctcctgccaccatgtaagatatgcctttcttctccttcaccttccgccatgactgtaagtttcctgaggcctccccagccatgtggaactgtgagtcaattaaacctcttctctttataaattacccagtctcaggtagttctttatagcagtgtgaaaacagactaatacatgcgtctaaccttatggaacaagttgtcacctctttgtgctgatttccagtccacatctctaaccttgcctgatttagccccaaatttcagaaaacctactataactctagttgcatctggtgctagtatctccaactaaacatgaccaagctgaactctattttgaatgctccagaccacgtatcccaattgccttcagggtttacattgttttcattaactgaaagatatcagtttctcaggttgtctatgccagggtcatgttagaccctcctcacaagacatctctcaacatgtttgtagagttttcatcaaaatggctaccacttcatcatctgcttttgagtttcattgctattatcctattcagttataaagtattgatggttcttggagtaagtttcttttctgggcccttctgattatatgtcccttctttcacattcctctacattctgctgctagattagtcttctttcatcacagtctcttagatcatgttccctggaaacctatgttgcatgcaggtttattggagaatgattcaggagacacagctataaggaagtgagaaaggcagggttgggcagagagagttgacccacatgaagttgtacctaaaacctcaggtgatcctacagagtgttccaagctgggttgagtttttagatttgtcaaaaattaaggccgagggccaggccattatgcccgaccatgctctcctgagtgacctttgaggtccatttcagagtccctctaatttctttgttcgtgtggctgtcctttgctctgtaactgccctctgagtctcctcctctctgcctcctcaagggcctggctatgagcaactcaccccatgagaggaggcagaaactggaggaggcttccacagctaagatctctttccaccaaatgatacagctgtggagtagctgaaggatgggtctgttggcaccaaagagggctgtgagatgagctccacaatgttcaccacaatcactgtcaacatttcactttcctgcttagggacctttggtgtattccctatactgctttatcaaggtaaatgttactattagacttccggggtcccatcattatctgaccccaccttgcctgtcactgaacccaatttctccctatcttcagtgtctccctccagtccattaagggttactcctacctggaaagtctgctctttagcttccttgagacccctgcccactcattgtccatgctgtaccttcgttcaggccttaggcctttgcttctgctatccttccttctggaatgtcccctcttctctaagtcttctgttcatctttaatcccctgcgggtgaatcaatcctgcttattattaatactgtgtaattctattattcattgtatactagctcttattttttcattagctccatgtatgctgttcttgtcttcagtatttattttggacgatgagactgtttttggtatttttggcagtatctagcagaatgctaggctcatagtagtgaatcaatgactgctttactccttgattatatttgtatatggcacgtccaaaatattaatactgaaagtggtgagataagatggagagagttttctagtaagattgtatttgagctccactggtgaacttccctgaaagaatttcagagttacatgtgtgtacgggtttgggtggctcctacatggatgatctgaagtaagagcatgaattaacagctgctgtttccctctcctcttatctcactttagtctcccacactgtgctgggaccattgcagacttggagtctcttctctgtgattccagcccaccttttggagttcacttcttgtcctgatgcccagtgctgtgctcccctccactccttttgctgcccagtaactctcttcccttacctgcagagcagcctttgccctggacattagcaccatgctctgactcttcctggccaactctccccttcaaaacttaggtgcataaatgaatgaactacatttacatacaataaaacataatgttgcctgaaaaaaggcagacacaaaagagcacataatgattgttgcaaagatggacaaaactaatatctggtgttgtaatcagtattgtagtaactcgtggaaggggcagtctttagaagggattatgaaaaggcttctagaatgctaggaatctttaatttcttgaccaggtgcagatttcatggatgtataatgcttgcactgtgtacttatgatttgtgcttccttgtatgtatgttatactctgacaaaaagttttaaaatcatttatctgcttggtaagctgatcactttataaactcttcagtgaacaggggctagtgtgttgctcttcccagtagtactaattaggagataatagaaatagaggaatcataaagttggccctctgtgtccaccctctttatggtggttctagggaggacttggaggctgtcaagctcatccagatgcttctggatattagcatacattaatcaaaattcatgttcaaagtcttaaatttttcttctaacagagccaagctaccagattatttttctttatgtcttattaattcccaaaggagatatctactctatcttcagaaataaagaatagttgattttgagtttcgttaagtattctaaatagaatgacaatttctgttttgaaaaataatttcccattgaatcttcaaaataactgggaaagaaagattgaggtagagttaacaattctgattgttatttctcactacatccttcaatttggatgtactttctcgtggcacaaaggcttccggcacagagagaagaagccctgttgggtttttccactttgacttgggtggtgtaaattaatgtgatcagatcggaaaggtgcaggaacagaaagtgcatgcagcaagttgtagtaggagggagtaggtatttcgaatcaaccaaacctagtcttcaggctgggcatcggcacttagtcagtgtgtgaacttaggcagactgtttaacctttcctctaacagagtggtaacatgccctctccctgtgccaagttcttgtgaagactagacaccctgagtatgaagctgcagattcaggctgtgatggttactgccattgtgacatgggactagaacagagaggacacacattttcacattgttattttgaatgcactgtatttctatattctataaagatggcacatagtaggcacttttcatatttcttggaaataaaaatgaatacaaggaaacaattcttgctctccaaacaataactcaaaattttgggaaagaaaacaattttatggccatatgttggtaagtagtacagaatctttcataaatacaaaggaactctaaagtgaatgaagatgcttgtgatgtgagctttgtcaggaacggttatattaacagatgtaggtgtgactgaagcttaattttggaaaatcagtcataatgacaatagacaatgttgattctacatggtcttcgagctgggcacttgacttcctgctttacatgtgttatatcctctaatccacacaactactctgggaagagttagctgccagcatgatctccattataggtgagaaaatcaaagcttcaggagaagaatgtcacttacccagaatcacacagttagtggaatggggcaggtgtctgtgtccaaaagcccttgtagccatctgcatcaacctaagagtgaacatggtgtttgtagggcatagtaccgaagaggttttggaaacagttgctctcaggaagctgtgagtcagttggagaattaataattctacctctgtgttcttaaatctcagcagaagagtagctcataaacagttatatcaaggaggggaaatcatgtggatgtagagtgagaactgattttaagttgctgctactcattatgtgctgtgcagccttggacaagttacttaacaaaattgagcatctgtttccttaaaatatccttaaacagggtagagagataatatactttgccatttttgatctatggggctattgtaatgatctggtggatttatgaaattgtcaagtgcaacaaagtaagttatttttgttaatagttcaagtaatagatgtggtgatggtaataataatatgatgatatagcaattattgtaataacttaaaatagtaataaaaatagacaatataacttggagtcagatggccacaaggattgaattgccttttgctggcaatatttcaaatattttctgattaagttgttttgctagattcgtagtttgtggctttggctcagacaagcaattaaattctcctcaggaaatcatgaaaggttacctttggttgtacagcctacactgttgaaattttggcttcaattcaggattcatggacaaattaacatctgaatcacttgagacctattcataaagaataggatgatgtatataactaaagcttatgtgcatagctaaagtgacttgagtttcacaatgaagctgggagatggagactatactcccgtactctgagtcacctactgcagggcagccatctatggggctgtgatggtgtttatatgtaagtgagcatcggacttggttggagctcgctgatttaatggaggatgcctccagtctagcaagtgaggtttgtaaagggccctgtaggaccctccaagaaaagttatgtataaaggagagttatactcatttgcaaatcatttcttaaagtaaaatgcccatgaaagtcagtaacaccatagtttgtttctaaaaagtaaacttaaatacttttagaggacttcagagctagaaaacatttatatcttacttagagtggtcattacccttgcctgccttgctgtggtataagtaatgaaattgtgtatacaaactgttatcgtggcagggattattattagataatttctttgtataaccttaaaaaatatggcatgttatgcaaattatacgaaatgtatttcttactaacataatttcagggtagtgtgaagctcaattttagggatttgggaaataaatgtgaattatttttattaagctgttttgctaagatgactaattctgaccaacaatttctgtatcgtagatctacttattatttaaaacttttattactcatgttttcaaaaagattctttgaggatagattaagtaaaaatgaccacacagtgtagtgtggtagttatgtctctgttagtcaaaatttctagcagttttagttttaaagatatgattagtcatctgtatagaaatttcaataaattgcttttgcaattatagctatcttagaagaatttcttccagagaagttgagtaagaatgccaattaattccagctgttggagtgaattgtatgtagaatgtctatgagttcaaccgtcagtaaactaggacaaagctcttaaatgttataatttcacaatcaaaaaactttgcaaccagttgtccacttattagactgaattattgaatgaagcattagtttcttcagtatttatttatatttatttatttttttgagatggagtctcactcctgttacccaggctagagtgcagtggcgtgatctcggctcactgcagcctctgcctcccaggttcaagcaattctcctgcctcagccttgtgagtagctgggactactggcgcccacccccactcccagctaatttttgtatttttagtagagacagggtttcaccacgttgtccaggctggtcttgatcacctgacctcatgatctgcccaccttgggctcccaaagtgctgggattacaggcatgagccaccgcattcagcctcttcagtttatttttaaagaactcagtatccctggcactgttggccatctctgtggagatactagttctagcaggaaggcaaggttgggggagttttttgttttttaaaaaggcttaatttttaattaaaaaattttttaaattatgttttttcattacacttgcatagtcagttatgtgtgtgtgttttaattgactttattttttagaactgttttaggtttatggagaaattgagtgtaaagtccagagatcccatatacttcttttccctggcacacagttccctttattattaacatcttgtattattgtggtacattcattacaattcaattgatacaattgatgaaccaaatttatacattaatattatctaaagtgcagagcttacatcagggttcactctgttgtatagttctttgggttttgacaagtgcatgatgtatttacatatctacatgtagatattacatacatgcagatatataatatctgcatgatattacagtatcatgcagaatactttcattgctgcccaaccccccaccccacccctgctgcctgtccctgtcttccatctacttacaccctgcttatacccatcccaatcccgtcaaccactcatgtttctgtcttaatggttttgtcttttctagaatgtcatacagtagaacgatagattgtatagccttttcctattggcttctttcattcagcaatttgcatttaaagttcctgtatatctttttgtgaattgatatctcatttctttttgtcatggaataatattctattgtatggatgtaccacagtttatttatttatttacctgtggaaggacatcttggttgcttccaagttttgccaattatgaataaagcagctatacacattcatgtgcaggtttttgcatggacatacattttcaactcatttgaatacttaatttccatttacctagcattgagatcaaatagacactgagtatatagatgaaggtcaagaaaaacacaccattcctatgagaataagaggtagtggaagatagaacacggagggtttaaaagtatgggtcctgcagaaacgccaacctgtcttctgccagtgggtaaatggaccatggggagaaactggaaggacgttttcttcttggttacatttcagaataatctagaggagtaccaattaagcatccttaatccattccaatttttgacctagttaattcaattcccagaaacacttttaaaatgcatttataaatttaatatatttggttcttttaaagcctccaaatgccttgatctaacaaccagaacttctccatgtgatagcttaaaagcttttcttgtaaacccaataaaacaaaatttgtatatgtagtttctcttaagcattctagtattggtgggaacctagtaaaattgttttatacctttcaatttaaaaatcacattttaaaataaaagaaattgatattacatgcatagtctattactatatcaaactgtcttaaacgtaatactttatgaactaaatattgaaacctgtccaaatgattacatattgattcctaaacttaacctccaaggtttaaatactgtgggtttgctttaaaataattatgtctgtatttaaaactaaatatttccagagtccttgtcacccagagtgatttatagttctcatctctggaagtggtgttgttatataacgtggtttaggtaacttaccagccagtgatctgagacctgttggaggtctgccatgtggacccagcagtattcttctctcccacccattgacagatgcttgacaccattttgtatagtcagtatcacaatcggaggattctaagtctctaccttgaagtaattatttttctaccttgaagtaattattttatttcatttgaatctgcattcttctgaatcgggagacacctaacttccttcagctaatctcttaaacttctcattgaattctctatttgtttaatattttttttccctattggttaggtcacaactcttaaaacttttgaaatctaatattaccgaattctccagatctctcacacctctgtctctgtagctatactgctaagatcttgctaatgacagctatgtctgactgagtttcctgtggagatactcatctgcttgttgaattacccactgacagaactgtaaccatgaatcatatgtattaaggaaaagtaaagaaattatactcttttacaattcagatgtttgaggtctctgttgacacgttatatatgaatgtatcctgtatgtggcagagcgagtttcaaatacaactaaaggtttttcacaaaagtttcattatgaagtactatattagtccagttgcatactgctgtgaagaactactggagattgggcaatttataaacaaaggaagtttgatcgactcacagatctgcatgtctgggggaggcctcaggaaacttacaattatggcagaaggggaagcaaggcacatcttacatggcagcaggagagagaaacagagagtgaagcgggaagtgccacacttttaaaccatcagctcttgtgagaattcattcactatcatgagcacagcatgagggaaactacccccatgtaatacctactccagtgacaatgtaggtattacaatttgagatgggatttgggtggggacacagccaaaccatatcattctccccctggcctctcccaaatctcatgtctttctcacatttcagaacccatcatgccttcccagcagtctcccaaagtcttaactcattctagtactaactcaaaagtccaagtccaaagtcccatctgacacaagcaagtcccttctgaatatgagcctgtaaaatcgaaaacaacttagttacttccaagatacagtgggggtacaggcattgggtaaatgttcccattctaacagggagaaattggccaaaacctaggggcttcaggccccatgaaagtctgaaatccagcagggcagtcattaaatcctttttttttgagatggagcctcactctgttgcctaaactggagtgcagtggcatgattttggctcacggcaacctccgcccccccaggttcaagcagttctcctgactcagcctcccaagtagctgggactacagatgcatgccaccacaaccggctaatttttgtatttttagtagagacagggtttcaccatgttggtcaggctggtctcaaactcctgacctcagatgatacacccgcctcggcctcccaaagtgctgggattacaggcatgagacactgcccggctagtcattaaatcttaaagctccaaaacagttacctttgactccatatctcacatccagggcactctcatgcaaagtgtgggctcctaaggccttgggcagctctgcctctgtggctttgccaggtagagcccccattgctgccttcacgggctggtgttgaatgtctgtggcttttccaggcctttggtgcaagctgttggtggatctaccattctggggtctggagaacagcggccttcttctcacagctccactaggcagtgccctagtggtgattctgtgtgggggctccaaccccacattttgcctctgcatcgccctagtagaggttctctataaggactcctcccctgcagcagacttctgcctggacattcaggcatttccatacatcctctgaaatctaggtggaggtttccaatcctcaactcttgtcttctgcacacccacaagcccaacaccacatggaagcctccaaggctccaaggcttgcaacctctgaagcaaaggcccaagttgtaacttggtgccttttagccatggctggagctggaatggccaggatgcaaggcaccatgtcccaaggctgcacagaacagcagggccctgggcctggcccatgaagtcatttttccctcctaggcttctgggcttgtggtgggaggggctgctgcaaagatctctgaaatgccctggatacgttttccccattgtcgtggctattaccattcggcttcttttttcttatgctaatctctgcagctggcttgaatatctccccagaaaatgggtttttcttttctaccacatggtcaggctggaaattttccaaacttttatgctctgcctcccttttaaacataagttccaatgtcagaccatctctttgtgaacacatatgactctacactgttaagagcactcaggctctgctgctttgctgcttggaaatttattttgccagatatcctaattcatctttctcaagtttaaatttccacagatctctagggcaggagcaaaatgacactaatctccttgctaaagcatagcaagagtgacctttactccagttcccaataagttcctcatctccatctgagaccacttgaacctggacttcattgtccatatcactatcagcattttggtcaaaaccattcaacaagtctttaggaaattcctagctttcacgcaactttctgtcttctgagccttccaaactgtttcagcctctgtccattacccagttccaaagtcacttccacattttcaggtatctttatagcagtaccccactctcagtgccacttttctgtattagttcattttcacactgctataaataactacctgagacttggtaatttataaacaaaagaggtttaattgactcacagttcagcaagggtggggaggcctcaggaaacatataatcattgcagaaggtgaaggggaagcacgacacatcttacgtggtgggaggagagagagagaacgatgggtgaggtgccacagttttaacctatcagatcttgtgagaactcaccattatgagagcaggatgggggaacctccccgatgatccaatcacctcccaccaggaccctccccttgacacatggagattacagtttgaggtgagatttgggtggagacacagagccaaactgtattaagtacaatttttagattagatttttgggactgacttggctctttcagcccctgtatctagtccatcagtacatttagtggctccacctgcagaatagatctggaatctgacagcttatcaccacttccttggctgccattctctcttgcttgggctctattgttatattgacacttgactgttttttttttcccccacccttttccccattatctgtcttccacatagcagttagcagattgtcattctaccactatcaatcctccagtagcattagtcataatagactaatagccaaattctttacctgtatgttgtagatcctggcttgtcctcaacctcatgtcccatcaatattcttagccacactggtctccttgtttttctttaatctcacagcacatgaggttccccctcagaacctttggacttactgtgcctcatctagtaactctctgccctctaatattattagcatgtccctctcccttatccaatcaggtctctgctcaagagattacctcctcaaagatgtcttcagagaatacatctgatcatttttttctgatttaaactccctctctgcccctccatacatcctaccctagttccagtcactctatggcctcttcactggctatttttatttataatacttaaaaaaggctggcattgttatgtatgtgtatttgtttattgttacaaatttactggtataactccagcacctagaataattcttggcaccagtaagtgttcagaaacacttgtaggagtaatcttctgtagaagtaatcttctgtaggagtagaaggactaatctccccaccttccctgatgcttgtagtgatggagaggcccaagggaaagttacacataagagaccccaatgagaacactgttattggacccatagctgattgacttaggcttcctaaagtagcttgtcattttcagcatggaatttacattagacaatttagtttttttttaagccactttacttaacaatttatagtaaaatacctacttgttaaaagaagataggtatgtttaaaaggaaaatacctgaaaataccttacataagtttgaatttttaaaagagtcaatcagcatggaaaaaatgaacatattgttaaatattgaagtatcattgataagtcttgtggttgaaagtgctatacaatgcaggaaacacttttcctctacattatcttaagcatgtgtgtgggccggaggtcaggtttaataaaaatactttagcttaagaacataggtcatgaaaaggagcttatgtaaaaggctttgaagaagttcttatagaggaagtcactcagtgtagtgggttacaatgccttgagtaggtcagaggcgatgagaaagtcacatggctagggccttggtgaatgtttctgggactgtcagtggtgtctgcatgatctcttctcatgctagtagccatttcccacatccagccatcaccttgtcacccatcatgtcagcacttagctgtcgactctgtttgccattgtcttttctttaaagaagtagcagaggagtgatattgggttattcagaataaccaggtctgggcatagcttcagcatttccacttcctgtctcatgagctcattttgttttaaatctcattcatgttctataaagatggggatgcttccaactattagttgattgataattgaaaacaacttcatttctaaaatttgtgaaaccattagtcacacaatggctataatatgaacaccatgtaaaggctctatgatggtaattgtacaatgtatctgcatgtcagaatcccttgggaagcatttataaatgcataccccagatatactgaatcagaatctttgaggctgaggtacaacaatcccatttttaaagtttcctagggactttgatatgttttcctgtttgcaaccactcatctgggggcacaagaaaagttataaggcatattttctgtcttcaagtctcttgtgtctagttcaaaaatgaaaatgagaacaaatggcccagttagacaatgcattggagttggttttctgtttgtgtgtttgattggtgtgaatgaagagtagtctagataaggcagcatgtggttggtatccttgatttattgttggataaagcaccagatagtctgactagtattgcaaggtttattttagtgtatgaatcattagtatggcttcaaaaatgtataatgttaaatagccttttatgtagcttgtatctccccttctactttcgaagctggcaagatttttaagaaaggacttaaaaatagacccaatcattttggtcaaatttgtttttagggtgaaaatgaacaaacccctcataccttttataaattggcttgcatttcctttcaaattcctgtaagaatgtaaactttggatatttcatagtagctctaataattctaacaacaatttaaaaccatttagaccaatttacccaattgccttaataaaaggctgttctggcagtgactaaaagaccccttggtggtgcttaaataaattattagctcttgatgtttgtcatcatatggtcttaggctcaaaatatcagtggccttctgaaactttattgtaaggacatttattaagtaaatgatctgaaaataagatggaagcaattcgaggaaattatgtctctactttgtatctctcatttagcatatgtacaattactacattttcctacaaattactttgaaagatatattaatcaacagtggtagtaggtattattagagaacaaagccatgattatcaaatacatttgttttgttaaaacaatgggagtatgtcagacatatagattgacttccttgaagacaagtgaaaagcaagtaaggctggaagctgatgtgtggagactgagaggggagtgatcagataaagtagggccttgtgtatgaaagatgagattttattaggactgtaatgggaagccactggagtaattgggaagaaattggaggttttgttcgtttgcagcataagttttaaaagagtactttgcatttgggtttttagtagactgggaagaaaggtgttggtagtttaaactaagtttataacctggagatggggaaaagtaaatggagactggacattttttgatggtactgctaatgggactttctgctggattgatccaggggataagaggaaataggaatcaaggccaaattctgggttttatttgtttagcatttactggaatgtattattttatgggaataacaggtttggggcagatctgggggaaatcaaggattctttgaaatggctatcagccatgcaattcatgatgtctagttggcagctgatgtataaggctggtgctcaaggatacactcaggctagagggaaaagctagagatttatcagtgaacagatggtctttaaaaccacagaaatagatgagattatccattcagtgaatgtagacagaaaagagggctcaagtcacagcccagggtttagatgttaggaggatgaggcagcaggagtgacggtgactgacaaggagcaaaggaggacaaagtaaacaagaagataaaggcattgaaaaaggagaaaataatctgtcagaggtttttgcgagacagaaactgactagaaagaatgaaagacatggatgccagattagagtaggttatggataaagtgggaggtgatagaggaatttgtaaggattgggatcttaagaaagagtaactgagaaatgattgttaagcgtgggtaagtgtggcaggtggggagtggagaacttgaagtcaagggagaattttataagatggtgctctagggtatgtttaaaggtaatgtcctagcagaaagagaggaagactagccagagagaacagataattgctggaaggaaggggaaggagagatggttgagtttgccctttgtaggagcagtggatgccaggctatgaatacaaatgcgcttaatacatgtaagtctctgtgcaagacaatgatagtgaaaatcaaagtgtgttgttgacaatgaagtgctaggtaaatgtgacatgatcctgtcattctgcaattacttctattacttcttgcctccctcacctcctcctcctgctcctctctcacttccttccaagtcacatatagtagtccagtgtacagtactagtacagtacagtttgtgggtatatattaagtcctgcatcacttaataacagagtgcattctgataaatgtaccgttaggtgattccatctttgtgcaaacatcatagagtgctaatataaaaatatagatggtgcagctttgtacatacctaggctatatggtatatagcccattgctcctcggttacaaacctctacagcatgttttcctattgaatactgtaggtaattgtaacacaatggtaagtatttgtatatctaaatgtagaaaaggtgcagtgaaaatacagtataagagataaaaatggtacacctatatagagcacttaccatgaatggagcttgcaggactagaagtttcattggtgagtcaatgagtgagtaatgagtgaatatgaaggcctactatactactgtagactttataaatactgtataattaggctacactaaatttattttaaaaactttttcttcaataataaccttagcttaccattaatttttttactttataaactttgtaattagaaacacttttagactcttttataataaccctgaagttaagatgcagacacattgcctagatgtacaaaaaatatcttttttctttatatccttattctataagctatttttaatatttcaatttttttcttttttactttttaaatgtctttcttaaaaaccaatacacaaacacacacagtagccttggattcatggggtcaggattatcaatatctctatcttccacctcgatgtcttgtcccactgaaaggacttcaggagcaataacatgcttggagctgtcatctcctattataacaaggccttcttctagaatacctcccgaagaacctgcctaaggctgttttacagtgatttttttttaacaagtaaaaggagtaaaggcatacactaacataatgataaaaatggtatacataaaccagtaacatagtcatttattatcattatcaagtattattgttctgtacataattgtctatgcaacccttttatacaactgccaatgcagtaggtttgtttgcaccagcatcacacaaacacaggagtaatgcattgacctacaatgttatcatgaccatgacattagtaggggctagacatttttaagctctatcataatcttatgtgaccatcgtcatatgtacagtacatcattgaccaaaatgtcattatgcagcatgtaactgtatattgtttctgtacctgctgagcagcaagtagaatgttcacctcatttgcatcacagattcttttgaaatacaagttaagcagccagtctccttctcaggaaaatacaaaatcataaaagcatgcaaataaagggtttctgggacagctggcacttgctccagagtaggagttagttttagagtttaatgggatagctggccattttccctcaggcctttggaccgtatggcaatgattattcctgggcattgtgatcacatgcaaaggttgtataagagaaagaatctttgctatggagagtttgttattaggcttgctacacttctgcaaaatattttaaataatatttctttctttcttttttcttttttttttttttgagatggagtctcgctctatcacccaggctggaatgcagtggtacaatctcggctcactgcaacctccacctcctgggttcaagcagttatcctgcctcagcctcccgagtagctgggactgcaggtgcccaccaccacacccggctaattaaataatatttctaagtgaaataaaattctagacagcagaatgataagcttagtgtattagaacatgatttcagagtcattccagattacacagaaagagatgggccaaactgtcactgccctctgcttttataatcaaaggctggatgtattatctctgtggggagaaagacatgttgggcctagagaagcctggccagagtatcagagatggacttagaagcccagcagagcctgttcttctttgctttttttactactggattctgccttcttgactctgacttgacctggtcaggggaaggtgggcagacagattcagaggggcatatgggcaccatctctggtgtgagggtatgcctgggttttgtaggatgaaccttagagattcttacaacattagtgttagaagacatattaaacatctagagtagtgattttcaaggctagggtgggttgcagatcaggattgtggtgaggaggggaaaggatgtgttgtttggaaaaacatatgtaggatgcctgttgtttccataatacaaattacaaaacacacactcaccaaagttccctctgctgcaacgggtatgacggtggtcgagtgttgcaggaagtcagggaccccaaatggagggaccggctgaagctgcggcagaagaacataaattgtgaagatttcatgaacatttattagttcccaaaattaatacttttataatttcttatgcctgttttactgcaatctctgaacataaattgtgaagatttcatggacatttattagttcccaaaattaatacttttataatttcctatgcctgtctttaatctcttaatcctgtcatcttcataggctgaggatgtatgtcacctcaggaccctgcgatgattgcgttaactgtacaaattgtaaaacatgagtgtttgaacaatatgaaatcagtgcaccctgaaaaagaacagagtaacagtgattttcagggaacaaggaaagataaccataaggtctgactgcctgcggggtcaggcagaatagagccatatttttcttcttgcagggagcctataaatagatgtgtgagtaggagaaatattgctgaattattttcccagcaaggaatattaataattaataccctgggaaaggaatgcattcccaggggtaggtctatagatagccgctctgggagtgtctgtcttatgcagttgagataagggatgaaatacaccctggtctcctgcagtgccctcaggcttactaggattgggaaattccagcctggtagattctagtcagactgattgtctgctcttgaaccctgtttcctgttaagatgtttatcaagacaatgcgtgcccagcggaacatggaccctcatcagtaattctaatttcgcccttgccttgtggtcttgctctgccctttgccttgggatcttttattgccctttgaaacatgtgatctctgtgacccactcactattcatataccccctccccttttgaaatccctaataaaaacttgctggttttgcagctaggggtcgccatcacggtcctaccaatatgtgatggcacccccggaggccccgatgtaaaatttctctctttgtattctttctctttatttctcagaccggctgacacttagggaaaataggaaagaacctatgttgaaatattgggggtggttcccctgatagttgagcaagaaagttttgtagaaaatttgggtgaaagaaatgcagagatcttgttccaggcattcatttaagaggtgaggaaatgaatcaagtctcagtggttgattgacctgcctagggattcatagttaatagtgtagaattgagactatggcttggcctccagggttctagctgtgtgcctttttgtactctgctaatgccccttgcctctgttcaagtaagtcattagccataatgaacagttttgctgtttcagtgtggtgaaatccacagcaagatagctttctagtgacgaaggttgtatacagggaagcccatttgctcacttcctcccaccccatctgttcttttccttagcatacagggctttaatgatctctacttgctgcaatgtgtctctcaagatttaaaaacaaatggcaaatttgtgcctcaggagtcttgtgaaaacaacatattacatgtaagaaacaaataattttattttctggttatttttcacacttcttccaaatggtatcataggatgctatgcctagtttccctttctctagtataaactattggttttaatgaaatatcatttattacagatagtagggttttatgcatttttttcattcagaatcaaagtggaatgtgttccaagtgcttgtgtgcatagtgaagttttttttcctttttgaaattgtttcttgtattatgttgttgcctcatgcctccatcctgtactgacagacgggtttgcttgctgggatgtttacttcaatgcagccaacatatactgcatgcctactgtgtagacatctagaaggatgtaaaaagaatgaaggatgtgagttaagctgactatcatttaaactttgggatgatgggataagagactggaaattacttgcttcagatgacaggctacatctattttccttctaagaggactgtcctattaccttgtcactgtcaccagaagctgtcggactttcaagctaagatgttctctactcctgtcttttctagcctggcaactgcctatctttgtttcaaagccctgtttaattttaaaggagtgaaaaagactgcggtgtgtgcagttttctgtgttggagagattggcagagtgattttccagaaccaaggactgagtggagctcaagtcttacttgttatttgatccataaagtttggaaagttcatgatccttaaaaagaactatataagaaggcttttagttttctttaaagccatagtgatttgccaaaaatatatccaaaagaataaccagaacaggacattcttctctaattaactataagttcccatttgatgtattaagatttaggtaagcagggagaacaagagttaaaataattctttgtcttttaactgtgatctttcccatcccttcctttgctagggtaggactggtggttggagaattggatacataagggaagcttgtggcctcagtccaagataggacaatatggtagttctggaagagatgtaggaattctgagtaatagtccaagatacctttctctttatcctttttcctgttttattcacttccactttgatgcattcccattccacaatcagtatgttttacctttacaatagaaggtgatacagactgcttaccatagtttctcttataccaaagggctacagctgttctccattgagaggtttagccaatattgcattagtagaaattctgagggattttctttaactttttcattgacattgtgtctgtttaaagtgcaagtgaatgaaggaaaaatacaagagagtacacactcatatgcacatacaggtacatatatggtggcatatgaatagaaaaagaaatgggagggaaggtatcaaactggttttctatagctagaatttgatggatttttgtgtttttttgctttatacctttagaaattgttaaacattttttgaggcaaataagttttactttcataatcagggtaaaaaaaagttttcctatttgaaaaataaaagttacagggaacttttagaacattgcaactattctatgtcttattgtaatggtggaaataattcatttgtccaaacccatacaatatagaaaacaaacagtgaacatgaactgtggacctcagtgaataaaaaagtgatcaattttagctcatcagctgtaaaaaatatagcctcctatgttaatactaggggaacctgggaagtgggagaggagggactatatgggaaccctctgaactttctgcttactttttttttgtaaacataaaactgctctaaaaataaagtctattatttaaaaataaaagtaatatacaatattgttaaatttggggtggtaactaaacatgttgcttaattgcctccttttttgttagttgcccataacagagcagttgcttacgaagcagcacttacctacagcagcacttccttatgaagtttctgataataatgatattttcatcatatatatatatgtacacacacacacacacacacacacacacacacaggtgtcagctttcccagtggaacaaaaggagctgggaagattctagtgactgtggttacttgagggtacttcttatattcttagtagttccagacacttgcttatggaaaagaggaaactaattttcatggagtgcccactctgtgttgggcactgcggtaggtgtttcgcatgtcctcatgcagcctttaatacaggtaccatccttacactgaagatgaggaagcagctgagcaagatcacaagctagcagagacaaagcctagaattcaaatcctatgtatttttttaaaaaataatcataacaccttggagtgcccttagcaacaagcatataacaaagcaacagagcaataacagcccctgcaagtttagttagaaatattttgaaaaatgagaaaagtactttaatagctaattgtatctttggatttattatactcaaaacgatgacacaggttagtttgttatgtactaggcaaatttaataccttattttatatattttcttacaagatgctattttgatcctatgaagccatcatttgacattttggcagtaacattaggcatctaatttcactttctttgttcctgtcaaacgatccccacaagtacaaagtgctgtgtcagactcatgtgaaaactttgaagagtttgaaataagacagcttaaagtgggaaatattctcttattagtgattggtgtgaaagaaggcagtgagaatgtgcaccagaaagtgatctggtactgcagcctaggaaaataaaggcagaaaggaagggtgttaggaacaagtggcacagattggagaaagcagaagctgctagaaagacttttgaaacaaaaagacgtctttctctcagaagaaccagagtgtgtcaggcacaatctggaagtaaaacccacacatctatgtgcgtctgtgcgtgcatacacatacacatgaatggcgaatggcagtttgttgcaaaatgtcaaatgatggcttcataggattaaaaatagcatcttataagaaaatatataaaataaggtactaaatttgcctagtacatagcaaactaagctgtgtcatagtttttgcaccattgcaaaagttggtacctggaaccctaatttgtaaaatttattaatccttctgttagtgtctgagttgaatgagggcctgaatttacaagtgaagagataaaacatttcctaagttgttgtgtggatctttcataggaatgccaaacaacctattgctaatgttgcttttattggagaggtttgcacagtgacaatatttttcctgcttgattttactgagaccaaagcatcactattgtgcttataagaaatgttcttctgttaattatttaccttgcttgatgtaggtacatgagataaattttgataattccttaaatttacattttcttcactaagagtgggagctaatgtttggcttgaggtcatatgaagttgatacaaccaaaattttgcacccaatactgctagttctcttctagctttaatattttggttcactagttcattagtctcagtccctttttccttaaaaaaattcacaattatagtttaatgtaactcatatatacttgtcacacaagaaatgcatatttaaaagtagtgatttatcttgatttttaaaaaattttgcagctttattagaaaattaatgacttgattattttattcattaaaattaattgatgataatcttaagcactgggaattagctgtgtccatctcagtaggttaaccttgtatatgtgagatatattagtaaagctctagattttaaggattaatgcttgttaggaaaaacaatacatctaatcatattcctcaataaaaagcatcctggaaagcacttgatctagtctccttagtgctggggctgtggcagggaattctttggcttgagacccatggcaaagttccctggggcagagacctggttctctagaaatgaagacacataatctgtgcatagcagagccaggagcagtgtcttgggaattttctgaactggaagtgaaagtccacctgatgattagagggaggaaaatgcttgtaaaggcatgctgtagggaaggtcaatagcctggaagaaattcagatgctttttatgctattcctgcctcagataatggagtttttgactatgatctatataatgtaatgtaatttttactgatatatatcccattgtcaaacttccatttatatagcatctttaaatttttactagggaaaaggtaagcattttcaccctattttcatagagctgccaagttatgactttggttttgtaatttaaaatgaaatggattaaaaaaataaattatcattactccttggagtgtccttggtaacaggcatataacagagaaacagagcaataacatgccttgcaagtttagccagaaagattttgaaaaattagaaaagcactttaatagctagttgcataggcacataatactggagcctggagggaggtgacctgtggaagtacagttaggattgggaattaggagaggtaaattctaatctgcttttgataaaccctgaccttcgtcaaggaatttaacttcccatcatctcaggtggctttgattgggggtggggtaaggagaaatacactttttagtctacaaaatgtagggtttggcctaatgatatataagctccctttcaactaatactgtgttcgtctggaacagatggtagaaagagcactggccttagagtcatgaggtaggacttctaaattcctgtgctgggctgttggtctcttctactctgaaatgaaatatgaagctagattattgtctcagaatttctagatagaaaattatctgttttctggctgtgttcatgtggtatttgcatatatttgcaaaaagctggtaggaatgatcaggtttcatttccaagctccagatctgttgttcatgtgatcttaaccctctctgcagtcaacaaatgaaggataagaaaatctcagtttttaaatcgtattggaaagttctttcttaaacttctcatattagaaagtttttggctgcaaatcacagatagcctttactcagatggtttaaacaaatatacaaacaagaatgtattgtctcacacagtaagtccggaggaaaggtgaggcttcagatggtgaagataacccttccccatctctgtggagctctctccttagctctggcttcattctaaaatagtgacccttaggttagtcacaagatggcagcttgtggcaaaatatctagcgagagagagagaaactttttctccttagcacttgccacactctaacaaaatacttattttacacgttccttttttgtgattgtctctctccaccagataaacatcaggtgggcaggatttttacttattttttttcttttgtttcagtgttgtgtctccagtacctagcacagtgccttgcacagagtagtcactcagtaaacatttattgaatgaatgaatgagttctcttaactcattacataagcgagtattgcattgcatatattcctgagtcttaaaactatgctttctatatttttgaaggcatttaatgatagatattacactatgtaaatctggttaaacatttttggacatcattgtttttattccacttgttttaaaagtttaattttacttttcatcttctaaaactattatatagaaatattctgggggaaatttaaatcagaaaattgattaagtcccttatttgaacttatttgaattactcttgttttggttttctttttttttttttaagatgaagtggtagtttaaaactacaaagaaagaaaatatccaagtttacatgtatggcatataggcaggtagaaattgtttttgccagctcacttttctggtgtcacttacgtttgaatacattcctagcaaaccttctcataagacttgtagtacattgtattattcgtatcacaggtaataggcactactcaatgctaaccttttaataggcatgtacatttttatttcaggtaatctaatatctgtatgaggttttctgaaaaaataaaatgagaatttttttgtctccttggtgacactattatgtcactaagttagggtggcagtttctagccattaatagctgttctcttaagctctcctagaatagtgcattcagttagttttatgtgaaaggacaccatcttttccaacagtaatctattctgtgtattcctgctggatgaaccttacagaggcccaccttttatttaactctcctgtctttttttatataaaataataattaaactccataaaaacctgaagaatgaggacccaaacctttgtctccaactttgtccccattactttacttcaaacattttggttttcaaccaaaataaactacatattttcccatctgtgactcttcttcttcccccaaactcaagttccttgagcttagaatgctgcatctcattataacatatccataggttcctccagagcagctcatgtgggacctgtactataaggttccacacttggctccattgggagttctctctcctatttctccattgctctaatatttcagttgttcagttgttacactctcatgcacttacaaagatctgctgtaataaagttatttatggctcttctcacccacttaagaggagtagttttgctttaagatccttctttgaactgccagtctgtgctgttgctgaacatgttcttggctagcttcaggaaatgtttgaatggagacagactcattttgttagaagtagctgatctgcacatttccatcacactaagcagtaccccagattctaaaatgggaaaaacatatctatttatttattgaggtagtaagaacaaaaggaaaaatgtaaaaacctgtcagtcacccagtgccccatgccagagtaggttaggaccaggatcagggaaatgggtaggtgtggccaaccgtaggtgtcatcagtcaccacctggttgtgggcccatcacttccctcggttttatgaggtaattcacttggaaaggatgaaaatcacctgaataaccaaagtggcccccagcatcctaatgttggggcttggcctctgtataggctcctgccctccacatcaccccactctccttcctcccttcacccttatcaggaacagtttgctttctggttggtccagtccatttccccaaagctctcctgtgtggagtagaggcaagcagggcctgattgctcattattctctttccttttaagatcccagcagaagagtttttgggtggcaagaatacttatttattttggttcaactgctttatcttacttagggaaggagggtttgtaattgtatatatcaaaacatttctctaggcaggttatgccaagcaatctggaggtgttcttggatgcttgtctactccagagctaacctacgcatagtatgaattttgcttatattccagaaggagtcaaatgttaaaagttttttggcatttgctatatctttccatatcttccgaggttagataatcacaaagagaaataggtggtcaatacatattagctgaataaatcaataaatactttgttaaataagtacctgccttagaagagagtagaaagcaaaggaattaaaaaatattttaattaatttttattagctacatttataatataaaagaatagattatccagataaaaaattaaactaaataattaatattaaataaacagtaaaccaccaatctacccatactttatcccctgagctctgttttcttccacatgggtaatttcttttcatagcttgagtacatccatcacctctactttctttttaaatgcatacagttctcaacttgatgtttttccccatagacatgttacaatattggtagttagagaactatatttttaaatatctacatgatttttatgttatataaatgtaccatattttatttaaccagagtaaattttatttaacacaataaatgacagtttaggttatttctaatattttactgtttatgaagaacattgaaatgaccattcttattaatgtgtctttgcttatttctgcccctgtttcttaaaagataaattcccaggagaaatgcaggttcaagggctacgaaaaatgtaatttttttaggtgtttactagtcttccttcccaccacaataactctgacctcaaagagtgtccaagtgtatttatttgttcacatccttgtcagtgttatcattggattaattttattctgagtttcatgcattaattaacgtttatctctgccttcctcccattctgtttgttttgtgtgtatgttgggggtggggtctgtcaaggcataagcatgttttctttttttttcttttgacagagagtcttaacctgtcgcccaggctgaagtgcggtgacatgatcttggctcactgcaacctctgcctcctgggttgaagtgatcctcccacctcagcctcccaaatagctgggactgcaggcttgcatcatcatgcctggctaagttttttagtagaggtgaggtttcaccatgttggccaggcttacctcaagtgatttgcccgccttggcctcccaaagtgctgggattacaggtgtgagctactttgcctggcctgagccacagtgcccagccagttttctcagactttaaactctgcagtgtttcaggtagaagcctggcagtatggcctgggaactagacctgactcttggcccagcttggctgttggctctctgttgctaccttgaataagtgcattttatttctttattcctcattttcctggggggtaaatatcaaaagtttaatacctacttgactttttttctaagcctctgagattgaattggagcagcagagggctagtgaggggaggacacatcccaaattggatgattttcaacattctgagccacattagtcttatctgaaaaagtgcatcaaatgggctaaatgtctttcagtgtctgattaaatctgccaatcaatgaatctgtattcaaagtgatatgaaagaaacaaatgtcccatgctaataacactaagaggttcctattccatctagtgggtttcattggggctttgaaataaataattgaaaattgatataattttatttttgcctattcgttggctgaaattacgaccatccacaaataccttcttatgtgttctccttcttgtcccttttcttactctgtttattgatttgtgggacacataaaacccactttaaattgtctacttccagtttcctcattgattgagtttagatgtttgttcttgccaaatctcatgttgaaatgtgattcccagtgttggaggtggggcctgttgggaggtgtttgggtcgtgggggcggatccctcatgaatggcttggtgctcttacggggcagtgagttcacttcacatctggttgtttaaaaaggagcctgatacctccccaaatcctcttgcttcccgagcccttgcttcctctctcatcatgtgatatgctgctcgctcttcacctcctgccatgacagaaatcttcctgaggcctcacaagaagccgagcagatgtgagtgccatgcttatatagcctgtagaattgtgaaccacataaacctcttttcttttgaattacccagcctcagtatttctttatagcaacacaaaatggactaatacacttataattgttactttatcttatcttggacaaagtggtgttaggtttttacacatgacattcaaacattaatttagggaccacaaacttagaggtccagcaataatagggtataagagctctgcgctcttggggattggagagggtggggagccatagcagtgatgcttgttgaaggggccagttgtgtagctccagccacataacttttaccacatcgtgaagcacaggatggcagaggttctgatttttatagaaaagccagagtgtttatttatgtgaaaatttctgatctttaaatacctgacaaagattaaaaaatactgcacagggtacttaaaccaagtctgcgggttggatctggttctactgtaaatccatgtatggttagaacatcgtcttccttttcttattgatactgtcttattgttaacaaacttatctcatgctgaataaaatgttgggatacaatttcagtttccgacatgtgcttttagaaataaatgatactttcaaagcaaagcttttaccatctttccataatctgaaatgtgtgtggaaataaaataatgcctttttagttatagcattaatatataacatttcacccacttatgaaaggaaaactcctaatgacatcctataggatatttctttgcttctttttaaaattctgtgacatctataatctccctttgtttgtcagttaataagaaaatgagaatggatttattttttatcagtgtattcagggtgaactgaatgcattgtagtgagataaccaatctacagcagagtgcaatgctagatactgtgctccttgcagtgatttatggaggatcctgtaatgattttatttttcttgttcatgcatgcgttattcaatcagcacttaataggcattttctctaaactcagcactgaattgagtgctatgggcacagcaggagtaagtgtaaataatgagtgagtgggggatatagacaggtgggaataggtcatcaggttattataatactgtgacaggacaacactgctgagagaaggttagaaaaggcacctcacttaaccttgggggtcagggaacacttccaaagaaaatgataactaagttaagatctgaagagatggtgggaattggtgaggcccagaagctgtggaagagggaacagaaaggacaatgtctcctaattttgaaagaccatgggggattgaagatctgagaaaagcaccatatggctggagttccaagtgtgatagggagtcgggagctgcatggagacctctccatcaggagcctgttgtgcgggctcttctaagtcctgttaagcagctgttgagaggttttaagaagagaagtgactagatcagataaaggcatttttcaaaagctgatttgagcagcagtttcctctttagctccccctttacttattactgtcttcttaaacctctttagtccaggtggtgatgctgcaagtgaacagttttcacaacaatcaggatatatctgatgtccttttagtcttcttagcttcaggtttttctgccttccaacacctggaaggatatgaagataaagggaaaccatgaccacagcaaaaaaactaggaatggatgcaagaaaactaagacaaaaggaaaagcagaaaatatttattttattatgaaaatggaattgtactgtgtcaggaatcaggaggccagaatttgagacctatgaccaaattcttttatattttattgtcctcaatggtcaaataaagggttggattggtgtgtttgaaggtgaccctgagttttacaattctgtgagggttatttcagttgtgcatggtgaatcaatcaccctgtgtatcagtcaaattacaaatatattcagtgcactaagattttatatatatgtgtgtgtatgaatgtgtgtgtgggtaatgtacatgaaacaagatgaaaacttattagaaagggaagcatgggtcagtagaaggttgagtgcatttgagaagatgatggtaatgctaataatgggtggatgtttgccatagctctcaggagctgcctgtctcttatggaaaggcaggttgtatgagcaggagctattgtcaataccagtcacaagtgtacattgcagagactgtcccctcaactgtttgtaacccaaactgtccaggagtcagatagtttcttacctagaggaatgtatgataaggttacctctttctccaattcctctgtttgacagtgcgtacagagatgcaagatttctggagaatttaaggccataatagagaaacctgtttttcttcccctttgtcattttcttgaatacctgttttttttttaattattatgacaatttgaagttaccttgctaatttatttattattattatttttagagacagagtttccctcttctacctaggccgaagtgcagtggtgtgatcatagtcatagtgtaacctcaaattcttgggctcaactctcactctgtcacccaggctggagtgttgtggcgtaatcacagctcactgcagcctcaaactcctgggttcaggtgattctcttgctttagcctcccgagtagctgggactacaggcatgtgccatcatgcccagctaatttttatttgttatagatatggagtcttgctatgtttccgaggctggccctgaactcctaagctcaagctgtcctcccacctccacctttcaaaatgctgggattacaggggtgagctgctgtgtctggcaaatcttttaatgttattattttttgtattgaagtagtttccctagtatcaaggagatttaggatgtctttattttcagaaaaagttggaaggagaataatctcaagcttattaaataacattttgctatatgtaactttgcataaaccattttattatcacagacttctaaatgctgaacacttgcgataagtcactctaccctttataggtatgtattcctgtcttgcttttatgtatttccagatgtagaatagcctctttcaatgctgcattagctggaataatgtgaagcagaaaagttaaacagttaaaaatgaaagaaatgagcccactcagaggctgggactccccagtctttgccaccatatggttggaaggccttagtgccttttcttagattaaatatctcataaacaccccgaacatttgagtgatgctagcattggccaagcacggttattagcagccgagcattaccggatactgacaaggaggacaggtacaagtgatagagaagcaaattgggactcagtgtattagtgacattcatgtaagtggcagagctcgctcagggctgaggtgaacttaggtgctcacaaggccactgctgagtagagtcagcctgagggattttaaggcttgtccaggcctaggaggatgactgcctgaaggtgaactgacactttgggtaacacaggctctgggactgtgggccttccaatgaactgtgctgtactttgtagttttttcagctttgactttgtttcagtcaaatgaagtagtggtatgtttgaaattttaattcagctccaaccaaaatctgtattcattttttatggtcttttctttctcttccttctgtgctcataatctgttttcattatgatcagatctgctgattgtatatgtttatcaaagcactggttctaaggtaatttacagcaaatcttactctttcacagattttagaattgtagtgggattggaaaggccatataattacgaccttatcaacagttcattaataatgaaaaactttgttggctgacattttttgggcttttcaactgaacgggaaaaaactgcacacatcaaaataccatcaaattttcagaatgaagaatttcctttgccttctagctcaagactatcactttcagtagaatctacctcagtagctttgtgtgtgagagaggggaaacccaaggaagaaaagacaaagacagacactagatacatgaactgagggactgacttagctgtttctgttgatatgcttgtagagcagcaagtaggttgaagtgtaactaaatacgtaaacacacaaacacacacacacactcacacacaccataaacatgctacccctctccctctgtgagagccatagcacagtgatttttaaactttaggatgtgtaaatgttaaatggacagtttggttgaaatatggaatataagcttcatgagaacaagagttttttgtctgtgttacctctgttttatctccagtgccttgtggttggcatgtagtagatgttaaataaatatgtattgggtgattcgtgggttccatccttataaacttatatttggtagctttgggataggactccatgaatctgcattggtatcaggcacaccagttgactttgatgtagttggttggagggccatactttgagaagcactgcatgatgagcctggagctgcggctgttgcgaatggtgaatggtctgtttctccataaagggaggtgggttctaatttgcttaagaatatgctgcagaactaccttgttttgtggaggagtctgacagtgctttacctcttgaccacagtcttacaaagttgagtatcttatgtgcctttgggtgctgggacttgtagccatggcaaaggagatgttttctgactttaaacttatctgtagaagatacagatgtgtaaatcttatgtgtaaaagcatacaacaatagctattcacatacattcatttaaagagaggttgatttaaatctattcagacagcaaggtcaggcacagtgtatcatgcctgtaatcccagcactttgggaggccaaggtggaagaatcacttgagtgcgggaattcgagaccagcctgaacaacatagcaaaacctcatctctacaaataactagaaacaaacaaacaacaacaacaacaacaaaacattagccaggggtggcggcaggtgcctgtggtcccagctgctcaggaggatcacttgagcctgggaggttgaggctgcaatgagctgtgattacaccttgcactccagcctgggcaatagagcaagaccctgcctctaaataaatacataaataaaatatacgtaaatacaaatctagtcaaatagtaatagctaatatgatatgaatggttattcttcttaaccagaaaacataaggggcttggtgcgaaaccactcatctttttttttttttcaatcacatactttgtagtgctcttgttaactgtacatgtaacccatgtgtaataaagtataaaatagttaaaatgaagcaaactgcctaacggcttttaaacctagtttttatggccagaccaagattaaaaaataaaaaacctgttatcaggtcttgcagaaaccctcagtccctaaattgtctcttttcctcctgaagacagtacctggattataatcaacaccattcccatccttgttgctaagtacatttcctttccccagaagttactagcaagatgtttgcatttaagaagagccacatgtctagcatttatgtagtacctgcatttgtttggatctttcccatcacaaataggaccaagattaactagagcatggaacagcagaagagggtcatttacaggttgaactagcagtgaatggagacagcaagattgaaaatgttttgcactgagtaaattttaatgcaggaaagtaactatttagaaaagaaacagatttaacatgttagattaatatgtgatatgagagcaaattacaggctgatacagggtctacagtgtaccaggatagaaaaagagatccttaatatacatatttccaccagtatccaagtgaggagggattagaagtgaagaatattactgcagttataatgattcattattgtattatagttccatattgtataaacacctgtatgctttttatttaatagtgttgtttcagttctttagcaaattcacttgtaataaaaacttttccagatatctcctttttagtataaaagcaatatatctttatcataaacaattcaaatgatgcagaaagatatatgtaggatattaaattatttctatatctcttctcagctataactataatttgatgaatagattattcctttttaaaaatgcagtcaattggtggtgatttggtagcagattaactggtttgaatattaatgttggtaaaaataacaatacatttgtgaaaaaatttaaatgctttgaaccaggtaaattctactaggttgaaccacgtacaattgctgtgttagtaggtaaaaaatgtcaaatattggcagtttcatgtggtcaagctgtagtattagaggagtgtgttctttacagtgatttagtaaccagttgatgtgggcatgtgagtccacaatgtggaagtagcctgtatctcaccgctctttgccagtagtcaggtgacagataaataggtatcgatgctaaggaagggggaaatggtttaggctgtaatttccaatatcacatttcagttctatgatgttagggaaattagagagaagcagagcaagagaagtgtgtagtgggattgaatttttgcccatctccaaactgaaaaactcttaagaagcaagtgaaaacagtacaccttttcgtagatataaaacaacttacatgatattttaaaagtattcctaacctgttgtattacctttccaattttggatgacatctggtgaacaaaaaacatctctaaatcctgaatgtgattttagctaaattaaggattacatgacaccacatttattttaaccttacgtttagagttggctatgacctctttcctccataacccacagttgactctttgtacatatgtgtgtataaagaataaaaagcaaatatggggtccaacatttaattctattttttagccctattcctctattttttcattcattagtttatggttctgtgtgtggagtgtttattgtattagatatcactaaggagaaggtccagattgatcacagtcacagtgtttatcattgctcttccagtgtttaggccaagcaggcagcatgcattatagaaccatgaatgcactaacccggagctgcgtatcagtgctcagcgtacgcacatgttctttctctgctagactgtctcctcattacagacagttaaacaagcaatcctgtctcttttgtgcatgcaatttttaagtcccctctttatatttcccctcagaatattttagctatgaaaatattcagactccactggcaagtaagggagatggaacttagtagttaaaagtagttttactatttgtagtaaaagtaaatttcaacagccttaaagctgtcaagctgtgggcttgaaaaaaaagttgatgtttgttgtggttgtagcttgagatatagttgggtccttaggtttcatgagtagtcattctgggaaagtcaggcagcaatccctctactccactctgctgagaaagaacacataagatgaaaggagcctgtgaatgtcttttttctcccagagactaaaggcgaagtgatggcggatgggctgtgtgtctttgtaatctcttttttcctagtaggacatcaaataatgatctagaaaattatctcaaatattaaaggtttttttcccctttattaacaatggttttggaaaaaaaaaacacaccactacagtgggtatctgataaaatgaacttactctgattttctgtattatctcaaaatttattttaatcatgatgggactagagtttggatgaaattcatttcttccaagttggagtgaaaaattaagttgtttattctcaaagtgggatgccaaggtttgagtatggctgcgaatatgaatctgaatccttctgccaacctaagggaaggctccttgcatccctctatcctactgggactttgtcagagcacagctacctctatgagcaaatgtttttctgtttttgtatagttttgacaccacagcccctaaactattgttataattttcacccttaattctaattacaagtcttttgcatcatgtgcaattttaccttttcaaatctcactggtgaaataaatttaaaacattgccatatgtttacctaaaatttatgatgaaaccaaggatgcttgaattactaatgctaatgttacaggatttttgtagataaacaatgacagaataacatgtcttgtgtttatgatattattaggattacatggagtatgattttgacagtgcttgtcttgatgagggagacacactggctctagaacttgtaggtgttaatctctggactgacttggcagctaggagactcccttgccttgctaacagcaggaactgtagtatctggcacctcactgggaccagtggctgctgcctttggcagcctcaaagttagtcatgtctgtcacctaccgtgatgttggtacatatcgtaggctgttttctgtccattaatgccatttttctgccatcagctttgaaattagtggctctgtgcttttccaagtatgaattcattatgttaatcttaaaagcaagagggcttgtttcaaattcagatgttggtatttatttaactgacagtgtgtttcaaaagtttatataaatatgttttgaaatctaaaatctgtcataattattgagatttattaggatgtaatgtggaggctttcaggtttcatctaagtggtcaaaaatataatatgaaaaatgacttgatgcttttctataatattagtcactttcaagaaaaaacattttcttcttaagatgaatgttggcaggaatttgattttactgaaattgtgggacaaacacagtaggaaatgatgggtgtgaagatattactttgagaagtgagaaacaatttaggtgtaagtggtaagagaagaaaggcagtaattgggggaaaacggttaaagaaaatcctgtgtcaaagcgtcctctgggtatgagattctcactgaagtggaagctttaatacctttatggagttgttgccaataaggatggatcatctctgaatttgacaacctgaggtattaacttgaaaaatggaatttgacaagattgcaaataatgttcaataatatgtttccaaaacttgcttcacaaagccatgtgcctttcttacaacatgatattcaggggcccttaattcatttgatctgaaaagttcccgtgcaggctaggtgttatgtaccataccttgccatcatttaaaaataccctgctgtggtttgaaataatgatctctgaggatgtgtgcacctcagaagactggtgcagaagcaagtatcacttttaaaatgagcctatgcgatccccagattaatatctgaaagctagctacctaataaagttttaattgcttaaggctactgggctagttgaataattgaaagaaagaagattgtaaattattagaattaacaatactaaactctgtggtaaatgtatagtgattgtttcttcaaagttaatgtgctgtgattttactgttattgtaattactttctcacttgagtgctggtttataaagctcagataaaataagcctgtagatatttttacaataaggtttttagtgtgcaaaactaagtttctcctggcagatatgtgtagggcagaagagaagtcctctctaccatagttagtgtctacttttcttgcctgggaatatacattgttgctccagattcagttccggagggaacacccttcttattgccttccccaccgatcagttatcagactgccttcttttgaccaatatatgtttataaaagtttatatttggattaaggatttaatatattgttatgaaacaggtttgcttggggaagacaatggaaattcatagcagtaacaatagttctgataacacgagttcaccttcgtggaggtaatactgacagttagtgtactactaagtcctaagtactttatttttgccttctctgatgactgtccagtgcagactcatttgcatggtaattgtgtatctaaaatattattttattttagtgaaatattaaataattgaaatttattttaatatgttaaaacatgggtaaatctcttttattttttaaaagactttacattttagagcaggtttaggttcatagcaaagttcattggaaagtacagagagtttccacatattttccatccttcacatatgcatagcctccccagctatcagaatccccaaccagtgtgatacatttgttgcagttaatgaacttggaataacacatcattacccaaatttcatcatttacatgaaagttcactcttggtgttgtaaatctctctttaaagatatggccttgctgtattattatttgccaagggatcaaggacctgctcagggccaccagtgtcagcaactagattctgaataaatatttgattaataaatgaattactacaagttattgatagaatataggcagaatgtttttttgttttttttctcttcagattttataggttcttaacaaaaaaccaaaatgaagacataatgtttttaatgtaatggtaaagaggaaacttctgtgttttgaatactctacttgaattgtcattgctgtaaagagaaataattttgattatttttgtttttactcaggtatgaagaatttattctcaaattaatactcatgcttatgagtgtataaatgctcatatattgatttaataaaggtttctgttacttgataggatgggctacttgcattgtacaatttttttttaacattttcccctgtctttcacagttcttttattcttacacagagttagaaagatgtaagactaaattcaccacctaaatttaataaataatattttgtaaatatatttatatcatttgaccccataattctatttttcacaattattataaggagataatccaaaaggcggaaaactaagtgcccagtcacgtcttttgtggtattatttataaacataaatcttaatctaaaatttctttaagatgagcagtgttgcaaagaatctgattatggggatgtgatgtgtctcattcctttttttttttttttttttgagatagagtctcactatgttgccaggctggactgcagtggtgtgatctcagctcactgcaacctccacctcccaggttcaagtgattctcctgcctcagcctcccaagtagctgggattacaggcacgtgccaccacacctagctaattttgtatttttagtagaggcggggtttcaccatgttgatcaggatggtctcaatctcttgaccttgtgatccaccccgctcggcctcccaaagtgctgggattacatgcatgagccaccacgcctggccgcgtctcattccttttttcaatcaaaggaaaggaggcttgcattgaggaaggagtgcagtttaagaggtaaagccagctattccttgtcaaggtcttgaaattgctagcattagcagctggtcctctctgggtttttagaggagtagatacccagaggccctgtgtggaaactgagttttatcagccagaggtttgggcgtagtgctagtctcagagtcaaaggaagattggtcaaacttgaggaagagctactaggtggcagcaggctcttcttattcagaatagccaccccaacccctgaggaccccagatgcatgacattcagtaaacttgttgagttcttactatgctttagaccttgatccaggagcaagatatatcaatgggggaaaaaaaagattactgttcctatgggagaaggggtttggaggacaattaatgatgcctttctgatcttgaatcttcccactcatactcctccaaaagtcataaatccaacaaggagaacaaataaaaacagacaactcataccttcaagagcattaagagacagcaacaagcctgtgatagcaaagagtgacacaggggaagctgatagaggcttaagaagctgtgaaaaacagtacaggggtgtggaggacttaatcaaatcacaagcaaaattattccagaaagacaaaactgggatgctgtgtagttcattcacagcactggatgcaataaaggaggctgaaagtgactggaattggcagctgttggaaagcattgcctctaggggagagtcaaacggtggtacctgttaagacaggatagtgaaagtaaagaaggaaggaaaagggagaaattaaggatcctgtggaaatgaaaaagaaacaagacaacccaaacccttcttctttcgtctcccagtgccagctgtaaaaagtacatagaagagggcaaaggtgacagaaaaaaagactctcagattaggaaccagttcgttcattaaataaataggaatagaataaagtagcccacatctacccaaaacgactctcaaacattgaaaatagggattagtgcattttggttgcaaaaactcttgcaataagtcaactgtaaaattaaaactgtgcataacactgaaatatgaattgaatatttgaattcatgctttttggtgtatgaaacaaacaagcctacctttagttagaagtacaaaagctaagtagagaaatggacaaaaaataaaatgaaataaaattagagttaattgaacttctggcaagaatagaagaaaagaaaaaatcaaatcagaagtgaagactaaattgcaaggtacctaaaggaaaatcagattaaaatggcaggtggtaacccaacatattaatatttacattgaatgtaaatggtctaaacatcaaaatgaaaagtcagagattggcaaaatgcattaaaaatatgaccaaaccatatactgtctacaagaaacttcaactgtgtgatatcagtaggactgaaaagaaaaggatgggtaaatgctaatcaagagaatggtggatgcctatacaaaggggacttcagaacaaagaaatttactaggagtaaagaggacattacttattgataaaacggtcaattctcaaagaagacataccaatcctaaacatgtattcagtaaacaacttttataatacaaaaagcaaaaacaagcagaactcaaatgagtaattgacagatccaccattacagttgaggatgccaatatgcctctctcagtagttcatagaaccactattcagaaaattagtaaggatatattaatagaagaactcaatgatactattaaataataggatcaaattgacatttatagaactccccacccaacatcagcagaattcaggttccatacctatggaatgtataccaagataaaccatattctggataataaactatacaaatttaaagaattggaatcataccaagtattttccctgatcataatgaaacctaactagagattaataacagatgacaggtaaaataactgaaagaagttttatctgaatgaaaaccttgtttttctggccaggcactgtgttatacacctgtaatcccagcttgtcaggaggctgaagaacgaggatcacttgaacccaggagtttgagaccagcctgggcagcatagtgagaccccatctcaaaaaaagtcttgtttttctacccttcattttgaattgttattgacttggaacatgtgaaaatagatatctctcatctgacagtgtgccaaaattataatggtatatattagttgattgttatccacgataaattgtttctctgtccattttgttttacagcttctcttttaaaaggactaaaacatgctaacatagtgctacttcatgacatcatccataccaaggagacgctgacacttgtgtttgaatatgtggtaagtaaaataagacttttaaatttagacatttaaaatatgaatgaaattcttatagtgttgtcatagaatttcgtttttagattgctgtactgaagttaatattttatctgaatacatgagaattataattttgtataaaataaaggccctataagagattattgaatgatatgtatcttaaaagaaaaacccagaaaaatgttaacttgaatttttatcagatatgttatctatttataacctatttgttactaggatacattgtaatttttaggtttattacataggattcaacagcctgatggtgatcattatcaaagaaaactcataggcaataagaatggttttttatttttggatttgtaacttggtttctcaaaagcatgcttattaagatatgtgtgtgtgtgtgtgtgtgtgtgtgtttgtgtgtgtgtgtgtaggaaagcctgatacaatttagacttcaaagttttccccctcacttggtatttcagctattaattagaacttccaattgcatagtacacaatgtaatgatcttcttatgtgagagtattattgctagaagacttggacttgaactcataattaattcttctccatttctcttaaaaaacatggtatttgtgtagcactacttcagcatttaactgtggaatcgtgaaatgtaactatgataattaacatcccaattttcacagatggatctaagaacatgtaatttataagacacaaatgacatcggtgcagacatttatttagaatagttgttggtattgtcagtgtattaggaccccattttgtaattaccacactactttttaaaaaatttgaagtactttccatttttccttaaaaaaaaaaagaatgaatatttgcaacatttttattttgcttatgtctgcctgtgtctgtcatttgaaaattgtcttatgaagaagccgtttatcttgtctatttacatataaatgatagatacatttgaataatatggtaatgtgactgcaaggacagctagagctgagcagttgcatatattatgtggtaccaagaatggatgcagattcacacatcaatgcaaacataatttcttttgtttaatccatgatttttgagttaataatgtattccagctgatttagacttggaacttttgattcatacttttaagtatgtctagtttacatatttcagttaaatctagattttctttactatgcttgacttttacagtgttttgtagaaaagagatttcaaaaatgtacttattctgtccctcaaattagataattaaaaggaaggaaagtagcttgtgcaccaaaatcagtaacattggtaaagaaactaataaaagtaatgtgaaaatatgtcctctaaatcttaaaaaataatggaatatatttatggggctaaaatgtacatattggatcaagtgtcatttgacgattttgtatttatgttgttgccaaataaaaggaaataaattcactaccctgcattatttactgataaagactgacttttaaacataatcacttttctttgtgtgagtaaaattttccctagtccaattcttatggagacatcccatgtgcttttaaatcaaccacttaataatatgggcacatgcagtatctagagtaacattttgttcccaacttctccatggagttcgtacatcatatagattactcttgtctcttttagagattgaggccaacttgggtcatttttggcttatgattgccctgcctctgcttctattgacctgtctacctgtgttgccttacttttacactgcttctttgcctttttcctttctacctttctttttctatcttttcctgttctcatcattttctaacattttgcttttttgctgctatatgtgaagtttgatttttgtgcatttttagtaaaagatgtttagttgaattcctgaaatcagcctttggtgaaaagaaccgcttcagtttgtagaaatttcttagggatagtcttctcatttagggtgggaaggtgtagatttctcagcacgattagtctatttggcaattgcccagttcaaaaataacttccctgaatattacctaaagtttttatttccttaacacaagtttccaattgcttgttctttgtaaatatttggatatctcaagaaaaattaaggttcttacataccttaatggatggttttaatcagattgctttcctcacagtgtctagcagaaataaactctactcttcttgcatgttttgaagcagtggaaaggcaataataattattaaacattaagtgccttggaaattagagcagatattagtgagcggcataaggtaggaaacaggagggcactgtgggcttgggatgaatgagtgagggccacagaaagagaggcaaaagaatgtttaagacaaatatggccacaataataaaacccaacagctgaaatttacagttttatgctgagcactgtacggagggctttacattcattgtcacttttggtgctctcaacagcctcatggaactgtaaataccatcattttgcaaaggaaaaacctaaaggttagggagatgaagcagttatttccaaggtcttgtagtttgtaagatagacccaggcccatcctaattggactgttatagctcctgtttatttttatcaattttagttagcctaggtctttggtcagaagaggaaaagaaaactttcttctttctttccataaccttcctttattctacacttaatatcctgagtgcagataagtcctaaaaacagtgaaactgctttatagtttgaataagttttgtagattggccaaaaacctgtccatttaaactcttatttcaattacaaaatgtgtttttagtttccataaagcaaacttgtaagttatagtattgtcacatatatgccactagggtcttctgaaatacacacacatacacatacacacacacacacacacacacacacacacacacacacacagaactttgttagcaagttctaaaatcagtatcagtttaatttaaaatttctaaaacttaatgataatgttgctgtatttcagaattattaacatcaaagatattttctaaacaatgttgattttgtagttctgtgtaattaattcattgtacccttttttgagggagataccattgtaagttaaacagtagaaaaaaccaataccccatgcccattaaaaccctggatatgacgggaaagtaaaataatttaagattcattagatactattgtatttttccttttgatttcacaatgaagttttcaagggctttttgagatacctatgtaattcaagttttaccaagtgaaggattcttatttataatatgtacatactacaaatgtatttctttttttggctttaaaggagaactgtaagcctagttgctttatattgttgccatgaatgacattttaggttttataaaagccttctgaaggccagaataatgaaataagtggtaaaaatttagtgatgtgaaagaatactcaaggaaatgactttgaaggtcattattaaagtggtttagcggctaataggatattgttggtgtaggctttcttttaataggaaaagctttacagacctaaagtgttctgtaatttagattcttatacagttacaaagtctgtagatactacgatctggaagctgcaaggttgggaaccccttaggaaatgtgctccttaagttgctcatgttgctattgggtaacatgtgggcccctctgatgcatggttttgagtacagttatttccaaggtcttgtagtttgtaagacagacccaggcagttgggtctaatatgtcaaacatgaaggaacaccttaaaccaaggagtcgctcagttagcttgaaaaggaatctcgttcataatggtctaaaatattattatagctgtcttttttccctatacaggtttaagacttggaagagaaaggtagaaaatgtagttgagaatcattgactcccgaatatatttagttgtgaaagttctaacaaatttttcttctacttaaacagaaagttaagcaatttagtttttattttctttgccaaagacaaataagtgccgcattaacctatttaacaccatgctgaaaaatttaaaacagatcccatcagtgaaaataagaatgctgatagcaaacatgattatttaaatatatattgccattaagctaataactgttctcttttaaattacataagagcaaagcatgtgtagcagcatttttcattacatatttaataattgtgtacaagtagaaatcaaaatagaattgtgattaccagggaataaggaggaggggaaaatagggagttgttcagtgggtataaagtttcaggttttttttggaggggggtggatacaagatggatgataaaagtttcagtcgtaagttgcagagagctaccgcacaccatagtgcacatggtttaacaatatgatattgtgcacttacaattttggtagtagagtagatttttatgttaagcattcttaccatcagaaatataaaagcaaggttggacacagtggctcaatcctgtgatcccagcactttggaaagtggaggtgggcggattgcttgaggccaggaatttgagaccagcctgggcaacatagtaagaccttgtctctacataaaattaaaaaaaaaaaattacccaggctggtggcatgtgcctgcagtcttagctgctctggaggctgaggtggaaggatgcttgagtccaagagtgcaagactgtaatgagctacaattgtaccactagactggactctggatggcagagcaagaatttgtctctaaaaaacaaacaaactatttatatatatgcattcacccataataccatcaccacaatcaagacagttaaggtaataaacatatccattactccacaagtttccttgtgtcattttgcctttattatacatatatattacatatatatgtatatatacacactatatatatatacacacacacacacatacacatacatacacacacattaatggagtaatggatatatttattaacttgattgccttgattgtggtgatggtattatgggtgcatgcatatgtccaaactcctcagattgtatacattaagtatatacagtcatttgcatatcagtcatacctcaataaagctgtgaaacaaagaaaagcaacaaactcaaagctaatcatgatattgttagggataatcattttgttcctattgtgctataaactagtgaaatagcctaaactaatgtataacattatataaaacaaaaatattgtatttcacatgaaaacaaaactgtatcaatagaaatcataaagcccataaaatgtttttatagtgttgtacattctacaaagcactcttatagatgttattttattagatgccaccctcagctctttgagttgtaggtagcatgttatttttatgaagtattttatcgatgaggaaaaataatgcttagagaatttaaagcagattgacaaatgatttagccaagttaaaatggtaaagatatgactttagctcaagtcttctgtgcctaaagatgccagttactccattttaacctgcaacttacctgtgttattaccttcctagagttttatatgatggtctaaggtatgtatgatgttagaagatgggacaggaagctgaaaattacatactgtcttttcaacttgctacagaatttacttaattatttggtttctctgcctcatacattttgatgtttaaatctgtgaagaatgctgtgatttgcatgattttatgccacatctgttcttgaaaaactgtagctctctatcaatattttgctttccagattaagcagtccttgagcaattgaacatttttctgctttcctctgagatagatgtatgtgcataggtatgcacacatgcaactttaattgagggtgatcagggagggcttgctgagaagtgtttaggtaaaaatctgaaggagatgaaagagggagatgcacatatttttagaggaagagcattctaggcagaaagcttgtctgaggaacagcagggctgtggcttgcagggagctagcaaggatgacaataggaagagacaaggtttgagatgcaatggcattcagattctgtgggctttgaaaggtttggctgtactgagtttggctttgactcagaatgagatgggaagcctccaaagggtgttgagcagagaaattatttgatctgactcatattttattggatctctggctgctttcttaagaatggaccaagggtggggaagttaagaatcaagagaccagtcaggaggctattgcaataagatctaaacatgagatgatgtctgcagaagaggtgaagagaaatggttggattctggatatacattgtgtggccgacacacctgttgggaagactttaaaagtgggcaggaacagcatgagactggatagccagaccagagccaaaatcatgccatggcactgtccactaagcaccctgctgccaccatgagtgttggggctggacattgtctcttgctttgctggccttgcctatctttgccaatgttgccaaaatgggaacatcctacattatcattgcttctttggactgttagctcgtaatgctaagccaggattgattgtgtttgttggctgagatgaagtttcaagcccatgttttgactgcacaggaccataagaaagtgagtatctagcattttggctattctaatggcaggtgggtcctgtttcctgtcaagattcataaaataccattgactgcagaaagaaattgtgatacatatacactgtggaatactatgcagtcataacaaagagatcatgtcctttgcaggaacatgtatggagctggaggccattatccttagcaaactaacacaggaatagaaaaccaaatactgcatgttctgacttataagtgggagctaaatgatgagaacacatggacacatagaggggaacaacacacactggggtgtgccagagggtggaggctgggagaagggagaggatgaggaaaaataactaatggatactaggcttaacacctaggtgatgaaataatttgtatagcaaacccccattacacaagcttacctgtataacaaacttgcacgtgtaccccaagcttaaaataaaagtttaaaaaaattcataaaatcagaacctttcccaacttagggaatacattcggatacagggcatacttccgtttttccctgcttttccaccatgccctaaggagaaaaagacacctcataaacgtccactagattcattatctagtcccagataaggtaaatctagaatgtaaaaagaattggcaggtggtatattcatggaaccattgtttataatgtttgggaaatcatcaagaatggagatgggcaaaagtaatgctggtttttaaagggtgatgggggacaaatctgagtctacagaaatataagcttcatatagaacattggtgaaatttaaaataaatttttagacattagggtctaatgatcttcattctctttgttatttcctgatttcaacagactagtgaactagtttgagatatttatgagatatttaaaacaagaatagaaatctagttgttaggagatcattattttttttccagtcttatctctggttgaaccactttgtccaaagcatgttgatcaatgaattgacatcatcatggagaaaagtctgtcggggtgtgctggagggcattgtccttgtccttgttctatttgatatttttattaatgactcagatagtggtggtgatatgctggacctatttgtgtcatagctgggaagtataattaacacttagggtgatagaatcaaggatcagaaaagaatataataaaatgatgagcctaacctacaaggtgaattatcatggggataagtaaaacggtatatttggttttaaaaaaagaaagcatcccaacctaatacagaaaaatggggtggaggaaaggtaacttaaaacaatccatgtaaaaaaagactagtgatttctttggtgtatgggagtatgcacagaggagctccaataagatgccaaaattattcaggagaattaaagacataccaagagaggagagaaaaaggtagtgtatatattctagatggggtaaggaagtcaagtgtgagaatttggggaaggctggctttggcttaattcttagaagaatgctcaattatgtgttttctgtaaattatgttcacttctttgaaatataatgagcaccttattgctaaaagcattcaaatagaggatgactagattcacatcaggaatattgtagaaagggttcctaacctgtattacatgcatgacattgagatatgtaatttaggttatgtgctgccaactgataccatgacgtagatgtaaggtcccttcattttgcagatgaggaaatttaggctaagatgtcagatacttcgtgcatgccgtttccagtggctacatcatatcatctcctgagttgagtgtgaatccaggtaactacaagtttccatagcaaatgattgcccaaggttttacaattggcatatataagtgtgtcccatgtgacataattttggggaacagaaacacagctcattatggtcattcacttaataatttatgtattcattcattcacttttttccctccaacatatacggactgtcttctctgtgccagggagtatccttaagttctagagatacaaatatatagaccttgtttttaaagagattgaagtcatgtgaagaactgtgatcttagacgaggtaaacctccataagccatttgagttataaattgctgtcacacatctataggtgtcatggtactagaacatatttgtgttttagtgtaaacaataggaaaactagatttgtctcataggcttttctttatggaagggtttttgtttcatatatggagaactagttatgctgtataatactgtgattctatattctgaaggggaggttgtcattcagaaccaagtacagaatgcgaacagatgtaaacattgtggatgactgaatgtgcaggcagtgtaagatggaggaattctgaaccataaggagaaattaaagaaataaaaaggaaacaagctagctttcagtcagtgctctcttaggaacttctcattttctgtaattggtaggacaaaataaattaacttcttttctatccttttccctaatggctttttctcatctaataataaggaatgatggttacctttagtcatttttaactgtccactatcatgttgggtactgagatatcaatttttttcctgtttacatcatatctatcatctctatattctagttttatgtgattgctctccttattagatacttataatcatgatttggtatttaattcacatggtctaagatagaagtgtttctgatctccaactgttgctatggtaaatgcctgcctatccacaaaagcacacagttctgagtatattccaccatagatcaaactattttaatgagaatacagtatgcatctgatttttataatattttaattcttgttcctcagtttatcttagaatttcaccacttaaactatgatatttaatggtagagaaatcacagaaaagataaaacagtaataaaaagataattcctttggaaagaaaagtatatatttctcatgttaattttttttaaaaattttctcacaggaattatggccatatgtcttaagaaaacaatactcctggaaaactgcatgattcagggggtgggtggaggcacgagagtaatacattgaatgtaataagactgacaataattatcagcttggagagattagagaaagctccagctaaggtacaaaagttgccacctgatgtaagtacccaagatcaggatgaagatgatcaataattccagttaccttcacattaagtctgaataggtcattaagtaattgatgaaaaaatcactagcaaattcagttgtaagtgtgaaagtatacattattatatatcatacaaaactggtggctataacttcacaaatttttaaagtaagttagtaaatgcctgtcatgaaaatgaccacttcttgcattctatttagtgtttttaattttactttttcttccattttatgaatacttagttaatatcacataatggtttagtttaatgtgcattctatactttggtaaaggaatattaggccaccctataaattattcatttttgttgatgtgatttttgcttttatgcaagttatgtatgtatttagattaagtcaattagttccaggtttcttatgaaaaaacagcagtttttaccttcaactttccacttttttagctgattctttcagtttctctttaaatatctaataaaactcatttattttcacttattgattattcatctttggcataatctactgattcctacaatgcaaagcgagaatttggttttttttctcattcctccacttcaaaacaaacgtactcaccttttcctgccaccctcccagtctcccatcctcccagtgtagtcataattttgattatatcagaattcagaatttgatatttatattagcatgttaatataaatctttgtagccaagacacatagtgtactgtgactactttttcctctctgtttctctggaattaatattaattttctgtttttcatttctgttattaattcagggcctcccagagcatctgcctggtgtatctttcctgatttccaggcatgcccttcccctcttccctgagctggagctcttttgtcttcatcttatgtggttttgtcttgaggaagacaatttctaatagcttcctgggaaagggtgtgtgcgagatttttgttgttgttgaggcattgtatttttgaaaatatctttattcggtgctcatgcttgattgacattttggctagatgtagaattcttgcttggaaataattccattcgaatttcagtaagattgctccatttttcagttccattgtttctgttaagctatttctctttatttctagtgtcctgaaattttatgataaagtgaaaaagaaaccaaggttcagctttatgctcattgggtgtactttttcaatctggaatctcatgtcctttcatccttttttttttttttttttttttttttttttttttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccaccgtgcccggctaattttttgtatttttagtagagacggggtttcaccttgttagccaggatggtctcgatctcctgacctcatgatccatccgcctcggcctcccaaagtgctgggattacaggcgtgagccaccgcgcccggcctcatcctttttttaatgtgtgtaatgcagtagctttattacgatacaattcatgtaacaaagtttgctttttaaaagtacacaattcagcggttttgagcctattcacaacgttgtggaaccattactacaacctaattttacaattcattaccctaaagagaatcccatatccattagcattcactctgaattcaccactaaccccctgctcctgaaccaccgatctactgtatgtctcgatagatttgcctgacatctcatataaatggaatcataataatatgtgaccctttgtcattgtcttctttgacttagcataatgtttttgaagttcatccatgttgtagcttttctcagtacttcatacttccttaagactgagtaatattccatactttggatatacattttatctatttattcatcaattactgtacatgtggggtttcttttcgccttttggctgttgtgaatagtgctgctatgaacatttgtgtacgtgcatttgtttatcttctttcaattcttttgtgcatatatctaggagtggtattgctgatcatcttataactctatctttcagcttttgagggactgccaaactattttccaaagtggatgcaccattttacaatccaaccagcagtgtataggggtgccaattttatttacacttggcaacacttgttattttctgccttttttttttattatattggatgtttagttgtatctgatagtgagtttgtcttgtgttttcctgacttatgatgttgaacatctttaatgtatttacttgtattcaagaacttaaattattttgttactatttccttcctttattttctcctttctctatttttagatattttattatttgaatgttggacctcctggattgttctcctaattttcttgtcttttctctcccgttttctaattcttttttctttagctcaacattaatgatcaaatttcctcaactttgtgtttcacatattctattgaagtttctaaatttaaattttattattaatttctaaggtacctttgctctgaatatttcatttataatatattcttccttgtttcaaggttgcaatatcttttcttactaatattttctcactgaaaatattaataatagcctttgtgaagtttttctaatagtaaaactatgtttccaccaagttgttatttttttcttttagtttgttttgggctctctcttgaatatttgaggctttggccagatagctggtacagaagcaatatgattgggaattccaggtatgtgggtatctgggtcattatgaatttcactgtaggtactgactaagtcatattgttgagaaaccctcaatgccagtatccgtctttcctgtgatgctatgagattcccaatgaaaaaacttccaaactcctgcctggctgccaatcttctggaaactgagtggggatcagacccctacataatcccccattttaggatggtgtcgctgtccctaactggttggattttctagtttggacaccctctgtttttccttctctgggtttaagaggggcagttatctgtataagcagagtggggaaacaaatctaagttaaatagctactaaaaagattgtcaaccaatattccatgttttcgacttccatatatagactttcaactcatgcccacttcctggtgccaccaatttctgagccttttgattgttctccgcataagcagtgctgcttctaggctttcctcactgccagtttagtattccatttggttggttgggtgtattttctatgcaaaacttgctaccatctgttttggagcttcaaaatttggtgagtgggaattcaggagaatacaaggtagatccatatgttctatttgtcatctttactttggaatatcatccattcttaataagtttaaatatgaacaaatgttaaagcgtgccattatgtaaaccaatgtataattagataactttttgacgtcaattgttgtgaagtatataagtttttctctttatcagttgtcagagtttatcaaatatgacaaggctagtgggagtgaaggtattttaattaactgttattagattattgtccattcaataacattttaggcacaagagcagtgtctgaaggattttattagaatttgctatcttaatagaaaataattatggctgtcaattggctggttagttgttggtttgtttttttatgatttgttatgattttgagatgttgacacatgtatagatacatattcatacatttgacagtattttaaagccaatgagaacctttttacagtctgtgtataaaggaatatataggggtaaaaggttctgattttaaaatttaattattcagaatatatacacttcatttttcagtttcattatgttttcattgccgtgtattattaagatgttatttttcgtaaatgaacttcagtgttctgagttaacattcaacttctagtgagtaatttactcctttctcactggtatattcaagcctggctataaatccccaacagatactcatgcctcatttctatttcataaattgggaactgagaaactaacttgtggtggcagctatttgctgagtaagaattttccatcttttgggtttttcctttcttctcaaatatgtgatcttggttttaaagctttggatctcaattactagtttttctttcagcccttgttagggacatttggaagaatggattgattgatgtttctcccccttctattttattaccctttttacttggataaggaagttagaaccagtcaggaaagaaaaatgttgagtattctagctagaatcttaggaaatatgtgaggaaagctgtctaaatctaacaagaagataaaaagtcaacaatactatgggaaagcaatatggggagaatatgattagtaatagaatatttattagagaaaaagaaaggaccagggatctttaaaaaaatcagattttggctaactaaaaatacattgaactgagtggtatcttgtaagggttcaaagggcaacatgatcattcttgtttgtcatcacgacacctgtataagatgaatgagctggatgagcagccagtctccatgagagcagggactaatttctcatgttaccaaatgcagtgggcaccctataaatctttgccaacttgatatggtaattttcatagaatagatgcattggacacattgtgtggctgtgtgtgtgtgtgtgtgtgtgagagagagagagagagacagagagagagagagaattgagagttatttttcaaggttttcattaaaactgtcttatagagtatatcagacacagagatatagtggctggtttctccttgaaaggaggacttactacaggaagtaatatcagctgaatgcctccatctgtcagctcctccagcatctgcttcagcacagagacccattctgattgaggtcaggcctttcctcaggcttcctatatctggtgactgcaaaacatgaaggtataaaggtccagccatttctgcacaacacaggacaactctggtgctagactggccacagatttatttgtcagcataatagtttgacttcctttgtccagtcttgctctcttttcctacatttcaactagtaaatataatgcatttcttttacacaacagacatactgtacatcagccttcatctggaagatccatcctgtgtccaagacttacaaagattaatttataaatgtagttaacccttcagtttaacatggatttgttatcttttagagaagtcactgacaaaatatgggttttgatttaagtatccaagtatatgacacattacaccagaaaatcagactttcagagatcagaaggaaaaagttagtgtagtatagcaagaatttctagaaaagttaactttagatgagaagtaattttaaaaaaagagagaagtaattgagtgagttggtaaaattgtaactttttctaaggctactaaatccttgacaaagggttctgttaaaattcaataaaaatttatacatatatgtatgtatttaatgttcagtaagtattgacagtgaagaaacaaatgagtagtatttgcctaatgtagaagaccatattgctattcccaaatatttgtatatcagtcttcgtaaaaagaatatgtctctcttccctattgaagttaggcatggccaggtgacttgctttggccaacgaattgagcaaaagttacttgttattgcagcaatgacttggactatcctgactgaagtatcccaaattacttactatccaaccactccagagagagccgatgctaccatgtattatccttgaagacttcttttatgatttatactcacatgcatgttatatatatgtgtgtatgtttatgtgtatactacaccatatacaacatatgctgtttttttaaccttttatacccatgctagtgttgtcatcattccaaatcattaaatgcagttatgtatcgtttattcacatttgaaaatttacatactctttgtatcattaacataaaaattccatgctcatctttgatgtcatttaaaattctggatagtggggagaggacaagatggcctactagaagcagcggtgattggaggctcccatcagaaaaaccataataagtgtgtgaatccttcactggcagccatggtatccaagttctctcatcaaaattgatgtgaaggtttgtcaaagatcagatagttgtagatgtgtggtgttatttctgaggcctctattctgttcctaatgtaaatgacaggttgatggtacagcaaaccaacatggcacatgtatacctacgtaacaaacctgcacattgtgcacatgtaccctagaacttaaagtataatgataaaaaataaataaataaaagtcgctgctattgtaaaaaaaaaaattgactagaaggcgggcattacccaccgagagaaggaagagcagtgtggtatggtggaccatctgaaagcaacacgggaaaggggagcccccactccccagagaagggagactgtgagtggtgtgatacccagctggggaaactgtgctttttccacagaactgtgcaacccaccaatcggaagatcccacttgtgaacccatgccaccagggcctagcaccaaactctgaaacaagcagattcttaccgcctctcagctggaatctgcttaagcctatcagactcccatggggagatgcgatcagcattggctgcagctgcctgctgtctaagccatttgagctccttgggggagggacagcagccagcactgggactcacaactgccaaacatgctaagctccctgggcaagggaagggtggctgtcatttctatagctccaggcttcctctgctagaggcagggaggctgaacagcttgttcccaagacttgtcctgacagcccaacctaccacctgtggcagtctgtggccatagtgcttcttcaggcccagccgtaacccatccttcctcagtggatggggcttccctgcaggatctccagtaactccagccagaggctcaggaacagaattcggatctccctggacctgaaaccctagggggaggagtggccgcagtctctgcggaccagcagacttagcctttcctcctggtagttctgaggaatccaggcagcccagatgagtgggtttccccacagcaaaacatacccttccaccaagggacaaagtgcttccttaaatagttcctgctcccatgccacccaactggatgagaccatccaacgggggtagtcagacaccctatacaggagtggtcctactggcatcagtttggtgcccctctaagacagaggtcccagcagaagaagcaggcaaccaactttgctgctctgcagcctccttgagtgacatctccagggacaggaacgaatcagatgaatagggcctgaagtgaactctagcaaactgtggcagccctacagaagagggatctgactactgaaagaaaaacaagcagaaaagcaacaacagcatcaacaacaacaacaaaaagatctccacaaaaaccccattcaaggttcagcagcctcgaagatgaaaactggacaaactcatgaagatgagaaagaatcaatgaaaaaatgctaaaaacccaaaaggctagagggcctcttctcctccaaatgattgcaatgtctctccatcaaggacaaagaactgggtgggggagcaaatggatgaattgacagaagtaggcttcagaagatgggtaatataaaactacggtgaactaaaggagcatattctaacctaatgcaaagaatgctaagaaccttgataaaaggttagaagaattgctaactaaaataaccagtttagggaggaacataaacgacctgatggagctgaaaaacacctcatgagaacttcgtgaagcatacagaatatcaacagctgaatagaccaggcagaaagaagaaaggatatcagagtttgaagaccactttactgaaataagacatgcagacaagaatagagaaaaaaaatgaaacaagcctctaagaaatatgagtcttcataaaaagaccaaacctataattgatcggagtgccagaaggagatggggagaatggaaataagcaggaaaacacacttcaggatattatgcagaagaacttccccaacctagcaagacaggccagcatacaaatccaggaaatacagagaacaccactaagatactccatgagaagattaaccccaagacacataatcatcagattcttcaaggtagaaatgaagtaaaaattgttaagggcagccagggagaaaggccgggtcacctacaaagggaagcccctaagactaacagtggaactctcagcagaaactctaccagccagaagagattggaggccaatattcaatattcttaaatgaaagaatttccagcccacaatttcatatccagccagactaagcttcgtaagcaaagaagaaataaaatcctttccagacaagcaaatgctgagggattctgttaccaccacgcgtgccctgcaagagctcttaaaagaagcactaaatatggaaaggaaaaaccggtaccagccagtgcaaaaatacaccaaaatataaagaccaatgacactacgaagaaactccatcaactagtgtgcaaaataaccaaatagcagcatgatgacaggataaattcacatataccaatactaaccttaaatgtaagtgggctaaatgcctcaattaaaagacacagactggcaaattggataaggaatcaagatccatcagtgtgctgtatttaggagacccatctcatgtgcaaagacacacatagactcaaaataaagggatggaggaaatttaccaagcaaatggaaagcaaaaaaaaaaaaaaaagcagggattggaatcctagtctctgacaaaacagactttaaaccaacaaagattaaaaaagacaaagaagagcattacacaatggtaaagggaacaactcaaaaagaacagctaactatattctaaatatgtatgtacccaatacaggaacatccagattcataaaacaagttcttagagacctatgaggagacttacacttccacaaaatagtagtgggaaactttaacacccattgtcaatatgagacagatcaacaagacaggaaattaacaaggatattcaggacttgaacttagctctggatcaagcagacctagtagatatctacagaactctctaccccaaatcaacagaatgtacattcttctcagtgccacatggcacttactctagaatcaaccaaattaattggaagtaaatcactccccagcaaatgcaaaaggactgaaatcataacagtctctcagaccacaatgcaatcaaattagaactcaggattaagaaactcactcaaaaccacacaatttcctggaagttgaacaacctgctgctgaatgactcctgggtaaataatgaagttaaggcagaaataaagaagttccttgaaaccagtgagaacaaagaaacaatgtaccagaatctctgggacacagctaaaccagtcttgagagggaagtttatagcactgaatgctcgcatcagaaagctagaaaaatttcaaattgacaccctaacatcacaattaaaagagctagagaggcaatagcaaatgaatccaaaagctagcagaagacaggaaataactaagatcagagaagaattgaaggagatagagacacataaaaaaaaaactccaaaaaataaatgaatccaggaactggtgttttgaaaaaattaacaaaatacacagcctcctagctagactaataaagaagaagagggagaagaatcaaataggcacaataaaaaatgttaaaggggatatcaccactgaccccacagaaatacagactaccatcagagaatactataaacacctctacgcaaataaacttagaaaatctagaagaaatggataaatccctggacacatataccctactaagactaaaccaggaagaagtctaatccctgagtagaccaataacaagttctgaaattgaggcagtaaacaaacaaacaaaagccccggaccagatggattcacagctgaattctaccagaaatacaaagacgagctgctaccattccttttgaaactattccaaacaattgaaaaagaggggccccttcctaactcattttatgaagccagcatcatcctcataacaaaactgggaagataaacaacaaacacagaaaacttcaggccaatatccctgatgaacgtcagtgcaaaaatcctcaataaattactggcaaactgaatccagcagcacatcaaaaatcttatccaccacgatcaagttggcttcatccctgggatgcaaggctggcttaacatatgcaaatcaataaatgtaatccatcacataatcagaaccagtgacaaaaaccaaatgattatctcaatagatgcagaaaaggcctttgatgaaattcaatgttctttcaagttaaaactctcaatagactagatattgacagaacatatctcaaaatagtgagagctatttatgacaaacccacagccaatatcatattgaatgggcaaaagctggaagcattccctttgaaaattggtacaaggcaaggatgccctgtctcaccactcctattcaatatagtgttggaagttctggccagggcaatcaggcaagagaaagaaataaagggtattcaaagagagaggaagtcaagttgtctctgtttgcagatgacatgattttgtatttagaaaacccaatcatctgagcccaaaaacttcttgaactgaaatgcaacttcagcaaagtctcagaatacaaaatcaatgtccaaaaatcacaagcactcctttatggtaacagtaggcaagcagacagccaaatcatgaatgaacattcattcacaattgctagaaagagaataaaatacctaggaatagagctaacaagggatttgaaggacctcttcaaggggaactacaaaccattgctcaaggaaataagaaagggcacaaacaaatggaaaaacattccatgctcaaggataggaagagtcaatatcatgaaaatggccatactgtccaaagtaatttatagattcaatggtatccccatcaatctaccactgacattcttcacagtgttagaataaaaccattttaaatttcatatggaatcaaagaacacccgtttagccaggacaatcttaagcaaaaagaacaaagctggaggcatcacgctacctgacttcaaactatgctacagggctacagtgatcaaaacagcatggtacaggtaccaaaacagacatatagatcaatggagcaggacatagatctcagaaatatcaccacacatctgcaactatctgatctttgacaaacctgacaaaaacaagcaatggggaaaggatctcctattcagtaaatggtgctggaaaaactggctagccatatgtggaaaactgaaactggaacccttccttaatgccttatacaaaatttagtgcaagatggcttaacggcttaaatgtaaaacccaaaatcataaaaaccctagaggaaaacctaggctgtactatccagtacataggcatggacaaagatgtcatgacagaaacgccaaaaataattgcaacaaaagccaaaactgacaaatgggaactaattaaacttaagagcttctgcacagcaaaagaaagtatcatcagagtcaacaggcaacctacagaataggagaaaatttttgcaagctacccatctgacaaaggtctaatatccagaatttacaaggaacataaacacatttacagtaaaaagacaaccctcccgaaaaaagtgggcaaaggatatgaacacttctcaaagaagacatttacacgaccaacaaacatgaaaaaaatctcaacatcactgatcatcagagaaatgcaaatcaaaaccacaacgagataccatctcatgccagtcagaatgacaattattaaaaagtcgggaaacaatagatggtggcgaggctgtgcaataggaatgcttttacttgttggtgggattgtcagcctttgtggaagacagtgtggcgatttctcagggatctagaaccagaagtaccatttgactcagcaatcccattatagggtatatacccaaaggattataaatcattctactatgaagacacatgtacacatatgtttattgcagcactatttacaatagcaaagacagggaagcaacccaaatgcccatcagtgatagactggataaagaaaatgtggcacatatacaccatggaatgctatgcagccgtaaaaagaaatgagatcatgtcctttgcagggatatggatgaaactggaagccatcattctcagcaatcacaggaacacaaaaccaaatactgcatgttctcacttataagtgggagttgaacattgagaacacatggacacagagaagaacaaaacacaccagggcctgttggggtggagggtgaggagagggaacttagaggacgggtcaataggtgcagcaaaccacaatggcatacatatacctatgcaacaaacctgcacattctgcacatatatctcgtttttctttagaagaaataaataaaaaataatttttggataaatttaaaattcttaaaacaaattccatcaatgattattttaacagattttattaagcttttgaatctggctttttaatatttaaaaaccacatgttttctctatgagggcactgagttggcttgcttaacaccagcttttttgtcataatgtcaagggttgagcacaagtatgttttcttttttgccaaatagggtttctactgtgttttccttgataaaaatcatttcaagaaacttcatatcttgattatggtaattacatgccaagcctactaatttgttttgaagtaaatattgagagatattttacccaaaattctcaagtataattttctcaagtgatttttggtaattgattcaaatttgagcaccaataacttcttttaacattttgctaagagtgactttcaaatgatattttcagccctcgcatagggaaagcattacctgaattcatcccaaacagactagatgggattttgttctttcccttgaaatatttttaaagtaaccttctaatggcaaatggcactaagtcaagagaatgaagggatatttttagctctgattcactgactacctaacaagattttggcataaaagcgtaaaacatattatgaggagcaatggtgttggtctttgctgcttgaagtttcaggatttttattcaaaacatcagtgatgtttgccaaatatatcagggtcctgagaaagttattatttttgaaagtttgcaagtgtccaatgattgaaaaaaaagttcttttttccagagtatctgtaatttcatacccatgcacagcaagagattaagtacattttctttatccatggattgagcaaagctagtagtaaaaaaagaagaaaaagagtgatgagttgattgttggctattttttcatttgacagacaagtcaggaatttgacatttgctcataggtactgacaaatagtttggagtttctacccattttaacttttggcagtactccagatagaaaaatttgtgagtttttcccctagctatatatgagggattttgtttgtttgtttgctgttaagagagctacttggaaccaattttttacaattttacggattcttaacagtatattttactactcttcattttctcatgtttcagagcacaatactctgtaggtaatttgaatttttaaaaataatgttggtgtgatccttttctcgttgagtttgagaaacctaattactttgcctctttatatacactatattgaaataatttaaaaatacagttttacttaaatcacggagatcttacctaaagatgctatgcttcaggctagccataagaatagcaatataatttgcctctttcatcatatgtagcaaacagatagttcatatacttcattgtttaccattactttctctgaaagcattgttattctacattgtgtataatatacatctagccaggaagatttagatatactctattcgtaacataaatttatttttcaaactatttctcccatttgagagatttttagtttgtcttgtcttggagtctagcttacaacttttgccccataagtaatcagatattcatgaccatgtttaagagttcctctgtattttgcattgtaaaatcttaataacattgcttctaatacattcctctgaattttctcttggaacaagtctccctaaaattgttaccactgggtcaaattatatgaacaaaattataaatgcttcatttttaattaagaagagaaagattatatattgtcatgtatttcattgccattattcttttccttatagtcataagtaaactcctaaattgtgaatacttttttattcatctttatacattttgtaatacttcacttattataagagtttgaaaattatgattttttcattagcatgccaaaaaatggggtaaccaaattaacaaattgtttaatattttatatttgattatgtgttccagaattactgttttgaaaattaaaagtaggccaggcgcaatggctcacacctgtaatcccagcactttgggaggccaaggtgggcggatcatgaggtcaggagattgagaccatcctggccagcatggtgaacccccctctctactaaaaatacaaaaattagctgggcatggtggcttgtgcctgtagtgccagctactcgagaggctgaggcaggagaatcgcttgaacccggaaggcagaggttccagtaagctgagatggcaccactgcactccaacctggcaacagagcaagactccatctaaaaataataataataataaaagtaacaggtacctgaagctcattacaatacggttcagttttctgagtcacgcatttagtaccttttagaacctagattattttttaaaagactctattattcacccctgtagtcagcaaaagttatttcaggatggctgtatttgattcctctgtcttccttccctttatctgttctctcttccgttagttctttgtttctaactctgttcattcatgttgctttcaccctgtgatttcgagatcttccatattcctatcagagtggctccagaaagtgtttgagagttaagatattcctgagtactatttcagttccttttttctttctttctaccctgacttggactccagaatattttgtgtggcccactttgtcagcctgttttttttcttcctttttaaacaattcttgagcatattcaatgatcacagcatttcattctcattcctctaaaaaatcagcctggcttcaaaatagcatgaacgtccttttcaagtgactgtttgactccatgaacatttgttatatgatttaggcttgtgaatggtttgccagagggcatataaatcatactgcttaaccctttcctccactatttgaagagagcacattttacacattcttctaatgctggaatagcatatggttctacagaatggtttacttctagcaaatttttcttaattttttgaaacatcccaaaactatacactgagtttatttagtttacaaaaagaaaatcatttatacttaataagttttatgtggtatttatatatatatggatatagaaatatgtttggttttaagaattaactcctacaagattgaaaccacttcagacacttgaactattaaagcatgaatacctgcattccttttatcagagaagaatagtttgcaatagtcttactgcctggacagagctatataatttgtctatccatgatgtcattgccagaagccaaatagtaagttttttgttttaatggaagggatttttcaggttgctggtttacatgatgggaatgcatttggaaatgcttcctgttccagtcaccagccccaggctgcccgtacattttggattcagaaatgacagctgaaatcatttagacagaattatgggacatgtaagacacgtacaggtttattatgaccaaaaagaagaaagagaatacatgttatgactaaaaagaaatggctaatttaattaggcataaactattgcactgtgattgctatgagaggatttttatgtagtataaaatactgtgtacgataactacttttaccctctttagggaatatgtatgtggtatactggtagaattttaaatctttcctaaatggcttaaaaccaggtaaaaataaaacataaacaggcattgtaatgtgtcaaataagtctatacaggaacagtggaatacttgagaataacatatctgagtgtttgatgatgaaatagtttgcagaccatattgtctctatcatcataccatgtcttatgatgcaacttgaggcataataatctagttgtaattataatcttgtcttcagagtagagagacagcacttttttactggttcatgaatggcttgtttttgttgttaaagatgatatggaattttaatatagcattaaacctgaataacatttgataaaatgcttgcaatgttttgtttgttattcactgttttgaaaacggactcctctaggccaggcatgatggcccaagcctgtcatcctagtgctttgggaggccagggtggaaggatcacctaagaccaagagttcgagactagcccggacaacatagtgagagtccgtttctgtaaaaattaagaaaattagtcagatgtagtggcacatgcctgtagtcctagctacttgggaggctaaagagggaggatcccttgagtctaggactttgaagttatggtgagctatgatcacaccactacactccagcctgggtgacagagagagaccctgtctcaatagataggtaggtagataggtaggtaggtaggtagacagatagagcccctttgatatataatgtacagtgggtacagacttcctctgttaaacaccctgaatgcctgtgatttcgttttaaaggataagttggttaaactttcctttcccttttttctcattaatgaatgattctcatgtattggaactcacattataattttattagttataatttggaagtgaagtagataagtactgtaaagcataacagggaaaagtgcaatttcaaagtcaatttaatcttgtggactgcatataagagcagtttgaacctaactgctcagtaatttcatgttttaattcttatagcaatgtaggctgaataaaacagaggttatacctagaggaaaatggcattgattgctgtagaagaaaggagggttcagcttctgtaagttttcttcagttgcctctagcagtaacagtttcccaataaattacatgactgtaataaggtgcaggtgaagtagattaaaaactattatgaaaggatagtgagttatttcaaagttcagaaccacccttaagtgtggttgtagtgaaatgtgtgtggtgtgtgcactgtgtctcagacatgggacactggtaatgaagatgacattggccagtgggaaaataagcatcaaggcatccacccttgcttccttggccacactaataattactgtcattgccataaaatttgggaccacatggggtaccacagaaaaatagaaattattgccctttttcttcagaaaatagtggacttctgatatttcctcttaccattgaaagggtggcttagagtttttataatgggttcattcacctggaagaggttggagtgtctataatcagatggcatgtatacccaagggagcttcttaaacaagcagagatcaatcagggaatttttatgcttcccttttgcaccgtattgactagtttgtaacatatcccatttttaaaacaatgtgttcacttaaagttttcatcaatttcaaaacaaaatataacaaatttggtgtttacacataaactatgcctacctatttaacattaaattcagaattattttttgtagtctttctgtatccttatgccagtgaaactattttcatttgtgtgtatgttataaaatctatacaaagcttgaatatattgactgtcctttcactgtcaaatagaaaattaaatgaaacagaagttaaggatatagagtctgtgtttaatctaactttcaagagaggatttctgttggtcatctccatggaatggcttccttatttttagcctagatgcaaaaactagggctatgctattttcaatgtcacattttggcagtgctcctgaagaacatcgaaattagcttacaaatattgtgtacaccaggcttgacattgtaggagaatggaaacaaatacatgtgttcaggaaggggctttatttggatttttgcttgaagggaaaagtctagtttgaaagccaatgctaatgcaaaagcagaatttctctgaggaactttctatctcatgaataggaggtctgatcatttgaagagtcaacaattggaaaacctcacttcatgaataatgttaggtaaagagaaacataagcacttactgaaagaggaagcctattaacagttctcctatacttgtttctgccctggaaatggcaaaatttcatgtccaagaggtggtctgagtttcagatagctttcttaccagtggctttagatggagggatattgcttctttcccttgacccaaggtcagattcaaaacagggtaagggatggagagaggaaaatatgcaaaggtgagtgttgttttctagcttgttttttaccttttctttgatctggcctctctgtcctcctcttttaaaaggggcagttctccactcacgcctgttttaaaatggacattatatacgtaattaatctttctagttttcttctgtgtctttcattttgagcctcatggctgttgttgcaccacatgactaagatgagtcagtatagttctcagatctgcatatgactgcagttaactgagactcaactgtgaaaatgcctattagtaaaatgtcttttcaattttctgtggtctttccatgttctgtcttttaacaaggggttatttttctcttgctttttatattgatccagccacagagaaatcaaatcaatatgggaaacccacagtctaaacctcataaactcttttacagaaaacatttcacctcaagagggttatgatttcagataccctcctcggattccttcccctggagatactcctgcacctatgtaaataaccagataaatgctacctgatgggttagtcaacagcaggaaaagaggatactgggttttttgtttttatttttgtttttgttttgttctcgctctgtcacccaggctggggtgcagtggcacgatcttggctcactgcaacctctgactgctgggttcaagcagttctcctgcctctgcctcccaattagctgggactacaggcgtgcaccaccacacccggctgattttttatatttttaatagagataggttttcactgtgttagccaggatgatctctatctcctgacctcgtgatctgcctgcctcggcctcccagaggatactgattttgaaaggaatatatgctagtgtggggcttgagtcttcagagcctctttctgcgctcactctgtctgctgcttggtttctaagtcaagccacacttgatagcttcctttaaaaccaccgacttcatggaaggcattcaggtgtaaccttgtcagacacaagtatatctggtagcattaaggcatagcaatggtgatggagtaaaggggaaagtgtgggaagaagaggtgaggcataatttagtgaaggaaagaggagatgttagcccatagccatggtagggattggagggaagcaatcttttggatatgcgtagttaccaggggtctagtctataggtggtcctcttggtattaggataagaaatagccagagatcaagccagatgcatctgagcttattagtatgtcatcacaggagagtgagctgttggtcatatgccatagtgatgttctgttcagaactttataaccagcagtgccttttggcatcattcttaagtgtagttctgtatttctggataagtgcaaatcataagggtcacataatccaatgagtaaaactaaggaaagaatgtataaagaaaaaagatatgtataatataatgaaatttgtaattcaggcacatgtaatgcagtcctaggcacaatactatgtatttaaaaagagagagggaaaacaaactgtttttagtttaggtaaaatagaaatttgtgaaacatcaatgttaaggtggaaaatgtgacattgtagtacctcttgttccctcttccatatgagattctccatattcttgcctctaatcactcagagcactctgaagttagtgatataatgctggatgtagtttcagtgattatatatagagagtggtggcatgggaatgggaatgtctgggcatgcacataggaagaacacatatgtaaagattaaatgcaactcctagaagttcctagggaacttttgactatatgtatcattcctgtttttatttcaatctcttccaacaattcttccctaattccctacctctaaacacgctacagaaaatcaccgtcatcatcatcatcatgaatcatcatcacctatagtatccacaatgtgctggacaatgttctgaaactgctatggatgtttaccagttaattttcacaataaccatgtgaggttaatatgaaaattgaactaggattgtcttcattacagaggttatgtgacctgctcaaagttatgtaatgctgatttacagagattatgtcacctgctcaaagttatgtaatactgatttacagaggttatgtcacctgctcaaggttacacagctgaggaagccatgtgtgtatagatgatgtgtgcgcatacacatagtacgttttcgtgccctacatctaaaaaataacctaaaattttaaaggtttaggaaagtcttttaagttttcccagatctcatttctagagatgatctttttcctgcaattcttgatgctaatgtcattggatttggaggatcaggaatttttttctccagtcctaatgtatttccttcctcatagttttgttgtttcattttaaacaagaagcttgaatactttattcttagaaaagtttaagataattcacaagcatataatattcacagaatgctagctgtgtgagtgtagagttcatcttatttatgcaaagttggcattctataaatacatgccatatatataacaccataaatgttcttttgtacccaccactattccacttctttaatttgttaactttagaggatcacattaacatatgtttttatattgaactatttctcatttctaagattagccttgtttggtcttgatgtgttagttttttaatgccatattgaattttagcacctactgttattatttttagaatatatacatctgtgactgtgatcatagagagattgttttagttccctccatccctttcttgtgcttgcctagtttgacaatgtgttttaaagaagaagtaggaagcattcttatctttttctgtactctggaataacttgtatatgttatttgaagattcggagcattttttattaaaacagtctgaattcagtacctttttagttatagcccttcctatgtcttacaaattttgtaacttatgttttatttagaaaaacatttttttcctagatatcaaatgtactggtttaaagatgtacagtgctgtattttaaaatcttcacaattttagttgtcacttttcccattctttcctcttctttcctctcctttcctctcctctcctctcctctcctctcctcacctctcctcccctcccctctcctctcctctcctctcctctcctctcctctcctctcctctcctctcctctcctctcctctcctcccctcccctcccctcccctcccctctcctctcctcacctctcctctcctctcctctcctctcctcccttcccctcccttcccctcccttcccctcccttcccctcccctctcctcccctcccctcccctcctttcctgacagagtcttgctctgtctcccaggctggagtgtagtggcttgatcttgactcactgcaacctccgtctctcgtgttcaagcaattctcctgcctcagcttcccgagtagctgggattgcatgcacttgccattgcacttggctaatttttttttttttttttttgagatttttagtagagatggggttttgccatattgctcaggctggtcttgaacttctgacctcaagtgatccgcctgcctcagcctcccaaagtgctgggattacagacataagccaccatgcccacccttgtttttctcattcttaatgttgattatgtcttggcaaactcctcacttaataaaaaaaatcagacttgccaaaggttggtttgttttattaggcttttcatagaagtgggtttttgtttaattgttcaaacttattgttttctagtttttctatttaatgtctgctattaactgcattgatcccttctctctcttttttttcttgtctcttttgttttctctagctttactttattggttgttttattcatttttagtcatttttatgttaaaataaatacatttaaaggtctaaattttcttgttgatgctctgaccaaatttaattgctttgaaatgtagtatatttattatcattcattttttactgatttaagtatttttagacttttttaactttttgtacatttttaggaaaatagatttttctattcattcctccctttctcattctctctcttcaactgattttctttcttccttattttcctcctgctgccattgaacttaaaacaccattgattggaagaaaccttattgatatactactaaaaaagaaaaaatgcactgaattaaactatgattgaatgccttcttattccgaatttttattttatgcttattgaaagagctagagaagttttaattctggcattaaaaaaaaaccttacctgaaaatttcaataaatggtttctaggtaacaattagggctcacccttcactgtttcttcttcagatggtccttaagttgtttgttggtgactcatgccattgagtaaactctgcaaattgagcaaaataaaaagtttgctgagacacaggcaataacaactatattgcattcattgcctgggtaatcataaatgaatgctgttgttccaatatcaaaaatgaaaagaattgtatgtcttagagttgatgaaatataatatactctgatgttaattttattcagttttgaggaaaggatgtaatatgatttcagctttctggaaatttttgagattttctctttgtctcatacattgtcagtttttgtgagtaggccatttgtgtttaaaaagcatgtgtagcatgagtttattgggcatgctatttaattgtgttatatcctttatagctttacttttttggccaattccatttgttaatttttgaaaggagtaagcaaaacccttcaagattttgtgaaattttccgtttcttctttgatgtttgtcaatttttgcttttaataatgtatcctattgttaggtgtgcaaatgttgaatacatgtttcttgaattatgttaaacgtgattttacattgatatatctgattcctttttattgatatttgcaatataaataacaaaatatcaaaagtataaataaacatttattttcagactttctggatttttggtatttattgttcttagtttgtgtttgggaagcagtatgaatttgattttgttttaaaaactgagattttacatttttaataagcgtttcaacacatcatggacatgtgattattgatatggttggatgtacttttcttttaccattttgtttcttgtgtgtgaagcattgaacagattagatacacttcttgccctcctggatcttatagtataatgagcattattttaaaagaataccttatttttatctattatattataagtaaaaagtacttatcatatactggcttcaaaaacaaatgttctctcgttctttatttgtcgttctctgaggatggtgttatccttatttaaggatggggaagttaataatatgaagttacaaaatggcagtttggggtccagagtcattcctcatttcactaaatgcatgaaataaaacttttatatagttactcaggaaaaactccattgaacctattttaatcatattttaggtttgtttttagtgtgctatcctatacataaaagtattcccatctgtacttagttcctttttctctttgtctgacattttgcctggaccagagagagaataatttccaaattaatcatagtttctaccctcatggagtttcactttgatttagaagctaaatcaaagcttgggttgcccaagataaaggcaattttgtctcagaacatatctaagagcattttctctgacccattttctttgcctttgcccttcagttggctaacttctttcattctctactcatgtcttacttagaagtaacttcttccagagacctttctgaaatctctagacctcattgggtttcccctgctgtgcccttgaacatcatccagcactattcttaaaatactacacagcagactttactgtaatcagtggcatgtctggtttttttccatttgcatctgtttcatttactcctgtgttcttagtgactagtgttgtgcctggaacatatgggctcaaaaattacatgatgaatgatgaaggctaatttctgcattgtatcctcagcaattataacctagcatgcaatgaaagcttaataacagaacctgaactgttgttataaatgactacagcaaggttcttgaatgtattataaaacttgtacttcctcagtaattcaggcctgatattggggcacaaatgctcatgttcattggcttttactgaatgattaaatgtttcagttttataaatcttatagtacactccaataaaataataaaaatgtgaatagtaactacatgcttttaaaaaattatatatagtttatgatataagcagaaaaagcattaagaagaagatatttacttgtggacaaatcgagcttgcatatttaaaagaataacagcatgagatgttgaatattcgtttaaacatatctggatatatttatcttaatttttaattttgaagatgtttctgttaatttatgaagcatatttgctcaaatatattcaggagttctagaaacctgaaaattattttttctgaatatggacataaagataagtccagtgattaattttactagtagaatatatttgtggtatttttatctcatataaaataaatattttttatttgcatttgcacttggaaaatatgggataattgacattataattgcattggttaaatatgtgtggttttctaagttaaagtataaggatatattcaatggaaaggaaatgagacacttaacaaattatggacatgtattctttttaatatatagaaatatttaacataaaacagagccgagagggaaaaataatgattcaattgtgtttaaaattagggggtggggaggcatgccactacatacactgaaaaatccacccacttgtcttttatttgctctgttcagaaggtaatggtgagtttgaagtaggaaaatattgatttattatgttatagccagagggttattaatacatttttccttttcttttctagcacactgatttatgtcagtacatggacaagcaccctggggggctgcatccagataatgtgaaggtaggaaaagatctttttaagccaaaggttagcattcttgatgtgtattttttgaactgaagtctagcatctctaccataacatatttaaattttttaaattttttgtgtaaagagaagggatattgaggtgaaccagtcattgcttcagttgagttgttggaaaccatgttttaacattaaatatttttactggggtattaatatttagatctcatcttatattttcttgctggagaaacatttgctaataatgagtgaaaaccactggaatcctactttttaacacttcacagtagaggggagtctcagttctagcttggaacccatactgatgtaccagttggtttcaacataaagcatcattatgatccaaaacaatgttatggtgggttcacagtgcatgtctttttatttctatgtacaagcatattctactttctgctactctttttcctttcttttagtagaaatattactaccgagtatcaaaagaactatgatttcctaaaatttgacctcacaatcatcttgggaaattattccaaaatttcaagcttcttggtatatgcaatagaattagaagagatcaaagttatatctgatatggcttaattatgtacttacattgtgtaactcaaatgactacatttcataatcctgagaaccaattgagtattacagatgtatttgaagtaaacttattcatctcaatttcttcccatttgttataagaaaccctattagtgataaactaagaggtcttcactttataccatagtcgaatcacctgggaaactttctatgtatatgtgtaaatgtgacaagttaatagaggcttttgtagtggtcagttacactgtataattttaaaatgtaggaacttataggaaatctgtcaaaacattgttaaataaataatggaatcaatatagaaattatagtctgttgattttttcatatgtcttctttttgtgttttattagattgcctttccttaaagttttttgactgttcatttttcttaaaaatgtgtaaccattaacatatagtttattagtagttagattaggttagaaaatttaatggatgaaaatacgtgttttattaatcttgtctatgttcaattccaactctaaatattagtattataacatgaacataatttttttaacattaaaatctcaaattctctcatttatacatccacatgttctcagggtttattggctttgaaatcaatagtacaatacatcttcattcttgtttcccactctatccctgagaatgtgttgatcacccagctagtgagaccactggccccggggagctcagaagtctaccagccacagtggaaatgagcagatcctctgagctaactttgacttcctgactttcacattcagtgatacaattgagattaaataactgattgaatctttcccacagtcatgacatcactgggcttttattatccctgtttagtttctcaccaatcatgtatgtgtcattagttatcagcaactgttggtggaaaattttgttgatgaaaaaaagaaaacctctttccacaaagcattgctgtgttctctgtcctcaggccactgacattgatgaattttgtcccatttttactatacgttctgcttcttccattacattttattttcccttatctcctaatggtcatggagaaatgggtctcaaggttactgtttctcagtaactgggctgtacctctagaaactgtctcaccagctcttattcaagctttgtgtgcttttctttcatcacatggtcattcatcatacttcaaatacttactgtttgctcctcattccgagtccaggttgcaccatggtgataaacaaggtttaacactgcaggacttggtgcctcctaggacgtggtgagaaacttaatgatgagtgaaatgtgtagtcagtgtagaaataatgtcacagaaattatatgtgacacttacagtgagcctgggtatttatatacagcaggaacttttcctacttggaagttgtttaacatggtcaccgatagatgacttactacatttttgtttctaaaaaaaatgtgatgtgatttacctcttcttattttttaaaataccttaaaagcagcaaaatgtattcatctatggggattcctttcctcacaactagtgaaatctttgatttgttgaggatcttctgaaatgtcctggacagtctcagtgcttggcatatttgtggatacaagaaacctcagtaataaactaagaggtcttcactttattctgcagtagagtcacctggcaagctttatatgtatatatatatatatacacacacacacacatatatattctccccagaatcaggacatctgcatagtataatactgagaattttagccagagtaatcagccaagagaaaaaaatggaaaaaatccaaattggaaaagaagtcctctgatcatctctccttgcagaccaagtaatcttatgtatagaaaaatctaaagactccaccaaaaaaagttacagagctgataaactaattccgtaaagttgcaggatacaaaatcaacatataaaaatttgtagtatttcttccccaataatgagctggctgaaaaagaaataaaacaatttaatttataatagttaccaaaaattatgtaggaatcagtttaaccaaggaagatgaaagatctgtataagaaaactgcaaaacagtgatcaaagaaattgaagagatacaaatggaaaaacatcctatgatcatggattagacaaattagtattattaaaataccattctaccaaaagcaatctacagattcaatacaattcctcaaaataccaataacattcttcatgcagtagataaacaatcctaaaatttatatggaaccacaaaagaacccaaatagccaaaacaatactgagcaaaaagaacaaagctggatacttcatactacgtgacttcaaagtacactacaaagctatagtaacgaaaacaacatgttatgggtattaaaaagagacacctatgtgtctgaacagaaaaatgctcagaatagagaacccccaaattaatctgcatacctatagtcaactgatatttgacagaggtgtcaaggacatactttggggaaataacattctcttcaataactggtgctggaaaaactggaaatccatgtgcagaagaatgaaacaagacttatttttcaccgtatataaaaatcaacttcagatggattaaaagcttgaacataaggcccaaaactattgaactcatgcaagaaaacatgggagaaacacttcagggcttcggtctaggaaaagattctatgactaaaacaggcaacaaaaataaaaataatagataaatgggactatattaaactaataggcttctgcaaagcaaaggaaacaggagcaaagatacaagctgttgaatggaagaaaatatttgcaaactcttcatctgacgagggactaatatttagattataaaaggaattcaaacaacttaacagcaaaagaaacaaactcgttaaaaagtagacaaaggacctgaaaaaacctgtcttggaagaagacatacaaatggtgcataggtagtaaaacatgctcaacatgactaattatcagagaagtaaaaatcaaaaccacagtgaaattccatcttaccccagttaggatggctatgatcaaaaagacaaaacataacaaatgttactgaagatgtggagaaaagggaagtcatacactgtgggaatataaattagtgcagttattatggagaacctatggaggtttcttaaaaaactataaattgaactatcatatgatccaacagtcctactaatgggtgtttatccaaaagaaaggaaatttctgcaccaccatgttcattgaagcactattcacaatagcaaagatatggaatcaatctaagtgtccatcaacaaattgatagataaagaaaatgcagtacatacatacaatggaagattattcagccataaaaatgaatgaaatcctgtcatctgcagtagtatggatggaactgaaggttattatgttaagtgaaataagcccctcacagaaagacaaatagggtgtatttatattcatatatgggagctaaaaaagttgatctcatgaaggtagaaagtagaatgatagttaccagaggctgggaaggattttggagtgggggatgaagagaggttgattaacgagtacagacatactgtttgatagaaggaatatgttctagtgttgacagcacagtagtctaacaatagttaacaacaatacattgcatatttcaaaataactaaaagaaaagatttggaatgttcccaagacaaagaaattataaatatttgaggtcagggatatcctaaatacccatcattatacattgtatgattgtataaaaatacgctgggctccccaaaatatgtacaaatagtatgtattaataaaaatatactttaaaaagtatctttacgcaggaaatgtgggcatttgctcagacgcaaggaggagaggccaagatttctcccatgatctacagcatttcctgactctccctatgtccctgcattgctttactccccagccctggggacatgtgtacttgccagcaatcctagcctcttgtttttccacagccctgcagcctgctggcttccattgctcctcagtctgccagcaggggagtgggtggtgacccagaataaggtgggggttgtgtaggtcagggagaggcaggggagagcttgagagacaggacttggcatggagagctttagacagcaaaagtcgtgcctcaaggaaaagattttaagagtattctgtgaaggatctgatcattccaagacgacagacctgaagaatccaagaaactctccagtgaagaccccagttaacaaatgagtaacttggaggaagccaagttgcttgcactgattggatagggaaaggtagagaaggaaactttaaaaaattatcattaatagtctcagagagagaaaagaagataattcatccataaaacaaaaatgtggtattatttttgagaagcagaatttagacaacacaaaggagctcttggaaattaaaaatataacaaattaaaaacaacaataaaatcatgggagacaaaattgaagaaatttgccagaaaataaaccaaaaaatacaaagatgaaaaatgggaaagaaagtatcaaaaaatcagaggtctaatctaggggatcccacatctgaataactgaggaaaaaaggagggaatcattaaagtaataactatgaaaccataattctttcaaatgtataggattgagtttttagattaatgcctagatcatttaaaaaataaactgaaaataatgttcattattgcaaaatttcagaacactgggttcaaagaaaaatcgataaaaaaggaaacaggtttactccacgggatcaagaattacaatggcgtcagattttcaacagtaacactgaaaggggaatggcagtgagacaatagcttgaaaatttggacacagaagtattttcagcctagaattctgtgcaaactgtcagtgaagtatgaaggtaaaattaccattttcagatgcacaaggagttgaaaattttgcctgtgttacattctttctcaggaagatacttgaggatatactccactaatactcaaggaatataccaaggaagagaagacaaagaaaccaggtaacaaaatccactactggagagaggtgaaggaaattcccaggataaagaagagaatccagggatgacaattgtgcatcaggctgggaaagtaacttgctaagccagcaggctagaagtctccaggagagatttagtaaaggagataaaattgttagttagaataccaaatgtgtttaagtggacttaaaagatgggaaaagaatttggtgttgaattagtagtggccacaaagaaaaccaaacaaaggaaaacaaactgacaaacaaaagaactagattattactaacaccaggaaaaacaaatttttgtgcaggggaaagaaaggtattcatagtaaactttatagctcagctgtaaataatatttacatggtcataataatttaaacattgaatgttgatgtaatttaaaacaaaacaaaacaaaaaatacctctttatgtgataatgctgtagccaagctcattccaggaccagcgtcctggatcaatggttcattccagcccccaacatttcatagaaagtaagcatcaggttcactgagatgatggagtgtgttaaagggctttttgactctttgtgcaatgttcttttccctgagctacatgattaatacattaaattactgtaattagcttgattatttgtgactttcgaaacactaagtcacataggttcatcatcattttcatattgaagataatagtggtacttcctccaagggtatggaaagttaaaaaatagatgtagcttggtaaagccttgtgttttggcatctgaattgcagtgcatggaagcagacaacccttattactatgttggtttctatgggaggccactcatctaattatgcattgggttttcctcactgtttgctgagagacaagggtctcctccagagttgctttaggatatgaactgcaggtgaaattattctcaaaaaattcggactatgacatagtgacagatatgtcatgggtatttctgtttgatatataaacattttttcatgtggtgatgtttattgtcacttaaatctatgaatataaaaatgaagaacataaaaataatatttactaagttaacagctgttcataatgctgtgctagatattaattgtttttaaagttgatcttcacatcatcttagattgttgggaaaatatagacaaaaaacctcaactgagctaaaataagacattgtaatagttctttataaatttatggagataggaaaaccaggtgagataagctattgtctttaaaaagagcatgtccttttagtaacacagaagctctatgtttgctaaacacttcacagattattaaatgttcagaatgtgatgaatacttaatttttattatggtgaacaataggaaaaagcagtgatcaaatcattttgcttctaaatttagcaattttgacttttagtttcatcattctgcagcatgacagtatatataaacattttaaacatttatctaggattctaaaactgtacatatttttctttgttgatattttgtatataattgtgtattgtaaaaatgtggatatcctgcacttaagaattgtggagattgttccttagtgagacttgggtagaatttcaggcattacaatggtaatgtatcctggaagaatgaaggggagaaaaaaagaacaaatggaactacacatagctcctgatttcatagtaaaacaatataattttgtactaattctcagcaaaacatctatgaaagttgtatttttcttgatgcgtatttcttgtaagccctggaatagactcattttaaaaagccagtgttaactaaatttctactcactttgctactttaattgcttacaaaatgtgtctattatcagtatggcattctgaaataaatattcactaataacaaatggtttatttctagcataatatcaatttttgacaaagtaattttagcaattaattagaggatgatttaaaacctgaatcaaaagcctgaggacattggccctgttataaatatttatgatgattaaaggcattgcaaccagtttgtagatggtgataataggtatgtgggaaactggttagaatatttttggaaaggtagttgaattccccactccctttaaagaccattcactgtgaattatattgggtttgagctatcatagttgaatatagaacttgtattaattcttgattttataattctcagtggtctacagattgaccattgcactttcacaaatgactataatggtctaaatttcatcctttattcagtttttcatgtgttctttaaaaattgataagcatgagagactgaaaattaagattcatgaaaaaaagattaattgatgctgtctccagctgatgtccagaaatgtagatgtttgaatcttattaccatgatgagattgaatcttcctgtgtttttatgtaatgtacttccatttctgttatcataatgacttttctagaaggttccctgcaaaaacacatttgccctttttttgtgaacaattgaaaatgaccaaagtaattttgaacttcctgccttattctctgaagtatccgcaatcctattggcataaagctgattcttatttttcatttcaatagatatattaattaaaaggataggaggtttattatggctgaaaacttgctatttttctttaatagaccagagaacaagcaggtgtataacagacagaattatgctatgccaaattaagattgtattatacagatggcactgagaattgatttctaaatgagactttctaatgttcagatagaaaaccaagtgacacctgactttctccatattcttcattagagcttctcatttagctcctaataatttcctactacacatgactgtgaatattatagagcctttcctcattctgtattttaattaagaaatatgattatttcatgaggccattaaagaatattttaaaaatttgacaccaagtctcagtgtctgtccaggctttttttgaatgttttcatcctatttttattataataaaataatcttccacatctagaaagtggaagactaatgataaaagaaaatgaagttccacgtgtcagctcttattgtgttagacattcagaggggatctgagtagtgaattttctggttaagatatggggtctgcatttagttgtttagaacatgtcttttgcatcctcaggatcatccgctgatttgttcgtaacaatttggatccagcaaaagaattaaggccagctaattaaacagtacactctttcctagagatccgttaaaacccagattgaaaaggaatcaccccaaagaatgatgaaatgcagacaatgattggaagtgttacatgatgctttaattgtaagttacccaacttgggagttcccattaagaataggggaaacaccctcctgggctttacactcgtcaccttgcctctctccagtttaagatggatctgcacacgacccctttgtttccatgttttccaagacagacatgagaccccagagggaaataagttcaagtagtagagtatacacatattgtcttggataggcacagcattcctgtgtccagccagtacagctctaggtattttctcgttcctgtataaatttctgttacttcagacccctctgagaggatggagaaagaggtttgttgatcatacgtatctaaattcacaagttgttaaatgttacatcctatttgaaattagtttttctttggtataacttgtttttgtgatttactccaaggcttttaaactcaagatctatcacctttgtcaatttttctatccacatctctctctttttagttatactagccttctcagttgatattaagataattcattttgattgagtatctaaaatgttactttagtcagaaaaaccatttaaactctgaatattgattcgttttcattttgtataaaaaagaatggccctgtagttgggagagagtagcataagttcccaaatgaaattgagtaggaagacctactgactctccatttcccaatttggattttgtgctatttctgtatagttcagaaaagcacttatcagtcaggtcagccctataattctggcagacagaaacttgacaatgacagagtaagattatgttatttgaatttcttagaacagttctttcagtttttctcttggaaaattatgttagatagctattaaatccaacagcttgtctttaacagtttctgctcacctagggaatatttctaatactaattttaggcagatgcccacctttattaggaagacccagccccaccccccacccccgcaacatgcttcacggtatatacaaagcccaataacttggaaacctacttactgtactagatcttcttttacagaacttgacaaaacaaagatcagtcacactagcctcacttgacttattataagtctcctagctctagatcccatggctttaaactgcctgctcattgtgggcacctccataccggaaacaccaccttgcttggtatccaccattgccttgaagtagaaagagagtgtggaatggaaggccaacttacttggtaagctaagcagttatttccccagcagcttgcccatgaacctgaaattctcattttttgagttatttctctccagaaagttctcatctttaggaaaagcatattaatgttcaaagatcttaaagaatgtaaattaaattgttacattatctagaaatgacaaagcatgttacttatgtcagagtcttagggattgtaactaaaaaagcagaaagaagaatggaagaactcaaacagggcaaaacagtggcaagacaaactcctccagctactcaaattttccaagaactggatctttaaaatatatattgcaaaaaaatacacgtggaaggactgatgccttagcatgaatgcttgtgtcttataccatcccagtagcacacttaacactgtcaagtatgtccaaagtgacacataaattatactgtaatgttgaatagctagggttttatttctctttttttatatctctgtataaccgtctaagtattctttaaaaattcagtactttgaattgcaatgatgctttgtaaaataaaacgatttgggtgtacattgcattaaaaattaagatttaatatttgcattagctgttttgaaactcaactaaatggaatgaatcatgatgaatcattttgtggcttttaaaaattgaagacctagtattgcagttaaaccattatctgatgcatattacaaaatattttgacattgactgcatataattgggattttaactaattatttttaacttctaggaagttggatatgtgggtagtttaaggttgtgcagtctatgggtttttaaatgatacggcgttaaatatggaacatactatttgaagtatttattattcatgtataactttcatttatctaccagtgtcatattttgtagctttaggttcacatagtatatagctattttaattaaatagtatgcttgcctttttggatagcagccctcttaattgtagtgtcagagtaagacaaaaaatgggttcaaatatcagcactctctcttacttactatgtgttcctttggccaattcacttaattcctctttttttaaaaaacttttaagttcaggggtacatgtgcaggatgtgcaggtttgttgcataggtaaaggcatgtcatgggggttggttgtaccgattatttcatcactcaggtattaagccttgtatccattggttatttttcctgatcctctcccttcccccaccctccaccctctggtaggccacagtgtgtgtttttcccctctctgtgcccatgtgttctcatcatttatctcccaagtataagtgagaagatgtggtatttgtttttttcttgctatgatactttgctgagaaaattcacttgtctgaggctttctttctttttctgtgaaatagggatagtaacatctacctggcagaggtgttgtgagggttaaattattgaatgtgtataatacacttagcaaaatgtctatcgtagtaagcactcaataaatggtagtgattcaactccagttgtttaatttataaaatctcttccatttctgttattcataaaataatggaatgatgtaatttaacaatgtgaaatggttaacaaagatatctaagacttaaccaaccactcaaccaaccatgtttaagatgagaaacctgagttatagagtatcaaccatgacaaaagagtagcataattatctttctaagacattactgctgtgttctaaatggtaggacccattgctaatgactcctattagtagatttcttaatcttctgaaagccctgagagaccccgcacattccttaaaagaagttgacacacgccctgaaaaatctacaagatattcaccacgcttcatctcagattaaattgaaccgcatatattaaataatctgtgtatttctgaccattcatggagcaggacacctctagacactgagaaaaagagcatctgacctcacctatttagacttcggtgagagggactggttataatgcttctttcttactgcaagtgtcagtagttctgagcaataaacataacattgaatccaatagtgtgtgctttatatcaacttactttaaaagttgtgataaaataccattaattaattaattaattaattttacccacttaaattgtgaagagtttcagaagggaatagaggaagtgttaagggatactcccaagaagtatatgccatggcactgagaatatgctgcttcctgctggggatgccaagacaactggctaaagatagctctgctgctggcaaaaatgtccctgttcatcgtttcattactatttaagacaatttctcattggatttttattacagaaaatgaacatattcaaactggaatataaatcttcagtgatccgactgatggatttgggatgaatctccttttataaagatggaatagaatatcctgagatggcaaaatattcttaggaagatcttatggctactatagtagaaagataaagagtttcaaatatattaatttatctagttcagcacgtgaatttgtcttctctcatgttatctatttctaagattttgaatggcaaagacagaaattcaagaatcatgtgcttattatactatatgctaattgaggcttttacaaactttgattcacttaataaaagcactttgattgtattgggtgtataactactcatccatgcatttattcagcatcaacctcatttaagataatgaggtgtggtggaaaattcacaagagctgtgtgatggttggatgactatgtttcttacatctttagagctttagttttctcatttgtttaaacaaaaggaaaaatacaggatggtagctggaaaggattaagtaatttgttgggggttttttgttttgtttattcatttgtttgtttttgaggcagagtctcacttggtcgctcaggctggaatgcagtggtgtgatctcagttcactgcaatctccacctctcgggctcaagcgatcttcccacctcagcctcccaagtagctaggactgcaggcacatgccaccatgcctggctaagtttttctattttttttggtagagacatagttttgccatgttgtctaggctggtcttgaactcttgaagtcaagtgatccatctacctctgcctcccaaagtgttgggattacagttgtgagccactgccccgggcctgattaagctatttatataaaattattctttaaattagaataaactttcagtaagtattagtctcccttcttttctttttagtgcctgagattccaatggtgtttaccaggttttattagcaaagctgattcttatgctttagaaaaagaatgtgtgtggacccctccctggtggcccttcttgttctcacagggtcttctggtttttcatagaagatcaagtatagcttgctgtgtgttttatacaacaaccaagagaagtgattttctaaaaaatttaaattagaaagttagggacttgcctatttgtctagaagaactcgctaaagcttgagttttaaagacattccaagggtagtccatggggcattccattgaattcagtagggtggctgcttccttagagccttcccacccctatctgccagtgtatattttgttaaggatgttaaaatgttttttgtaaatgtagggatcaagggaaaactaccccttcaccctctaaaagttcatagaaaaattaactcacaaaatgcacattgatttgagaaaaggcacaaacttattttaatgtgcatagcacaaggtcatcatagaagaatagttacccagtaacccaatgtgaatagatgtttatatattcttattaggagaaagggaaatggggatgtatgaatgcttttaggggtgtggtaaatgatttttaaggaaattcagtgggattgaagaatatacgagaatatacgtctgttgggcctgcagagcagagagtggtttgtgacaaaagtctgtccaggtgtgttgacagacttcagtctttcttcctaggataagagttcagttaatggaaactcaggaaaggggccagaggtaattgttttcttctttggcaggtccagattttaggcagataaggggacttcagagaacaacttcatcctgtgctttgggagagacagagggttgagagacggggcagagacggggagtggggcagaaggtcaaagagaccttcaagcttcttcagttcagcatgtcaaagtgccattttgagggtatcagtttctttgagctccagcataaaagttttctaatggttttcagaaggttgatcgtccccttgccacagttaatttaatgaggctgagttggtaggtttacagcttcatatattgtctttctcggaatttatgttatacctgcttgcttggtcttcttagtgttttccttcaggatgttaaggggtttgtcataacattttaacttctgtgtctactgaatgctcaactcgttccttttgaaattttacaagtaatgaattctgttttcagagtgacaagtttcttgtgattcgttcccttctcttcttgtaacagccaaatcaattcttctactttttaaaattgttgttagatccacccttttctgtgctttcagtatgctcagtttgcgttgctgttaaaatacagacctctaagtcacaatgatttgtttgtgtgtctgtcacactgagttagctgtgagttcctcaagtctagggaccacatcttatatcttattcctcttggcatccctcttgcataacagcacctagcacatatggttggcacttaataaaccctaagtgaatttatgctgtggagatttgttcttacatttgtttggggctgtatttgtcatgtttggggcttaatttgtcatgtatacacttagaattttagtgtatagtggcatttttttctctagtactgctttttaaatctcctttaatatggcatcctatttgaatagcttctacgttagcgtgaggattatatattttcactaattagtaaaggtattaagtaatagttctttggaactacttgatttacctatgtctgcccttagcttctcgagaattccattccaaggcgcctgttatttgcttttatctgctgccatccagatgtctctaaattcaggtcagtactcacattactggtgtaggagtaccacctattacccgagtatataaagatagttaaagcagacagcttagataagtatcatactgtgatagacatatgcagaggctgccctgggagcatggagaaggagcaccttacacagacctgaaggggtacaagggcttgcaggggtggtcagggaaggctctagggaggagcagttcctgaggagagacctaggaatgcatggaaaatagtaggcaaagggaagagagggcttttctggccgagtagaggcaaggataatagctcacgcctgtaatcccagcactttgggaggctgaggcgggcagatcatgaggtcaggagatcaagaccatcctggctaacatggtgaaaccccgtctctactaaaaataatacaaaaaattagctgggcgtggtggtgggtgcctgtagtccctgctacttgggaagctgagccaggagaatggcatgaacccgggaggcagaggttgcagtgagctgagattgtgccactgtgctccaaaaagtacagggttggagaacagcatgctgagtgttgaggtaggcaaggtttcttggagccggggaatatagagtaacaatgcctgagcctgcaccccccaaaaaataatgcctgagcccctcagttggaatcagttctcagttcagtggccttggaggccatgttattagatgcccagatatttattctgttcattggaggaagcagttctctagaaatactttgcctactgatgttgatttctggccaagatgatgagtgagatggtgagatggttaagagcatagaatttggaatcagactctctgggtttgaggcctggctctgccacttaattgctgtgtgatcttgagaaaccgcactcagtttcctcattactaatatggaggttaatagtagtacctacttcattaaaattgtttgaacgtcaaatgaagtaatattctataaactacatggaatagcagttggcacatagtgttatgtattcattaaattaaaatgcattgccatggttaaacacttacattctgataagactctgctagatcccaaagatcaggtagcattttgcagaatggcaaactgtttcctttcaaaatcaacttatttttaaaattaagtttgttatgtggtttgccttcgtgtttttatttcgtttttttaaaaggctttgataacacaaagtggctttatttttccctctttccttctaaactaaaggagtatgaattttcttagaagttgtaagctttaggcttcaggatgcagggagtattggaagtgaagaatgaggctggcagctgctagtgatggtgtgaactcaagtctttctgtttgttgtataagaagcgttgagaggacaaatccagagagatgtttgcatcccgagattcttgagttagtcttttaatcttgaccaacacagatcagacttctactttctgctgcctagactctcgaaataatcatctcaagcctttactgccccatacatattctcgcatacaaagattttgagattaattaactttactgttatttcaaggtatcccctgtaatgaaattcacttggctttcaaagcccctgcttagtcagaacattccagagatgccactgtccagggccctcaggaagttgccaatcttttcgattcaagtttcagaatctttctatcattcgtcttttacaactcatttaaaattgccctgaaactgcctttggttactaactggttatatagactagaatattggtggcacttaaaagtaagaacatttgtttttgttttaggagattgattttaaaaaatatcaattaggattattttggcaagtaaattgtttaaaaatattctctttttcataagaagaatattgggaagcctagtgaatcacacttttttgttatcaaaatagaaacatttggtatgatccaatattaaacttcacagaaaaggctattaatcacttctgaaattatttcttccaaaagtattactctcgagttcttgactttcctgttgtgtttcctttccctttaggatgggtttgctctgaaattagtgaaggtggtacatgtctgtctttaagcagcagcctaatctatatgaccatatgtgcaaaagcagtataattataatgtagtattaattagacaatatgactgtttttgttttaattatttcagatcatcttatctttccattccttaaagcatgttaatggatgaatttatgggtaccatgttcatgttgtttctatggaattaaatatgtgcatattgatataaacccttggtaaacagttctttttttaatctctataatattatgaatagatttcctctcctttcaaacatcattttagtcctgaagactaaatcaattataaaaaaattgattatttacattttgcttaaagaacgctaattggagtacagatctctctggctgagggagaatcactctcgggttgatataataggttgttagaaattcctagatttacttctaaatgaattaggaatttacatactaaaatctcacattctgttgaaataatttggtagaaaatttggtgatggttacccattttccctaaatattaatacaagtacttagcagactgtatgtagaaactggcatttatctgtgttctgattttaacctttgtctccttatttttcagttgtttttatttcagttgctgcgaggtctgtcttacatccaccagcgttatattttgcacagagacctgaaaccacagaaccttctgatcagtgacacgggggagttaaagctggcagatttcggtaggaaagcagttaattaccagtctattttgtcatactgtgagaatgccaggcagatggtggcactgcatttgtttaggtgcacttcttctatcatcatagatcctggtaattttttttttctgaaatgaaggattttttcttttttttaatgatagcataaaatataatgctttgtggagttttataaaattcagactgcttgttagagtctttaataataaacataaatcagatcttggtaatatatatttccaaaggaaaagtcagtaaaattttgaacataaaatatatgctccttgagtgaaaatctattttttgaaacttttattatgaaaatgtcaaatatactcaaaaggaaaaaaataatataatgaacttcaattactcatcaaccagcttcaacaattactaatattttgccaaacttggagaaacctaaatttgaatgtctggaccttttcagagggttgcaggagatacacaataatgtacattgccctgaggctttaataactagaaatctagatgtagtgttaaccttcccagaattgactgttgtttcaagtattttcaatatcagtgcaaaaatagacacttattactatttaaaagttgaggttctggaatgagcattataagtcattccttccttagaagtcttgagattgtcttcttccagcatagaagctttcctccaaacaccatgtttgagcatccaaagggaagcacaaccattgcatgctccttgctagctccccttctcttgatcaaggttgacgtttctgcattgcccaggctctctgtcacattagagattgtgttgagttgattctgagcaccacgggatgcctgatggcagcataacgtgttgacattgcattgcctcaattatttttgaatacatattctgattagaaatttgttctattaagaatggaatgaaaatattacccttgggacataaagatgcctgaggttgagatgggcttttgctgaaatatgattatctttttcctctccaccccccattaaataaaagaaggcaggaaatgtttatttatttcaaggttagtagactgttgaatacctttggaatgaatctactttgttgggttttataaattcttttattcgaaaaatgaaataaaacaaaagttagtatgactagttgagtagtgatatagattataaaactttgtcatttcctactttgataaaaatgatgaaattctgtgcacattagtttgtgtgtatcatttattgccagattttaacattggaattacactaggtggctgggtataaaatctttttataatagggtagaaaataatgggagagtagtgggtggaggagagaaggtttgcagtttctcaaattcaagattattggctttactgtgaatatattttatagttggtcagtgtcaggaaatgaaaaaggatttataatgattttcttatggtgtgttaatatactgtaaggtatatgttgaaatacattattgagcattaattgtatgaacatgcatttgtcgtatatttataaaaagcatttttataaattttgtctgtataaccaaggatacaataggattgtatgtttgtgcttactagggattctttttaaattttatgctgatgttttcattgtagtaggtaagtttatcttaaaagattcttatggatctttactttaaaactgacattttaaaatatcagattcaaaaccaaattgaaatataattttttaaaatttagatgatttttttagaaaattagaaaatgtacaaagtataaacaactcagagatgacaaatgataacatttttctcgtttgttttcccagtagctttctcctgttcctttctctcattccttgcttcacttgcatatcacatagcctcaaaaatagaaatatactattttgtaagcatttttcaaataatatgtcatgaacattttcttattttattaagattgacaaaatcatttgtaacggcttagatttttttcattaatggccaaacctagtctctattcagtctcttattaatgagcattttagctctttctaatttttcactattatgctcagtcctgtactgaacatccttgtagagatagctattgatacagcaattgcaatgttgagtgttttaaagcatttggttcttatgaccagactgctgtgcagaaggatcgtgcccatgcacctctcctcagaggcatggactgaattgtccagcttggaacacgcagttggcatgcatcctgtgcacagagtgtagtgagcaagattcattcaccaactgacaagttcccccaattaattgtgtgattttttttgtcttttaatttaagacatgcaattaactgtgatttactgtgtttgggcatgtttgtgtgtctgagatgaaggaaacacactgaaaactgtagagaaatcagacagaataggatggttccaggcagcaaaacaattaaaaacacaaaggtcttaattcagtgtttgatgtgtgaagagctttaaaaatggtttctttgtcttaccttttttccttatgtgaacaaaaccgtaaatttttgactaaaagagacaaatacaaagtatgattgtagttctcatattgtaaatgatactacttttattagaaaaatatatgagggaaaagactaaaatttattgagtttattctatatgctacacacttagaaattcttgcttcattgtctcttcaagctaggaatgtatactaacctgtatttttgagagagatgagattcagagagggttagaatcttgcccaggcttggacatacaggttgctggttgcaaagctggaattcagatgcttgattcatatccttcaatctcaggtggcccagggcctttatatttatacatatagatattttctcttacagggctgcctaagctaggaaattattgatcgtttttgtatgctgttttctatatataacaaatatgacacccatgctttataaatagattacactggtacaaaaatatgcatcacataatttaaagaacactttgtcatttgactaattcagtagtaatgagtgagttcaaccttagtagactttacctgctggatgaggtaaaccagatgatagtgaatttggagacccttcagctttaaacagtatacagctctgaattccaggtagtcaaaatgctgtaactattttttttttctggtaagcaaagtcgtatttaaacccttacctgagccttattttctatatgcattttgaataagtaaattacacatgatttagaatcactgtggctttcctaatgcagaggtttgctctgcctggatataataaaatgataaaattatatggaggcattcagactcatttcctaaaagatggttcatctttacataatttaccagaaaagatttcaaatcccttttatagcccgtgtcctcaccaccttgttgctccttgtatactgtggtgcagccaaatcccaaacttctttccactagaggctttcagtttgcctttccttttgcttgggatgctcgtccttctgcctctcatgtggctgcctgtttcttaccatagaagttatagttcatgtcacctcttcaaaggggccccctttctgaaaatagaatctttcccattattatcttctagtctaatttcttcaataacacttccagggctctgacattatttttttcatttgttcatctatttagtttttgcttaaactgcttgattggaagttccgtgaaggcgggaacttgacctgttttgctcactgttgtttgcactatctctagaaccatgcttagcacatagatattcagtaaatattgattgaatgaataaaaaatatacatgactaagtggagtattagtcatgtctataccaaaagacatcgagattaaagttgccccgagaatgagagacagcgagaattctataatataagcatttaaggacttagcttattttattgactgtcgtggtggagaaacaaagtttaaaaactctgtggttataatagaataaaatcacattggtttctttcccatcagaggtctaaaattttaccttcctaatgttgatagtttctcttccaggctggtccttgtctaaatttgagagaggaaatcattgtaaatcatgttttagattaatttgaaaaacagaccagaaacgtgactctgtagaggacatggtaagttcatggcttgtcatatgcttctctgaattcacataagaatagtagtaaacagaaagaaatcaccttctttcagatgcagagtagtgtgtctgtttgataaacatagcctctggataaaagcttgttagtcccgaaggtacagacctttacctatgttttaaatcatttatgcacaaaattcaccattgaagttatagtcataaatttaaggttagatataacttagctcatttgttgtggcctgccggattcaattttactgtatctttcttttagaatatatttttaatagcaaaaacaactttattacccaatgaagcatcaatctacttctaaaagatcctttcaacatcttaacacctcaacagttttaaggcaaagtttaggcagttgctttcatgtagatctgaaagcaaagaatgtatttagaataattgataatatatgaaccaaagaaagggttttttttttctctctaatttctctagggaatgtcattaaaactctgaatgcaagtatacatattttaaaatctattgaacagactattaagattacatgttaggtataatttttatttgacgtgaactagacaaagttatttccctttgacacattactttaaagatatagtaactcttttgaaaaggaatgttgatacttaaaattgtcttttccctatcttgaaacatcagttaccttaatcatttacatcttgtttaatatcctgctcatctcctcaaaagtttttattttctattcaaggggaatgataatgacatctaattatattggatctttttgttttatgttatcacaacataacattgtctcaagcatattaaaattataaatatttgagagcatttttccttttagataaactttattttttagaagcgtcttaggttcacagcaaaattaaacagaaaatacagagagttcctatatacccgcttcccatatgcacagcctcccccactattaacatctggcaccagggttatacatgtgttaaattgaaaaacctatattaacacagcagtatcatccaaattccagagtttacattagggtgacatttgtcaatcactatagtgtcattgatatagtatcattgagaataatttcactgccctaaacatctttttttttttttttttttgagatggagtcttgctctgtcacccaggctggagtgtagtggcgccaatctcggctcactgcaagctccgcctcccgggttcacgccattctcctgcctcagcctcccgagtagctgggactacaggcgcccaccaccactcctggctaattttttgtatttttagtagagacagggtttcaccgtgttagccagaatggtctcgatctcctgacctcgtgatctgcccatttcggcctcccaaaatgctgggattacaggtgtgagccaccatgcctggcccaacatctttttaaaaactcatatagtttttttaagctgtaaatgggaacaagaaggatgtatatgaactgcaactaatatgcatatactattccatctatgagaaatctctctgttcagtcaccataagccagattgaagcaatgtagatagggtttgattgctaagaatggcagcttcaaactctatggaaatgaggaaatttgaaagagagttcagtttcagccaaatcatgcatgtgaggtaacgagacatcttttaaatgcagaacaaattgctacgcataggactgatcatcttattctccactgttgatggaaacttaggcagagggatttcattatgcaaaaacatcatgtgtttcttttttcctgtacaatttgagggcagaattgttggcagtaaatcaaataagtcatactggatgtaagttaaaatatagccatgtatccttagaaaatatttgcatatgtagaaagactggaaccttaagtagcagccatgatgaacacagtggaagaattaataggtgttgttaacagtagtaacactgaaatgaatcacagtggatttatgtaatacatgtgctattgaaggcaacagtgattacacttgaacattgttaacatatagctaagtgtcttagtctgtttcttgttacttagaataactaaatctgggtgatttataaataaaaaaattatgtcttatagaggctaagtccaaggttgaggggctccttttgtgagggccttcttgttagtggggactctctgcagagtcctgaggcggtgcagggcatcacatggcaagggggttgagcatgctcatgtaaagccactaatgccatttctgtgataacccattaatacattaacccatgaatggattgatccattcctgaagggagaaccctcaagacccaagcacctcttaaaggccccacctttcagtactgccatatttgggattaagtttcaacttgagttttggtggggacaaacattcagtaagtgtaaacgttagcttagagtttggcaattgcctaatatccctgctttatagatcctggcccatctctttctctaccttctaaaaagctcatgttaaaattcagcccaaaccagactccactactatatgtcaatatgcttgatttatactaaaatcttagatgacagtaaatgaattattgcagtctaaagcacatgttttctaaaatctttactggaagcgagaaaaactgaccagctactatgggaaatgtaagacatgctgtaaattctggttagacattttttttttaatttgtgattttaaacctttgtttctcactttaataccaccagttcaatattagttttctttcttccttttttccctagtttcttttttaaaaaacctgccatatgttggtttatttagctttgaaatagtacatatttatgcatattagtattttaaaatgtccttttcaccttgaataatttcttctgtggtaatagataaacttaggatattaggacttttttcattttaatgaaagaagaaagcactggaaaattaaaaataaaaaccaattaagaactaatggtctgtgctgcttattaattttcaatacatgtctgaaaaactttttttttatttttaccacataccggaaaggaatcttggtgcaaataatcaagtttataggcctaaaataatataactttttgcaaaaattcaaactttaaaaatggaacatctttctgtgaaatatctgtcaagatatttggcactctagtttttaatcagaaaggatactgatataaaaatgcagattgaagtgttcattccagttatggagtagagttgtcagctgtggaaatctgtcctgtgaaacaatgaccggctaatattggatgtagaaactgtgcttagatccagccatagagttgggagcagtagatgaaatgggtcagtgagttggctaaattaagtgcccatatcatgcgaatggaataactgaggcataagcagaggatggaaaacgatggaagatttcaagatcaaatgtttagtatggtttctgaatagttatcattaaggtctcaacatgcttaaaataaattgagagcatattgttataagaatcactgataccagaattacaagaacaatgtaaaataaactggttatagtggtgtgtgcctgtggttccagctacttggaaggctgaagcagtaggactgcttgaggctgggagtccaagtctagcctgaacaacatagcaagacctcgtctctaaaaaaataatgaaaataaataaataatgacatgtgagcattttgctcaaagaattgaaagcgggagatggtgttacttttgaaatcatccagttgttgatagaatcatatcattgggaacattttgttatagtttgttattcagaataaaggcagaagatctatgtggggaaattaaatcactcatataagagaaaagcaaatccttttacattgacattttcagattttttaaattgaaattttctctagattttgaaggaacctcagagattatgtaatccagacccctcatctgaaaaatatatatactttgggccagagatggaaaataagttaacattgtgcctgttacttagtgttaaattattattcctaatattattgttaccagtgtctttagagccccagtgtaataccctgtagagtattaataacttagttggcacatgcatggctagttccccaaacatgtgagaaggtaggagtgctaactggatgttcaggtcgaagtaagccatgctggtctgatgacctgtgtcacctgatcactgggatcctgtcaggaagatgagacccagaatactagatgtcactctgttcccaaccccacgagtcttgaggaaactttaagaaatgatacaaagaatgcttctcacagtagactagtaggaaaccttgttggaataaaagtttaaatagagctttggtaatttaaggaatcaccctctttaattatattcctgggtgaattaaagcattgagaagccttatggacaggtggaggctgaactggctttaataatgttcctgttagggctccgcagtgctgggcagtagctcaaaaaatgccctgatgcctgccaatgggagtaaattttcttttcagatttcaccttttccatggtactgtgctgttttttactcataacactttcaaattaactttttgggttatttccccacaccaataaccaattcaccaacacctcagacagacaccaactgagtgtctaaagattctatttatttctgacactaactacgcagtagcacagaccccttaggttaagggcttagtctgcaagactacctccgctttgaatgccagttgcaagtcctggactgcctgcatttctgactgacctgctacaaattgggcattcccacgcccccttccttgggttccatagtttgctagaatggctcacagcactcaggaacacatttgcttatattttctggttgactataaaggatacaactggggaacagccagatggaagagatgcatagggcaaggtagggaggaagggtgctcagagcttccaggcattctccaggggcaccaccttcccagcacttcagtgtgtccacaacccagaagctctctgaacccatcatttaggggttttatagaggttcataacctagatgattgattaaataattggccagtggtgactaactcatctttagccccttgcccctccctggaggcacattggtggagttgcagattacaaccctgtaatcatgccttggttcttctggcaaccaatccccatcctgaacctatctaggggcctgtagccaccagtcattcttcttagcattcagaaaatatactcttatcactaagattccaagggtcttaggagctctgtgtcaggaactgaggactaagaccaaatattataacaaaagatgctcttatcacccctgttactcagaaaattataaggattttaggaactctgtgccaggatgaagacctgggatgaagaccaaataaatatttcttactaaatcacaatgtcacacaaagtttggaaatagacagtacacagctgtagtgcaagtggtggtgtaacagaagtactaaagtacatatataaatataaatatatataaaaggtaaaatatgggtagggtgccgattctgcagccacatgcctgagtttgaatcctggtgaatctgacaattacgtgtcttggagttgctcttctcgaggagtatctttgtggcattctctgtatttcctgaatttcaatgttggcctgccttgctaggttggggaagttctcctggttaatatcctgcagattgttttccaacttggttccattccccccgtcactttcaggtataccaatcagatgtagatttggtcttttcacatagtcccatatttcttggcggctttgttcgtttctttttactcttttttctctaaacttctcttcttgcttcattttattcattcaatcttcaatcactgatgccctttcttccacttgatcaaataggctactaaagcttgtgcatgtgtcacgtagttctaatgccatggttttcagctccatcagctcatttaaggacttctctacactggttattctagttagccattcgtctaatctttttttcaaggtttttagcttctttgcgatgggtttaaacatcctcctttagctcggagaagtttgttattaccgaacgtctgaagccttcttctttcaactcatcaaagtcattctccgtccagctttgttccattgctggcgatgaactgcgttcctttggaggagaagaggtgctctgatttttagaattttcagcttttctgccctggtttctccccatctgtgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccctgtttgcctgggtatcaccagcggaggctgcagaacagcaaatattgcagaacggcagatgttactccctgatctttcctctggaagcttcatctcagaggggtacctggctgtatgaggtgtcagttggaccctactgggaggtgtctcccagttaggctactcgggggtcagggacccacttgaggaggcagtctgtccgttctcagatctccagctgcatgctgggagaaccactactctcttcaaagctgtcagacagggacgtttaagtctgcagaagtttctgctggcttttgttcacctatgtgctgcccccagaggtggagtgtacagaggcaggcaggcttccttgagctgcagtgagttccacccagtttgagcttcctggctgctttgtttacctactcaagcctcagcaatggcgacgcccctccctcagcctggctgctgtcttgcagttagatctcagactgctgtgccagcagtgagcaaggctctgtgggcatgggaccctctgagccaggcgcaggatgtaatctcctggtgtgccgtttgctaattccattggaacagcactgtattagggtgggagtgtctcgattttccattttctcgattttctgtcacggcttctctttgctaggaaagggaattccccgaccccttgcacttcctgggtgaggcgatgccccaccctgctccgtgggctgcacccagtgtctgacaagccccaatgagatgaacgtggtacctcagttggaaatgcagaaatcacccatcttctgcattgctcatgctgggagctgcagactggagctgttcctattcggccatcttggaacctctggaacctgttttaaatggactgatttttaaatcattgtcttgcatatttcatggtgatggttatttgactattttaaagtataattactgggcaagggacgattttaaaaatagttctttacatatcaatgttaacaactttttgttgtttgtagctcagattttaaagtatctctatcacagtgctattcagtttagctttcctggcaaaagaagtgagaataatttaataaaagggaatcattcttgtagtaaacagtttttatgatagatttatattattcatgccatgctttgagaataaaattatacttcatgttaattcctttaagagacagaacattttgtttgctaagcaggaatccattggtgtacttttattcctcataaacagcttagtgtttctgccaaatgttttcattcacagagacctgtgagataagaaattttgtggatcacaagaaaatttagtcctgaagaaatgcataattacaccttagtgtatactttaaagaagagtaagctatcatctagagtgaacactactactgctgtccaatttcaatgtttgttgtctcttaagggtagttcttgctgcaaatattactttttatattagcatgaaacacagaaatctacatgtaaaatggcatattgatttcttgaagtctttagagatttgatgctctgttcaacagtaaaattagtttataagaaaacagtgtacagaccattatattaatagcttgttttttaggacattttggtagtgttttttttttcttaattagattgttaccaaagttcatttgaccagtctttaaatctcaagagtaaacatatataagtggaaatatgcataaatgaaggagtattcttgtaattgtcagtaaaaaaaaatgcatagattgccaaaatgtatgatttgaaataatggtagattgtggattccttagcagattgataaatcaagtgctttgtcacatgtatccttcattacagtaaaaatatcagttccctacattttgtcagccttggctatagatagcaaagggagtcacttcttaaattttgaaagatgcctgtgtatttgaccttctatgtgaatgacatgtctgtggtctgccttggatatgggtgatatgggcatctgtactgtgcagtgttatagcacaggctaagcttttttttttttttttttttttttggtcaagctcaaggtgtagacttcagtgtctgagggcattcttatttttgaacactgaattcaacatttgtaagcattctggtttttgaatcatagaaatgtttgatctgcagcacttgacattagattgcttttaggaagcaaaatggactcaaacttcagtcatttctaataatagtaagagcctattacagtttatgaagtgcttcatagctcttactttgttttatccttataatcctgtggagtagagagtgcaggtctcattaccccctctttaatgtgagagcattgatttgtgcttgtaatattagctttatttaggcattagaatgaccaatattttaacatgggcatttctgttgagtcttcagacttgaaggtaattcatttgaaataatcttataagatcatatcatatgacttcttgtacatcttttaaataacaacatgaagagctttcaagtagttctgatttttattatgatcagtgattttttaaataggtatattacagataagtaagttttgctatctagcactgtatcaaagaatagctataaatgagctccttgatctccctcaataataaaatttagactagtaactggaattagtgctattaaaattcagacatagtatcactttactttgaaatgcacctaagttgagaaattttgatgcaaatttgaaattgcctttgaatcactgagtgccagattaaacatagcacttttacccaccagttctaaagggctatctgtaaattgaaagcacaaatgttgaaggcagtaaaacattctagaatgtgcaagttggccctttcattgccaaagaagtaaagtttctggaaagcaggaagacattaaaaaacaaaaacagaactcaacaccttttaaagtgatggatgtgatgtcaaacaaggtgctcattggactctactccatttcctttcctctgcaagctgctctgtccttctgcctccagcctcctgacagtccctgtcattgctggtgagaggtgatgtgtatggctgatgtgatgggggaaggaagggataagagaggaaaactactgttttgtcttcttcatagctgtaaattattttcttgagaaacgcaattgcagaatttgttcataaaaataccatgcttggttggtttagagaaataaaagatcaggagggactagagaaatatttcaaatgaaactttcatctttggattttgtgtgtgtgtgtgtgtgtgttttggtgagaagttttattgttttgggtcttagaggtccccccacaacaaagtttattctaaaacaagtttttactgctttgacttatcttagattgaagctagtctgttgattcaaacacatgaatacgtttttttttcttacaaaatatgttgagcattatatatttttgttgacaatttacaagacggaaaaattagggaagcaacaaaacttttcacaaaatatagtttgttggataacagcaaatttggatatttttaggaagagttggataatttccctcaattcgtgggatggctgttgtccacttttgcacatgttctgcctcctgtctgaggcattcacagctggctttggatttctgtgtctcctaaagcttctgtgaatctgaaaagtcatttctgaaactgtggtctgcggctgggagcagtggctcatgcctgtaatcctagcactttgggaggctgacacgggcagattgcttgagcccagaagttggagaccagcctggccagcatagtgagactatgtccctatttcataaaaacaaagaaaagaaaaataaaattatggtccaattaacaaaataattgttaaaattaggaaaaatgtccttgatcaaatctgtttggggtgagctgcatatgtgcatctctcccatctccccccagccagtagaatctcaatgttcattagctaatgattaaaagctcttggtcttctgctgttaaaattaaatctgccattacatctcccagatttactagattaagaacaaattttggactctgtggaacataagttggggaaatgttggtatattagctgtctgttgctgtgtaaaaaattaccgcaaaataagctgcttaaaatagcactggtttattgtctcagtttctgtgtggtaagagtctgagtatggcctagctgggtgcctctgcctccaggtgtcccttcagtctgcacagtcagctaggccttctcttgtttcatctgaatgctccactgggaaaggatctacttctgagctcacatggctgttggcaacattctgttttttgagtctcttggactgcgagcctctcacagacactcaaaggaagaatattccacaacaaagtgaatatgaataggcaagggagtcatgggaaccaccttagcgtttgccaaccattgttggtatcaaaagtactgtccaattatgtcgtggtgattaaactatgtgatatggttttccataaggaataacagttggctgggcatgatggctcatgtctgtaatcccagcactttgggcgactaaggcaggcagatcccttgagctcaagagttcaagaccagcctgggaaacatggtgaaaccccaactctacaaaaaattagccaggattgcctgagcccaggaggtcgagactgcagtgagccatgatcttgccactgcatgccagcccaggtgacagagtgaaaccctgtctcaaaaaaaaaaaaaaaaaattgttagcatgtagtgcatgtcagcagctaccttagggtgtaaagatttataaacggtattgataatgatgatgattaatgatagtacaggtgatgataaggaagccttattggttgttgctcatgtgaaacactagggtaagcactttgcctgtagtatcttttcaaatcttcacatagtctccttttctatataacagttcgagaagttatgtaaacagagggctgtagattgttttcaaacagctcactgagaaaatagacaatttatatcactaactatattgtatgacaagtaacttctttatatagaatggcagaccagaaaaggacactgcactttttgcttgggagatttagagagaaagacctaaagaattattttcaaggtccaaataggatttcatgaagttttaagacaaggacagagacagggctcagtataagtaaaggtaggtaaggtttatgttatggtaatatttcataatcctccactagtaacattccagaagacagagcttttgctgtgtagccatgagcagaaatgttgatgttcatgtggacagcaaagctggagagtagattgtcaacaaggtggtagcaacagtaacagatggcaattatttgattatattttttattatttatttattcccagcctctttccaaaatggctctgaagcagctgctgatctgacgctccactcgctttattcttatttagcctgcaggctgtgctaggcagacttgtttccatccagcacatgctctcactccagttgcagtctccaagctccaaccttcatcatgtgcccctggaaaggcggtcagtgcccaggaggccttggggcgtgagagcagtggcacaagagggtttcagcatgtgtttctctggcctcctatcagctggaacctgctgccagtcaggcgggacttaggccaggaccagtccctgcccagatatgcccctgggactatggcagagccctgagccaggtgccagcaatgtacagtttgccatgtacagggccagttggcagatcaaaggaggccagcctgagtgaataagtcctggtcccatttaccagtcctctgggatagaaggagagtgatagccaaggctcacagcaacaactggggatgaaaatctaggaacctgtgtcttttctggaagtccttcccttgagcagagatggcagcaaaaaggcaggctccttttgcagtgaactttagttttaaaagcatggtatcaaggaattggaagtccagtatttcttctaactttgtcaccagttagtttttttattttggacaagtcacttaaatggacagttgtgttttctgtaaattaaaaaactaagaatgaattcagtgatctattttagctttaagttatggttttaatgtttttaaatgttccttaaaaactattattttaggtaagttattccattccctaccagatacagatgtagatgtatagatacatacaccaaatttgtggttgtttctttaaaaatacttttgctaacttcaaactaaactgcttggctcatgaaaaattgaagaaattcaacaaatatagaattattcggactgccagccttatatggaatggagattttattgtcttcatgtattgtcttgtttattttgtaatgctatcacaggatagtacagactaggtaatttataaggaatagaaatttatttcctcaatcccctggaagctgacatgtccaagagcaagaggccagcctctggtgaaggccttcttgctgtgtcatccaagggcagcaggtagaaggacaagagtgggcaagaaagagagacaaaagaggcccaaactcacttttttatatggaacccactcccaagataatgaaccaactcctgccataatgccattaatccattcatgagggcagagctctcataacctgatcagattttaaatgtctctcttcttaatactactaaaatggcaagtaaatttcaacatgaatttgagaattgataaacattcagaccatagcagtcatcattccagtgactgaaactaggtaattagggaaaggaatggcaaattttaatgctatcagaaagggttatttttaaaagtaaattcaaggcaaatttttaaatatatctttacattatacaaaaggggaatgcacagttattttcaagatgtattcattgttaagacattgggaataagatattaacaaagagaactcttgaaacatttgcttattatcttatgattacagtagctataaattccttaattgcatgtatacctatctttacataatgggcaattataccaatgataacatgcattctgttttttttcactaatatatctattagtaagattttccatgtatttgcttttacaattataagtaatatatgtgccttgttttaaaatagacgtcacagatagtcataaagaagaacataggctggccgtggtgcctctcacctgtaatcccagtgctttgggaggctgaggtgggaagatggcttgacttcaggagtttaggatcagcctggacaacatagtgagaccctgtttctacaaaaattaaaaattagccacatgtggtgacgtgcagctgagtcccagctactcagcaggctgaagcaggaggatcaatagagggaggttgaggctgcagtgagtcatgattttgccactgcactctagcatgggcaacagagcgagaccctgtcttaaaaaaaaaaagaaaaaagaagaagaagaagaaaatagacattgctatcttctttctctaatttggccatgttaacatatttttcaccctttcctatgtacttacgtaacaatatatttttctgttttaaaaaaaagttgctttatttttttaacaatatataaattgcattttaaggccatgtgattttatttgttgaatttttcaacaggcagttaccagtttatttgttgtcccaaatgaagttcatagaaaagtggagatttatgtgagataccagaaatgcagtagaaaacagacaaatgtttttccatgaaatggtcacaaattttatatcgaaatctagtaacatcatattctaacatgaatcagtcctttgcttccttttacctcaaaatattcataaaatgtactactaagatttttaatgaagagaaaacttttgtctagaaagctaagtggtctcctatagctttttatctcttttttcctttgaactcactgtggttatgagattctgttagtagataatgggtttgttcagccttgttaaatatcattattttaatttttgatatgtatctaaagctgaataattccttaaaccttttgattctgaaacctcagcttgggtgccctcaggaagagaatactctccatcacaaaataattaactgctccctgatttaccacttacttcctggtacacgaatgcatatgcacgctgtgtctggcatctaaattaaaatattttaggccaggaatggtggctcacacctgtgttcctaaaactttgggaagctgacaagggaggataacttgaggccaagagtttgagactaacctgggtaatgtagtgatactctatctctacaattttttttttaattagatgggcgtggtggtgcacacctgtagtcctagctatttgggaggctgaggcaggaggatcacttaagcccaggatttcaaggcttcagtgaggtatgatcataccacagcactctagcctggatgacagagtaagaccttgcctcttaaaaaataaatcaaataaataaataagcaaacacataaataaataattcaaagtataggacactgtgagtaatatttaagaataagttctcaaattctacattgttgtgtattgtatgatatatatggtaaactgtagaaacattcctgtcaggaatcacatagctcaaatcattagctgattttcgttttcttcttttcttttgatatttttattatccaactataaaaatgaggtgaacttattttcagatgttttctttttattgcattatattttacataaaatcaaattgccaattacaatttgatgaatttggtaaatgtagtgtgaaaaccacctccacaatcaagttttgtagaacactttcatcatctcagaaagtatcctggtttcctatagcagtcaagtaaacattgtatttcttgctattaattgttgttttttcacaccttagtcaatctggaatagtaggatttcagataataaaatgctgcatagaaaacaaaatttctatcttaggagatattctagaccagaggttggtaaactttttctgtaaagagctagataataaatatttttgcccatgaagtctctgttgcaactacacaaaatctgttgtttcaatgaaaaatcagccacagacaccatctcaacaaatggatgtggctggatttggttcatggagcataatttgccaacccctgttctagacctttgcagttcagttgttcttactaataaccaatgagctggtaataaagcatttggttcagtgagattttcaaaggaaaaatagataatgaaataatttgtaatattataatttggtatatactcatctttaaagttattatttctgaaagtatccaatatatgatactctaaaaacctacaaagcgtagctagagtaagttcatgttacacaatttttatagtagttgcaaagagatcatgaaagaatagtttggaatctttatgtgtattgcaatttgtattaaagctcaaattgtagatcctaaatcataccactaactgataaaatgtttacaaattgttgacttctgtcaccctgtattttcttttcatgtaatattgctaaatacagatttctttttcctgtactaaatggcaatcctttcttaaatgaataatccatctttgttttgtgagtctttcaaaaccatctgaacaactccactaaatcctgtaggtttgagagcttgtggaataagaatgccagcccttgggctaatttagcacatggacagactaggcttttacatggtggaatgctaccttctgaacatgtggcctttctcacaggcatctcttccctccttaaaagtccaacttgctaatgttatattgtttttattaaacttttggggggttaaaacttagtaatctagttaaaaactcaacccaaatttattacttcacatattgccaacaaatgacctcatcataggagctacatgaagtcaataattttttttaaaaaatgagtcatttgtgactttatgataataatagtgcaacaatgaatgctaatgtaagaaaactatttttagaaaaagtgttctgttaaatggcttaccttttgacttaaaagttagtaatgtgtgaagttgccagtagttgaaacaaaacaaggtttacagaaaataattgatattataaaggatatcttttaaaaattccatgtgtgtttgctttgattttgaacactaattcccttgaaatttgttttgagacatatatactgtatttgtttacaacatttgatgcattgtcatctttaaagttatataatagattgggagtaattttgtgtccatgatttattgtttcgtactttggcattttaacatatagtcataatttccaagattaatcagtccacatgtactaaattttacttctatacttatatttcaaatatggtttcccctttttgctcctttaacaaaatatttaatgagggaaacaggaatatcaatacaagagtggatagcgaaatagcactttatgattctgtaactcaaatttgttttgaagaggatttctaaatttcaagtatcttcagccgtagtgtaagatttcaaataaagctttattggagaagataaaggtattaaggacaagttatttggactgacaagatgggaatatttaaagtatacataacagattctgaaaaactaggacatgtgcttcagatgtaagatttcttactgtaattcttaaaggctaagacatttgtctagtatagcacaagataagtttgagtttcattgctgccagctctttatggcagtcttctgtgaacactcttggtcctaaaaaatacagcatgtgtaaagtttactgacaagtgaggatacatagattgtcgggttgcggacagtaagttcaaacttatcaaaatctgtccaactgtattcttgcattcatttgtattggttattagtacagtcttcttggatgtagaaatgcaacattcattgcattcattttatgaattatataattttgttttaaaagtcctagatgcttggccagttttgaaactttcatcatcttgtagaaatctattacaggatttattctgcaagcaagtttcccttcaaggaagattttagtttttaacttctaaattgtttgatgattcagattgtgcatgcaagcctatcccaggttttagtagctaaatgagctattatgcagacaagcctgagctttggaaggcaacttggttgtactagtgagaatatttaaatagtagtttatttctgcttgttccacccagtctttaactcactcctgccagccaccagttttcctgccatgccatgaaagcctgtcatttacaaccgatgactattttagaaccaaaccgtagtgaaataaggctggagtcggggggatgtagggagctgagactgcccagggctgtgtgaggacttattagaccctttttctttctctcttttttttctgtaggtaacatgtgcaccctgtaatagacattgcaaagagtacaaaatgggagtatagtgaaagttaaattttcttctctcctgttttcttgttcctttccccacaggcagttgcctttaccagttttcttatgcatctttccagagatccaatatgcaaatagaatcacacattttttacataaataatacctaatatgccccctgttatttattttgtcttttccattaacaatatattatagttggttccatattagtacatagcgatttattggccttattggctgcattttgtatctgtactgtaattccagttctttcctggagtttgaagttatttttagtcatttgctacaaacaatgtcacaatgaatctccatgcccgtaagtctttgtatgtataaatatacaataaggctgggtgcagtggctcatacctgtactcccagcactttgggaggctgaggcaggtggatcacttgagtccaggaattctagactagcctggacaacatggcaaaactctgtccctacaaaaaatataaaaatcagccaggtgtggtagcatgtgcctgtagtcccagctacttaggaggctgaggtgggaaggtcgcttgagcccgggaggttgaggctgcagtgagctgtgattgtgccactgccctccagtctgggtgacagaaccagaccttgtctcaaaaaaaaaaagtgtatatctatctatatctgtatttatatcaatatagatatatgtatttatataaatctatctatgtatatatatgataaacacctagaataaagttgccactggtcactctgaaacttctgaaaaataaccaatggcttccaagttcagttcaaccagttaactcaatgaacacattactcatgtattgatcctgggggctttcaacaatcagacatggcctctgccttaaataggttagggccactttcatgtgatggttatgcttcaagacaaagtgctgggtgacaaatcagaggtgccattgaatcttgaggaagtccacaacagggaaaaataacttgtaacttcagtaatcaaggagaaattagaggatgggttgagattagaattagatatgggaagtggcagagaagggcatgtggggagggtgcctggaagcatggatgcaccaaagtgcatgaaggacatactgcattctatcacatggacctcctcaccatacctgtgacatgccaggcccaccctgtctcaaaacgtgagcatctgctgtacccactgcctgaatcacttcccctagatttctttatggcttggtctctttccaggacattggggctcctcaacatgggccctggttatttgtttagtttgtttgtctgtctgtttttagagacagggtcctgcaggagagcaagacagggtaaagagcggtggtgcaatcatagctcactgcagccttatattcctgggttcaagtgatcctcctgccacttgagtagctggaactacaggtgcatactgccaaacccagctattttttttttttaattttttgtagacatgacatcttgctatgttgcccaggctggactcaaactcttgggggccagcagtcttcctgccttagcctcccaggtagctgagaatacaggtgcatgccactgcacccagcatgggccctgcgagtttgcaccagtgcatcaggtgttgttctgttgtgtctgaagcaggtgcctcatgttcttgtaccttgctattccttttcatgccaccatacaagtgcctgtaatgttgacccttagggcacatcctggctcctccctggtgtcttccactgcagtggctattctggcttcctttgccatctgcccaagggcaaagctgacccttttcttagtcggctacaatgcagctgatatctggctgttatttccaacaagattttatgaaggctggacatttggggatgggcagggcagagcagaggtatcacccacttctcttcaaagtgctctgctcggagcttagaggatcagtctcagtgtgggggaaagggatcccttatctttatttcctgtgcatctctctctgactagggccggattctctgtttccctagtgattacaccctaggcttgctacctggaattcaggccctacaaccccaaggcttgggaaggaatattctctccctgtgagaatctaaggtgcctgggaagtctcatcttagatcttggagtccaccttccagcacataacgtttatacaagacagagctctgggtgagaaatcagaggcacagttgaatcttgagaaatttcacaagaagaagaaatgggttgagaaatttcacaataaggagaaatgacttttggcttcaggggttaaggatctgatcacaaccaacagtcccacatcagtaatccttgtgagatttagacttaaatgttactgcaagttgggctttattggtccatttctttggaggatgaatagctttcagcacacaccctttcttcagttctctgagttcctgaaaactgctgatcaagaatagggggaaccttcattgtgcagtctctatgttccctgagtcagtaaacatcttcctcaaagaagccacagagcctcagaaacatggctctgctaaaacatgcacccggcttacatgaaacactttcttctttttgaaacatcaagatgcaggttaatttcactgcttgccccagaacagtgggtagggacttgctttatatttatataacagaatttgccgttaagttgatttttccaagaataaagaaacagcctcaaatgtaaattcaggtctcttccttcagtaaagctgaacagctggaagctttgaaatgagtatttttatacttctgcctgtcaaggtttttttttaaaaaaaactgtcgagtctggacatacctatttctatggctcaagttaactcgttgagaggcagctaaagtgtcgtgctgaatcagagaagcctgatatttctgtggttgagctctaagctggcttaacacatctacgtataataattcatagcctggaatcctagtaagcaaaggaagaattaatcccctttccaagtgtgttttacagagacttagtcttgtctaaattgtacattttacataagacccagtgttacgtagagatggagaagaggtggggagtggtggtaaaaaattgagacaatcataagaaatgatccttgctcttagggagtatattttgtatagctagagaggtaaacagagataaaaatataaataataacagatttatatactgtctgccaagtgagctgaatagagattgagatgtaatataaaagtttagaggagaaattaattcttgaggttttatttatctaaaatttaaatatcatattagataaaatttgagaaaaattgattagtcaggaaagtggctcccttacttgtatttaagggctggtagcttgtatattaatagccttatggtataaataagaatattaatagccttattaatagacttgtatttttatttacaatattcgtgtgcatcataaacatattaaagtattttatgtctgttttggggttacttcttaccccctaaaggggatcttgagctttaacgtgattcaactttactcatattaagttctttaacgttttgaaatccaaggataggttttctattgaagtctcaaggtgaaaacagagatgttctggatgagttggggtgggtcctgctacagtttgagtgtttcccccagaatatgttttggaaatttggtccctagtgtggcagtgttgggaggtgggacctttaaggggtgattaggttgttaagaggaattaatgctgctcttgcaggactgggttaatcctcacaggagtgagtgagttcttgctctcagggaactggaatagttaccatgagagtggattgttataaactgaggttgcccatcatgttttgcccttttgtacgtgcacacttcatccttccacttctctacaacatgatgacacaataccaaagtctatccagatgccaatcagatgcagctgcctgattttggacttccaagcctccataaccatcagccaaagtaaactttttttctttataaatgactcactttcaagtattctttgatagcaacaaaaaaatggactaagacaggtccatccctgtaggctgggatgacacacaagtgcgatctgccaaaggaacctctgcttcagaggttcatactaggtggttgtccttgccagatatgtcagtttatcagtagacttactgcaggccagacgtcatgccaggaactggagatacaaaggcaggtgaaatgtggccatggccaggtgcagtgccccacgcctgtaatctcagcactttgggaagctgaggcgggaggaccacttgagcccaggagtttgagaccaacctgtgcaacatggcaagattctgtctctacaaaaaatttaaaaattagccagacatagtgatgcacgcctgtagccctagctacttggaggctgagctgagaggacctcttgagcccaggagtgtgaggctgcagtgagctgtgattgtgccacagcactccagcctgggtgacagagtaagatcctttctcaaaaaaggaaaaacatgtggccttattttgggaaaattggtctgccccacctgtgtggggcaggtggcagctgtcatgtaaatgaaagactttgctgtgtttatctgttaagtgcagtgctgaggtaaatcagagaacagaggaacgttcattacctggaccaggaaggggagggcaagtcagggaagcttctggaggccttggccctgagcataattttgaaggatatgtaggagtcatctgctgaataagtattaataattacaggatatgagaccatgttgtgccaatgaactgacataagaaaaaaataattactggtaatttgattggctgctaacagttggctagaacatagaaagggatgggaagaaacaaggtagtcacatgttcttttattccttggaatttggacttcagggtaaagcccagaggatctattaagatttttagcagagaactggtttaatcagatggtgttttagtttatggtaatagccagtatgaattaagtgttactctaggccaactgtatgattaagcatttttcatgcattatctcatctaattcgcacaaatacctttcgagttagatgtggctattgtatcaggattctagaaggaaacaaagggcaacacaaatggggcaattgaggggtgttcgatgaagggactgtttatgaaactctgggcagggttaagtatgtggaaccctttcaggctagcaatagtgtggaaaatttcactactcctccggggagaatttagagaaattggttctggaactgcctgagcaagagctgtagccttctaaggaataacttaggcaataccatttccttgtccagctgggaagaagccaggagaacaaatatactgagctcacttttctccttccttatgatcatttggtcagtttgctgcccattggccaaacccaacttgaggccaggggacaaggactttgtaattacacgctcattaaggacagcctgtggggagcaaagaacagggtgaaggagagtcaagaatgcatcagaagaggcaaattcagaatatctagcagagttttactacatgtatttcacagacaaagccactgaagcttagccccaaatcacacatcttgtaagtggcagtcatagctgaccccaaagaggaagctcttacatactacatcaaactgtctcttcatcagaatatggaagaggagtaggaagggcaaactttgcagctaggagaccagttaataggctcaagacccagaagtgtttaagtctgagggcttgatgtggcagcagcagtggggaaaaagaagggaatggattagaaacagtggagtggaggcagaatgaacagaactttgggcctcagtttattttctgtttaaaaataaataagaatattatagaagatacagactgtcttagatccttgcctgaatgaaagctctgtgatgattcttctctgtagtgattgtggtatgtatttatttcatggaattaatgtatttttgaaaatattccctaaatgcttcttttggagattcaaagttgtgacatttatttactacattagcaatgcccaactccaatttcaagacaaccaagattgtcaccaggtgtcacaaagtagctttaaaattatcaaaataaagatgtgcatatcttttaataggcctctcctcaaatagaatgatgaaagaaaagaaaatactaaaagcatggtgaaaataattcagaaaacctgggcagcaaccataaaatgtaaaagtattacaataattcaatatgacccaaagcttttttttcttgaatttgctcaataatcgcctcattaatttgcactgattcataagggcatttattattgaagaaacataaaaacctcttagttcatgtttgaaagtagttgcctatttttatctcatggaatgttttaaaaattcacttcagtccgggcatttcagaagagccttttatttcagtgttatttattacatgccctttagattggctttgaccacaccccagtttgaggtttctgaaaacaaaaaacaaaaaacaaacaaacaaaaaactgtccttaggatcctgtaagataaataggccattcccttttcacggtccccgtctcccagcagtttccatttcccgctgttaccctgcaagccatcacagccttctagcttactgctccatttatgtgtctactgccttccaccctttccattttaaaacaaaacaaaccaacagacaacgcagataagagttgttctcatttcagcaaccagaccctagcttgaagtttcctgagcttttccctgcagtatttccttaacgattttctcttttcttcacaggctttttgtctgattatctggaggctctctagacagcgtcagtcattctctctaatgtactcgtgtttttggaacctttttccagaacaaccagcctgtgttttcagttcacttcccattcctgtcttcgctgccatccatcccacaaccttatccctttcagtctccctcaccaggctagctggtcaccattctggactttggatctgctggtctaggctaccatccaatgtgagccccacacttgccaggcaacctgttcccaagttcccagtcttcttggggaggtgatagcactacctgcattttcccagccacttactacagtatgacctggggtaaattagtttctctaggcattagttttctttctgttatattgggatacgaataatcttacgacactctaagttgtgtaaccattaaatgatataatacatttaaaaccattagagtacctaacagattataactgctcaataaattatcttgtgctttgcctctgtgtaatgagcactgtacatccactgattttcatgattttgtattatctacaataagaccaggtaaggatattgcctcctcctactacttaaaaaagaaagaaagaaagaaaaagaactctaggtggtttaggaaggaaatgggaagagttttctcataagcctcccatacaaacactcatactaattttttcttttaaaaactaaagaaattaacacactaacaagagcatatgttgtcattttaaatatgtatgtataataaattttatatttatagattgacttctttcctatcaaatgcaaagtatttctctgacataaatcacagttagtcttaccttacttgacataattatggttgtaattatttcaataaatattttctctttaacacatatagatacatacttgtataatgttttgagtatatattaattcatgtttacaaacaaatgccttaaaagttctgaatattatgccttgacttaaaacagattcttatgatgaattaatgggttttaactttaatttttgaaaattggtaataaatcagcatcattatggaaattcatcaaaattgctgatttagtcaggttttgaaattcattttttatattatgttgtcatctagcattggaataataaccacaagtttcattaactgagaagcagaaactagaaaatgagatgtaaaccagtgaactgtgaaaatgatgatatattcacatatactctattgaaaatgattttgcattctctgctaatgcagatgtgatatgggattgttgaggtggaattatttaaggggctgcttaagaatttaagcatatatgatattcatacattgactaaagaagattttagtgaaaattattttcttagaatcactgagcattagtacttgaatgaattagtacttaaagttaacctagtctgtcccaggagtcagcaaactttttcttacagggccaggtactaaatatcatagcctatgggtcagatggtctctgtcaactattcagctcagctgtttagtgcataagcatctataggcaatatgtgagtgaatggatgtagctgttttccaccaaaatttaattacaaagacaaatgcctggctctcaggccatagtttgctgaccccagatctcaggcccctcatcatacacatagtgaaaccaacactagaaagcttaagtcacttaatcaaggagaaataacaaaataacaaacctagatagtgccagaacctctaccaggcatttagttttgccatatgacaagtcttccaatatgcatgctaatgctctaagaacaacagcatgtttatcattatagtatttagccaaagaattctaactagttggttttccacatctattaatttcacttaaagttgttatttcccagaaaaccatattgtttttattttctatgcaaaaagagaaaaaacagaaaaaaatgtaattcctatactgtatatgaaagttaattatttgaatattttctgtcttctttggaatgcttatattaaaatattatttctgttatttaaaaattatatatatgtgtgtgtgtgtatagtttttttatttgtttgttttgttttgttttgttttgtttagatggagtttcactattgttgtccaggctggagcagtgatgcgatctcggctcactgcaactgcacctccggggtttaagtgattctctgtctccgcttcctgagtagctgggtttacaggcgcccgccaccacacttggccaattttttgtatttttagtagagatggggtttcatcatgttggccaggctggtcttgacctcctaacctcaggtgatccacctgccatggcctcctaaagtgctgggattacaggcatgagccactgcgcccggccaaatgaaatatattttttaaaaaatctgtgccgtttaggatatatataaattaggcataatttattgaacttaaaaaattcagggataattaaataaaatcaaatattaccttaacatgtttcagtgtcttctggacttaattcctttttatttatgttcaaagaatacccttattcagtagaaagactactgaatgaatctaaacatttttaagggattttggtttcttataaaaagtagcactgttgaaagtctggacagaaaccaaaacaaagatgttacatacaaaggaaagaaaaggatattttaattgtaatcttgaaactacttttccaccttaaacaacaccataggatggcaaatgtatttaaaaaacaaacaaacaaaaaacatagacctgtcctcagggcgcccaattttctggaaaggatacacttcctattaagtcaaataagagggagggagttggtgggtacccacatctcatagtgattatatgagtagattgggcatttaagtcttttattgttattgttactgttattcgcattgaggaatgttccaattaaacaataaaattaatttttgtttttatttttgttttttgagacggagtttcgctttgttgcccaggcgtgatctcggctcactgcaacctccgcctcctgggttcaagtgattctcgtgcctcagcctctcgagtacctgggattacaggcgcgtgccaccatacccagctgattttttattttcaatagacacggggtttcaccatgttggccaggctggtcttgatctccttcaggtgacccacctgccttggcttcccaaagtgcagggattacaggtgttaaccactgcgcctggccaacaataaaaataattttaataaaggtagatcatttattgtctatattttgaagataatattgtgccatggtcagacttgctagtgtaataatccaataagagatgatatgaggacctaagaaggaggaagaaaagagggaaaattataaagtaaaatccactgggttttgtgattttgtaagtgcagagagactacaccaaaacaagacttccagctttggtgaatggatggatggtgatgtgtagcagtcagctggagacgctagaggatgtagtactggttagaaaattggagacaggagaaatgttcaattgagatacctgtggactatcatggaagatctaagtggacatttttgatttagaaacatgaagctttaggggaagattgatgctagctatatgtgtttgggatcatcagtatatatagatagtaacttaagccatgggagtaaatggagtcattcagggaaaccttgtcaagtagagagaaaagattaaaggctagaacaccataagaaaatatttgtttgttggttgtttattgatacattataaaagcagcaatagagtatcttcaaacagtgttaccacatcataagatatttaatatagtataaatcctgtaggagggagaatattccattaaaaaattatatcaaaaatgagattcttggccagtctttggctgtggaatgggaatgaaatccaaaagccttcaccccgtggactgattcatggaatagagaaggcctcaagtctttcccttcccagtgtaactgtcttatggtaaaatattatccaagcattttatgtctgtttggagtcaagtgataaaggaacctttctcctagaaatattgattttgtgattaactaagagcaagacttttttttttctgattaatttggggagtaaggtgtgttgagagagagttgtgggagttgctctataatataatatgaaaccactgaccaacacaaagctttggcccattttctggaatgactctgaagtaatgaaagatactatttctataccgtatttttgttgactctgcaaattcagctagatttgctgttattaatttcacttagttagaaaggagtaagtcagtgttgccacttccttctcaattctttagtcaaagcaaaggaatgggaatgatcatttctgaaccttatcctaggttcagcaattttctccatagagttaaagagattgcttaaatccctagccaattttaccacctacaaaaaaaaggatgcactggaatttgaaggaataattaaatgtacatggaatataagttctagtttacatctgtgtacagctaaaagaaaagaaccttggctgtttttggaacttgaaacagttactagtaaagtgcatttgctcctggactcttttggtgtattctctgtattaattctggctggagttatattgagtgcctgtaggacatctagcacctatgcctagtaaggaattacatagaaccaggtctgaagcccaaagacaagtataagctggaggtaaaatcttgggagaaatcatctatggatggcagttaaaaaactcaaaataaggcccagtgacctataaagtgtatatatttgagaaagcactggtttgagcgtatgtgtatataaccataggcaaaaccagcatttaaggggcaaaaaggggtaggtcccagaaggagaccaagtcattcctggttaactatcctatatctgagaaataaagggagaaaatgtagaagaaagggagtggtcagcagagtctaatgcagcagaggctgttatgatgaggcctgaagagtctccattgtttggtgctgaatggctggtctgcgtagggaaaatgtcgggagcactgtcccgtggtttattctgtgtccatgccagagggtagaaccaggctcagggtagcagcagatattatctataagataaccatcttatagagatgtgaggaggaatttttttattggataagaggttagctataaagcttcttaactcctccagaaatccaagattctgctatgctagtatcagggtagctcaactttgaatcattggcagtagggcttgaatagcaggattatcccttttactctggggtctttcattagttagaaatgtcaacactgtaaagttggatacactgaattttatgcaagccattttaggtgcccatcggaattgtaccccttcatgagcacacactcagccaaagcagcaacgtgcatataacctgcacttgtctggttagcactttgctttttgtcttttaaatcaaactaaacattaatataagaagttttgataataatccatgaactgcgtcttttttaaaaggtagtgtagctctgttcctgtagtgtaaccatagcaactgacaaagaacagagaaagaaagctttcacacatgctgtgctaattaatcctgtcctacagttttctttcaactgaagaatgcagtttaataaattttgcatgagtaagcatgttttgatgcatgaactgtataaacatatagcaatatctttaccaaaaatatttgttaaaaatgtagttatatatatttatacttcaaagtctctttctctcctcttttgttcattcttttctttctctttctttgcttctttttgtctttcttttatttttattttttgagtcattgttttaatgattttctcccttcctgaaaagttttgggattttcttatcctattaaccaaacagacatttttagggtaaaaattttttgttcatcaatatagaggacactttctacaataaattgttttaattgactgtgttcaaatgagatgagagaatttttctcaagcaatgtagaataatgtatcttaaaaatataataacattcttcactctgacacatttacatgcaaaccattttaagagactcagtcttaagctttgaaaagttagatattgaaagttatttttactgttattttgggaagttatgtggctcatctgaataaaattggagtagtctttggcctaaacatgtgggaaaaaagacagtaatgtagataaagcacttttttctatttgtagtttccaaaaatatttaaccagtctagcaaactcatattcagagtgagcatagttgatctgaaattacatgtggttattttgatttatactacttctagattattttgaggtcttattttcccctttacaactgggaacatcacagtttttttataactagcctggtctgagctgtcaatgaaaatcttcaattttttttcattctctcatccttctggcttagctttctgacaacagggcctcaggaaaaccaagagaatcaagctggaatgtttgtagcatcccatttgacttgacaacagcatatggaacaagtcagaacctatttcaggacttgtgcctggctctttagtctccatatggaaccataggcatttgaggaaccaacccttttgatggggttaccaagttctggagacactttatcatcttgattgtcctatctattgttcaattttgcctgaattaatgtaggataaaaccttgcagaggaaagaaggaagaggttgttatagaaatctattatcaaaaataattactccattcatgtggagaaaaattggggaccaggaatgtgtaagtatgtctgtgtggtataatctgtacattttaatatggaatacttgtaaatatcaaccaatttatagtataccattgcattattattaaaactgactggtagaaaaaaattagggcactgtaaccatggctgaattaattagaaattctttgtcttaccagctgtcttattaactttaaaatttacatataatactgaaaatggaatgctacatttaataaataagaaaaagccatttccttactacataaaaatttttaaatagaacattaaaatgaatatgttatggtaggttcactgtaaaaatgttttaagtgctataaacataacagtaaataatactttatacttgtcactaatgaatacagctagatagaaagctgtcacacaggtttttttcttttaaaaaatgacatctatagattttgtgatttttaaaataattgcacattcattccacaaatcttgggaaaacactcagaaaaacttactaaaaaataaagataatcccatattccagaggtaaccactgaagacatttaaatgtattttctgccaaacttttttcttttttttttttttttttttttttgagacggagtctcgctctatcacccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccggtttagccgggatggtctcgatctcctgacctcgtgatccgcccgcctcggcctcccaaagtgctgggattacaggcgtgagccaccgcgcccggcccttttttttttttagagggaaaaaaaaacagacctacaaatattttttctgtgcatgagtatttatggttatgaggtcaaattgcgtataccttttcacttaacatcttcccagtttaaaaaaattcttagaggacattttaatttatcatatataatctcatcaatgtatgtaccagatttgactattcctttatagttatttatttagatgttttttcaaaagagcttctgcaataagcatttcctagtgagtatttgacagaacactgaaaccacaagaaattttaggacaattctttggggaaagtattatactctcctcttgcagattcacaatacgcattagaacaattaagaaaactgagaagtttcacaatttaaggattctttaagtttctaaatctgttttttctcagttatttgaccaaggaaccctttctcacaatacttataaatctgaaaaattcaagagacttctaagctcctgtgttatgatagtttgtgaattatttgtttactctgctgatattttattagattcatgacatcagtgctttattaggaaatagaaatgttttaatggttattagcatgtgttaaaaacagaaaccacaatatgctttccccagttttctattaaccttgatactgcactcctgattctgtattaaaaggtcgggtttgacctttaagaatgtgaacgttcaaatttaaattcccttgttttgctaatgcctgttaaacttctttatgtttcatataacccacaggtcttgcaagagcaaaatccgtccctagccacacatactccaacgaagtggttaccttgtggtacagacctccagatgtccttctaggctcaacagaatattccacctgccttgacatgtggtgagaaatggaagctttactctagctaatctatctgtagtgcttggtctgggtcaagcctagacaaacatcctaacagtttgaatgaagattaatggtgcaggagtgtttgcctgcatgtggccatgctgctggatgttttaaaacatgattgggaatgttctctaattagagtctcctttgcagatgctgtgtggtaatggttcttgatggacaggggcagagacatttttctaactgtcagtatcatgatttttctctccctaagagtcttaatttgtggctgtatcttataacaagggaagtatgtatctccagacggcaacaggattggagtagcagggagtatgtttaaatttgcaacaaagctctgatgagtggtctgaaaattttggtgtaactgttaggcaccagtttgactcacagtatgtacttgaaaacttctgacactagttatccaaaatgaaataaaatgactacttttaaaaaatattatatgtttaattttaggtctcactttcacaaatgctttagcaaagcttaaaaatctattttatgaggtccaatgactgtcaagatttaattcataattagcattaatgataaactatgctgagttcccaactaagtgtgatccaaatcaaacaatcaaataagggaataatctaatttttggcatgaaggacggactgttgaacatatcttttattaataaaataatttcttttcagactcacagttgtgtccaaagtaaaacaatttacatagcacatggctatttttttatttttatgtatttatttattattattatactttaagttttagggtacatgtgcacaatgtgaaggttagttacatatgtatacgtgtgccatgctggtgcgctgcacccactaactcttcatctagcgttaggtatatctcccaatgctgtccctcccccctccccccaacccacaacagtccccagagtgtgatgttccccttcctgcatccatgtgttctcattgttcaattcccacctatgagtgagaatatgtggtatttggttttttgttcttgtgatagtttattgagaatgatgatttccagtttcatccatgtccctacaaaggacatgaactcatcatttcttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaacaagtttacagtcccaccaacagtgtaaaagtgttcctatttctccacatcctctccagcacctgttgtttcctgactttttaatgattgcgattctaactggtgtgagatggtatctcattgttggaagttctggccagggcaattaggcaggagaaggaaataaagggtattcaattaagaaaagaggaagtcaaattgtccctgtttgcagacgacatgattatatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccgttcacaattgcttcaaagagaataaaatacctaggaatccaacttacaagggatgtgaaggacctcttcaaggagaactacaaaccactgcttgaggaaataaaagaggatacaaacaaacggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccataaaagagcccgcatcgccaaatcaatcctaagccaaaagaacaaagctggaggcatcgcacatggctgttttataataggagtcattttccctgaatgattatgcccccatatgtagaattccactgtgtattcatataattttatgacctcagtaaaactgcagtatgtgttgtttatcttactgttgtatacttacttacttcagtgctctaccccccgtaatcttggcttttcataaattggcctgtgatgaggcctggcttctttcctgatgtttttgatccaaaaacgttatggtgagaaaacaatcaagtttctcatgatctagggcacagtgcagatttttttatgttctagcagccctccctaagaatgagatttagggatttgtaaagccactgaggatacctgcaacattttgtgtacatgagaacgtatttatttttattgaagtgtagctctaaagctttctagtagagctacaagaaaatcagataatcatacagatctgttgtcataaattttgtaacatcttgtaataaatctaataccattttaatgatattctaaaacactgagactaaagatgatcatctgtcattaaggggctgagctaatctattttgtcacacttcctggcttttttggggggatggttgtttacacagttagatctttttttcccaacacagggatttgggtaaaatagatatttacataattagtgtaatggcagaaaaagttgaaaataaaggccaatgaatgcatcaggatattagttactttctcatccctttcctacttcctgacttatagttggctctgcagatattcattacttaagattcttgtgttatggggctttttctctattttttgagtatggaaattctaggttgtctttcaatgaggtcagttagggactctgctaataaaacattggttggaaacatctgtggcttggagccagtttttgtcttagttgcttggtagttcagttaagattctaccctcagaacattttttacatactagtggctaatttttcccaaacctttaaaagcaccaagaaccaaatggactgtgacataatatgtgtgtttctgaggtgtagctcagtatttgatttccagcgtgtgctactttttcttgcccgtgtgtcactttttcttcctcgtgtgtgtgtgttcattctctcaaggaagatagcttggacactttctgccaatttgctttgaacagagacataatggaagcacaagaagagtaagtggaaaggaggaaaactgatagaaaatagtagaccccaaatgcccttttgtctacgtgccaagattattcattgccagaaccaaatagcaaatgtgttatgtctgaacagcttcccatgcttactggctcttcacttccaagccttaaaatctatgttatatctatggtacacctgcctgtctgaatctgatttcaagccattttctaaaagctatcttgttattatcctataagtcaaataaaatgtgtttttccagttagaagttcacaggcactgatttttgcataatcaatgacattgatgctgggtattgagagaactagaaatgggactataattgagtcatggctcagctgcagcaaagagaagtgcaaatattaacccatggagaatagcagggaggcaggtggcagtagtttcaggctttcttacagttcatttatcagcatggggcagtaaggtagtaactaaaaactaatgatccctatacagtgttacattttccagttttctgtttaaatagccacaggaaataaaaaaatgaatgaagacacatatgcattatcatttgtcagcaagtgatggaaatcagagctggccgtgttacgatttcctcctccaggtctccaacacttgcaatgaacaaacaaccctgtgtgatttgggaactcatcaagatagatagtttttgatacttttatgaaaatagatagtttttgattgttttatctccctctgtaaaggaaattttaagcagaggaatcaaattgaacatttcctttgtataacttctcttaatttttggatttataactctgtgaaagtcaaggcataggaaatcattgctaagcttctaaaccaaaaaggcttactaagttttgaaagccacattaagagaagtgcagatgtagcaagcagcttatctatgtagttcttcccttgctaggaagctctgctcaagctgttgaggtcattgttccaaataagctttatattcctctatagaggaatataaatttttaaaatagggttaatttttaaaatagggtgactaagtcacctgcagcaaataaatgattatctcatcaagaccacagtgctttgggggtgggtaaaatatatagtagcactaccctgaggtatcaactacagtactccccaacaccccaacagtgtatgaagaatgatagcatgccagtctcttcctttcatcatcttttaaaaagctaattaacatattaactatgcttgtcaaaatgtggggcaaatcatttataaataagcctgtcaaatgtaatgagattgcatattaaatcatccgtttctctattacatctctgatttaagattaaaattaatttatttaacattgtagcagctgggtggttagaaaaaatttccataccactcttgatatatagaaaaatgtccacatcaaaattgatttcgcatatgttagaaaagaaattgcctgtttattaagtattgaaaggccatttagcattgcttttttattaaataagcctaatcaccatacatattggcagtgtacaaagttctgccattatctttaatgatctttcttgagccaaggaaatgtatataataaaataatgtttcttaggatttaggtttatttgctaatgttttaaggtagagaatcacaaattagccctaccatagcccctactttgaaaataaatttgttctatatgaggtcctgtggtttgatttgagacttgagtaataataatagtaacagcaataggtacttctattgaacacaaactgtattctgagccctgttatgcattttaattacttacctattttaccatgatacagtgaaagaaaaccaaacccagagatactaaataatatgggtaaggtcttgcagttagtaaatagagcactcattcaaactcagagataacctactccaagccctttctttttacaagacactacataatctcttaagatgatttatttaaaatttggtctttattttaccactagagcaactccaaaacacaaatacagcaaaacatatattttataatttaggttatactctgagtcatgtcctttgcataactaaaatatagtgggtgtctttcactctcactcaacagtctttggactgtttttctctcctgacattgttttaagacattttactatacagttttatgcaaggaagagttttttaaaaaaaataaaccaaggaatccctggattgaatacattttcacaggactagtacttatgctggcatgtattaatattttcccaattcctagccattactcatttattacttttgctaaaatgaatgagttcattttaaaccaaaggatagtaagaatgagaatttgagttgatgagttatgttgaatcatctatctgtcagcactgtttgtactatttctaattaatcaggtcataagaccaaggaacatatgaattagttactgtcaaatgtaacacctctttaagagttcttgagaactgctcaaataatgcatgatccaagtgacttgttggtgtagccaacgaaatgcaatgcaacataacaaaagaactggggacagtcagaagggcatccaggagattgaagctgatggtttctaagcccactctcactacggaagtcccttaaaattaggatgaccctgtattttattattataccaggacaccattgagagttaataattctgccaggataataggtgtaaaacagagataattgtgacatgtggtcacctttctcataacgcactagagcaataatttactaaatactactaatcagaatagacttaacacatttgagtgtttaattcacactaaggactactgattacaaactcaaattccttgttacaaacttaatgttacattgcctaatacaaattatctctgtaagtacagttctctcatattaggttattgtggcattttagagtggctactaaagtgccgaatttagtgatagctttggcatgctgaaaggaagcacctctatttttatgtcaaaaatctagtgtggggctgggcatggtggctcacaactgtaataccagcactttgggaggccaaggcgggtggatcacctgagggcaggagttcaagaccagtcccatcaacatggtgaaactgcatctctactaaaaatacaaaattagctgggcatggtggcacatgcatgtaaccccagctacttgggagactgagacaggagaatctcttgaacccgggaggcagaggttacagtgagttgagatcgcaccatcgcactccagcctgggtgacagagtgagactccgtctcaaaaagaaaaaaaaaaagtctagtgtggttatagtttttatattccattgttgtttatcggtgtgtatgtttgtgagagagagtatatgtgtgttttcagtgcatatgcttggtcatttattggcaataaattagctgaatgataatatgtaaaatgaggcattgttcactaccaaatatttttaagaacaaataaaaatttccccattttaaatcaatgtttgcaaaataattggctatccacaaactggttttggggtgattttttaaacagccaatcacagagactcagtttcatgacattattataacccttggtgcattcagctgcctcactggtttgtgagaataacaagagatggttacatgtaaaattttttaagaaatataaaactccccaaatgttgagaacagtgttcttatcaactcttagaacgtcaatcagccaagctaaatatactgcatttctattggggtacagcatccaagggtgctatgggatatataaaagctgctctatttggttttagggaaattaacatactgcctgtgtcttgagaatcaaaaataatttttggcccaggatattctcatcttaagagtgtgtgtgtgtgtgtgtgtgtgtgtgtgtgtgtgtgttttaatttagaaatatataggcaggagtgttggcttacacctgtaatcccagcactttgggggccaaggtgggaggatggcatgaggctaggcgtttgagaccagcctgggcaacatgctgagatcccatctcagcaaagtataaaagttcagttaccatggtagagtgtgcctatagtcccacaggaggctgatgtgggaagacagcttgagccccagattcaaggctgcagtgagctatgatcacaccattgcactccagcctggccccaagagtgagacctacaaaaataaaaaattaaaaaaaaatagaagtacataaactagtattcaaattttagagaacattggatgtgcactggtgctttcgtgttgtaagttgtgtatttattcatgtagaaatcatttctctgaacattatcaacctaaataacaaaaacggaaagggagactctctaaaagaaaatgatgtttattcagaaacaggcattgcagtgggaatatatgtgccgtaataaattatgtgcgtattgagggaggtgaaggaagacaaaggttttttttttttcttttttctttttcttttcttttttttttttttttttttttgagacggagtcttactcggtcacccagactgtagtgcaatggcgcgatctcagctcactgcaaccttcgtctcccgggttcaagagattctcctgcctcagcctcctgactagccgggattacaggcgcccactaccacgcctggctaatttttgtatttttagtagagatggggtttcaccatgttggtcaggctggtctcgaactcctgacctcgagatccacctgcctcggtctcccaaagtgctgggattacaggcgtgagccactgtgcctggccgacaaaggtttttaaaggaaaattagaagaattacataattgttttatgataattatccttgactacaaagatcagtaacaagcgtcatggcagtctgacattgggcaggcagatgtcttcatagaagtatgttttgtgtataaggttgcagtggcctttgtgcaaggctgtgttttttgcagccttttgtgatagttttcatatatgagaacccttccttcgtggccttccccagctctgtttgtcaggggttttaacacaagtgactccattttgattgtgataactttgacaaaatgtaactagcagtgttttgctttataaaggagagtcattgttatagtagaaaacatatggaaaacctaggtcagcttccctctgccacttcttagctgggtgactttagttgaacaagttccttagctactcctagcttcagtttccgaaccagaaaactgtaacaataaaacctattttaagtataacctataactaacataccacagcaataacaatagaaaaacagtgatcttctgcctcatccatacccaccctttaatcctatttaccagaagcaactacttttaactgtttgtttttaattattttttatttatttttacttttaactcttttagacatggtattttacttctgtcttaaattgcttatattgctattcattgatttactattttcgacactatctactaagtaggtattatggtagatgaggatttaacttgcttctgtcaaccttacttcattatcctaatttagaatctatatcacgtcttagaacattaatatataaatattattcatgcttaaagtcaggtagtatttatgatgatatattttcttgtataaccttttgcttttcctggacttaataactgtctgtgattcttattagttgtctttgctcttatgactaattataattgtgaagaatttatcaattacctatgaaaacatatttttcaaattctcaaacacaacagcaaatctatcagttccatttactttttttacgtctcctttcctcagccatgttcttgaaactttcctctctcggctttctgatttcttggcttggcacaatgtagcatttcttatctcagacttcatttgctccccactcatccccatccccactttgtctctgcatggtgttgtaggtcctaagatggttattctctgttctcttcctaatctcttccccaccctcttctgtcctgccctgtgtcttacttcgctgacccctagggaattgcatcctctcagctgccatcactcactggtttccagctgggttcaggcaaaaacaagtgagaggagagagtgactgtatacttttccctaattcttctgcatgttagaccatgtttctggaaatgactaactacaacttctttggggaagcttctctcccatagcactagttgtcagtagacactaataacacttaggtcttagttggagagggagtcatggcttcctgctgttgctagaatctgagtatttctgtatgtcttattggttcccttatagctctattcgtagtcacttctgggttggatccattttccttctggagtgtcactgactgcagattccctttatctggattccatgtcttcctcctttaggtgcattagaagaatgcatacattagagatacagttttcaaattcttagtattttgaaaacgcctttattctactctcacaaatgattgatgtttggctaactgtatatcattaatgataatgtataacttgaatgttaatttttttcctcagaattttcaatacattgttttatttccctagagcttctggtattgctgctgagaagtgtgattccattctccacttctcgatcatttgtgtgccctctcatacttcctccctggagggaattgggttcttccctctatccctggtattccagaatttcatgatgatattgccttggtagtatctttttctattggtgctgggtaagtttccttcaagataaagaataacgtgttttagctcttagaaaacttcttgaatttcttttttaaaaaaatgatttcttccatcctctctgtcgtcactttctagaaaatttgtattactttgatattggaactcctttcttaatcctctattttttaaagtcttttatataactttgtatcttacaaaccttctatttaaaaaaaaatcagcttccatatataaaattgttcttgcttcctttccttctgatctgtatttcttcaaacacggggatggggacattttttggcttttcatttacttttatacattaagcactataaatctatacacttagaagggcccaattaaccggtcagttcattgtatattgttcatgcatagagctaaacttctggttgggagatcctcagatgtcagtatctgaaggctttttctttgttcctcctcatatgctgattacaggcagctgacatcctcaaagcagagtggaaaggggagctgatggtcacatagatcagtaaacatgtttttcacacttgatttccctttttttcagctcagtgcctcaccctgctctcttctgcaacttttatcttcaatttgaggcctcctgggtttaatgtcatctaccctgctggtgtgtgtttaggatgagatgagggatagtcagagaagacctatgaggctaaagtttgctcttcatacacattttcatttctcccctctatctccagctgtcagactcagcttcacactttttacatcctgaactttttccaagttgctgtaggtaaataatctgactataacttgaagctgtaactcactgcctgtggtctgcctagattgtcatgtcttcatctacatcttctcaaaacaggttacctctcaagtacttgtgccttctcgtagagttcttttatccttgtttaaaattttatttcctaactgacactttggtcacttgggagaagacaaatgcagcaatgttagtgagtgctgcttgagggcaagaaccaggtctttctcaccttgaacgtcttgatattatgtaaggttgtccagaaggaaggaaaggagggagggaggaaggtgggaggggaggtagggaggtagggggagagggagggagggagggaaggaaggagggaaggaaggaaggaaggaaggaagaaaggaaggaaggaaagcaagcaggctggctcatattgtataaggagggaattaggttcgtattgtataaggatctttataggaagggagctgccctaattctagaggtgtctagaaagggagatctatgcacgttttaccacatgccctgcttttgttgattatttaatatttgtgactttaactatgaacattgactactaagggtctttgtcatgtagacatttgtgattttcctggggcacaaatttaacttgcatatgctgatgagtgggagctgattaaatagcgtagtaatgcaggcaggaaactcgtgactgctgccatcttagtgtggtggtggtttataatccctaccatttaactctcagtgaaataacaaatttatgaaaaccaacctgaaaagaaagccatacactggttgatgagatagtgatgcaagttaataaaatgtgaggtcataattctttaaaaagataataattttacatgagtggattatagaaagtagttctttggatctgtgggctgtatgaatccaaaaaaaagcttgctgttaaaaccagcaaaagtagttagtgaagcattttcaacaagtgtttaggcaatagaaaatttctaatccagtgaaggtgaaaaagtggatcattaacttatatgcacaggaaagacatgattgaatggaaatgggattggagagaaactaggagcctctataaatgtcattgtgtgacaatagttactaaagatgcctaccagaatattacaaggatatctacttcatattgcttactgaaggatggacgtggagaattctgtgcttgttatgacaattgtgaattaattcttcagtactgcattacctggaggttattttaattaacaatcacagtttcatttgctggtattttgctgtatgaattactataagttaaatattttggtggctttcttaattttagatgctatattatgtaattggtaaacttagatgtttgtgggtttttaaaaaaaatttattcttcaaatgttgtatccttagattcctgttggtagatgtcattagaaaaaaagaaaagaaataaaacaatagttgaaaaagaactaaacttgaactcaactaaaacgacctatcagtgtccaagaaacatcctgctaaatttcattaaaaataaaacaaaacgtattcatagtatgtgacagtcgcttagtaattactaatgacagaatccgagtagcttcctattttcctacacccatgtgggttgctcatcttttactgtggcgttttctatttctctgtatttctgtgtgagacaatagattccaagagtgggatgtttatataattgaattttcagttgagcttggcaaagcttttctcattttttctgattgataatttaaatggttcttcctttattgttagcttttaccatgtttgtttttgaatacttaatatattcatagcctaatggaaaccccaacagattaaaaactttattatagaaataaataaatttccatctatttgtgaccattttataacctctgaaattagaggtgtttgtttttgttgtttgttttttctcacacactgggtgtggttgatggtaacagaaaacaaaaaaaaaacagctctagaatctcagggtagctctcttcccacagaaatctcccttataccttgtgagccacttcatttattcattcagcaaaacattacagaatgtcgagaggtgcaaggtgagaaggacctggttcctgccctcgagcagcacccactagcgctactgcattgtacaaccccaaaggcatcattcaagttgtaatctatgtgcagtggccagactgcaaagctacattccagggcaaatatttgagaatattccaagaagcccacagacttcaccaaaaaaatggaccctgttaatctgtaccggaaaggtttttgcctttaggtcttgcatctattatctcagatattaggttgttgtcaaatattttactgtaaaatatcaatcatccagtcatatatcttagtagtgcccatttcagcattcttacccatagtccatcaaagtctagctatgccatttgatgactggaactaaatatatcaacttaacatagtgtaaattgaagttcagaattctccttatagtaggataatttacatgaaggttttagcagtgatttctcttcacgatatgccacatgaagtttcttgaaaaagattgcttgatgtgtcttttgctttgatttttaagataattacccatgaataaatttttcctaatttcctacattattgcataaggattaatacatttgcagagagaagccttaaaatatgacttccttgttttgtatcagctgtcatataaacagaaattaaagatgtgcaaggcttattaatttgcttttttctcattctgcctggactatgcttattccttagagaagggccgttattggtagagttttaaatgaattatcaaatggaacttctcctttcattgttccataatacaagaaataatatttatctgctatttcttgtcatatttttcatttttcttttttttcttacagtagtcctcggtgaaggcatttcctatttatatttttatactaattgtggctggttgctggatgttaccagtccaaatattccttgttatctatgtaacctggagttattactttaagactccatctctagagtcttcattatccataggagtctgtgttgaatttttaagcttttttttttttttttgagatggagtctcactctgtcgcccaggctggagtgcagtggcacaatctcggctcattgcaacctccgcctcccaggtttaagcgatcctctgcctcagcctcctgagtagctgggattacagatgtgtatcaccatgcccagctaatttttgtatttttagtagagacagggcttcaccatgttggccaggctggtgttgaactcctgacctcaggtgatccacccgcctctgcttcccaaagtgccgggattaaaggtgtgagccactgtgcctggctgaatttttaagcactttttaaacacagccaacatcatattttcagtgcattagcaatgatggtagacttcaattttataggatagttttactgtgttctttgccaaagcctctaattttgaagattttattttgattttgtctttatctttgctggcatttgtgtcacctgggaagaaatcaaagttgccatctctatttgctcttttttaacctgaccaggctgaccaaataaagacaggtttttctgactgcagaggcagcatagcataacaaagagattgctgaccctggattcaggagatgcagtttctgattctgctacctacactaagacatttaaacatataatacagcttccttacatgtaaaaatcaaaacattgtctgaggccttctcaaaggtacctttatttctaaattttagcattcaagtaaattgtacagtggagcgaaaggtttccatggagactgctggagttcctttggagtctcttagaaatgaagttagagttcaggtattttggtgaaattactgagttgatttttttattagtgtttaatttcataggataatattagctctaaataaaatgcctttttctgttgcagtatcttgtgtgtactcctcagactagtttatgcaattcattcatttattccctcattttttattattattatactttaagttttagggtacatgtgcacaacgtgcaggtttgttacatatgtatacatgtgccatgttgcgctcatcaactcgtcatttagcattaggtgtatctcctaatgccatccctccccgctccccccaccccacaacagtccccggtgtgtgtccatgtgttctcattgttcagttcccacctatgagtgagaacatgtggtttttttttttttgtctcgttttaaagatagttattgaacacctattttgtacaaggcagtttgtgagatcttggaactgaaaagatgagaaagatgtattcatgccttcaaggtcacagggaaagacagtgtgatgagccataacacaggtatatggttagtacagtggcagctcagaggtgaaggtgataaatttatcctcagtgaatgattaaggggatcaggggaggcttcacccggtggtaattactctgcctgacttctcaaagccatctttccaagctaacaaagctaggtttgaaggacgtgtacatcatgccatggacaaagactaacagctgaaatatctggtgttttgtagatagagatggaggataggatttcagaagcattcaaaaaggatggtaaggaggaagagagaaagtgtttggagatcagattgtagaagtatttaggaatacttaggatgtagacaacttgatgactgcatatacatagtaaaaaaaaaaaaaaaaaaggcaaaagatttcagatgattcctgggtttctggatctggtaactggaccagacagcaaaaatacagctttgccatttcattaaaaaataataataaatgtacatagtaattaaagtgtatgaacaaaaattatcattggaacataaggaacatttatgctggttggcactttaagattgttgggcttctcagtcttccgtgttagttttattgctgatgtagatcctagtaagaggattctaatcacttgcctggtgcctccctccaagtcagcagcaggccaccctgggccttgagtctactgaactacattagcttagcttcctgtactttattttttacttttgtttttattctgatatgcttaatttgtaagtacaacttcttagagatataattttgtttcatagttgaaaaataaatattatagtttcccattatattaaaagtttattgttttgaatcaaatattttctaagatgggcttttacccacaatccagggttatattttcattccttaagagcaaagtactccatagaagttcttgactaagatatattgtgcctatctgtgcctaatgaagcactaaccacagtaaatgatgagtggcagtttaatcaatttggttccttctgtagtcaccaagggcatgcagaatgtaattttttagtctttcacttttcaaatactgcaaatgccaaaatgaaaagattaagtctgttatatgtaataaattttcttttagaatacagaaaaaggtcactttttaattttcatctttttgaagctgacctcctagggaagaaaactctttgttctattttacatatatatacattccttcagagaagagtaagataaataaatggctaccttggtgcatcaaatagttctagctttaattgcataatggtttatttcagtgaaccatggctaaataaaatttcctattaggttaattaatgtggaagcattctgagtttgtattgcatccctgtgtgttaaatttagattatgttttgcatttaatctaacttatttcagtgatctgtttctttgttgttcctttggctggagcttgaatatatgttcagagaattgatctgagttataaaactccattcaaaacagaattacccaaattcctttacattatcgcccctcagtacctgattttgagaacagcagcatcaacatggcttggaagcttgttagaaatgcaggatctcaggcctcaacccatacccagtaattagaatctgaattctaagaagatctccatgtggttagcatacacattaaaggatgagaagcactgcttcaagtactttttttggaaggatacataggatttgaggaaatttccgatgccagcataatgttgaaaggcagagaactaacctgtaatgagttatggttctgttcatctgcttgcctcctgtcagaatcagaaacagcttgacactcccttttttaacatccttctttccaaaggtttcaacaatgcagatggctctgaagggctctaaataattttctaaacttgagaagaggcctcttatcactttcaattaggaaattatgtataataaggggcaggtctccccccaccataatagtctaagtttgatgagtcattgttcctgctgcacatatggcagtgcacgggctatgctgtgtcatgatccctctggaattgaaactgtcactctgcttaaagctctcggtcctaaggaatcccaagcctttgctaacacatggatgcaataaaaaaacgaaaatctaggcagtgttttctgacattttcattgcaaccatattttaaaatattagagtctttctgcattatctactgatattgagccaaacttttatcggggggaccagcccacaatatttcaacgtaggttctttctattttcctaagtgttggctgatctgagaaataaagagaaagaatacaaagagagaaattttacagctgggcctctgggggtgtcatcacatattggtaggactgtgatggcgacctcgagccgcaaaaccagcaattttttttagggattttgaaaggagagggggtgtacttacagggagtaagtcacagagatcacatgcttcaaagggcaatgaaagatcacaaggcaagggcaaaattagaattactgatgagggtctgtgtcccactgtgcacgcattgtcttgaaaaacatcttaacaggaaacagggttcgagagcagacaaccggtctgactagaattcaccaggctggaatttcccaatcctagtaagcctgagggtactgcaggagaccagggcatatttcagtccttatctcaacctcgtaagacagacactcccagagcagccgtctatagacctccccccaggaatgcattccttcgctagggtatcaattattaatatttctttctgggaaaagaattcagtgatacttctcctattcacataaccatctataggctttctacgagaaggaaaatatggctctattctgcctgaccccacaggcagttagaccttatggttatctttccttgttccctgaaaattgctgttattctgttttttttcagggtgccctgatttcatattgttcaaacacacatgttttacaaacaatttgtacagttaacgcaatcatcacagggtcctgaggcgacatacatcctcagcttatgaagattacaggattaagagattaagacaggcataagaaattataaaagtattaatttgggtaactaataaatgtccatgaaatcttcacaatttatgttcttctgccgtggcttcagccagtccctctgttctgggtctctgacttcccgaaacaaacttttgccttgagaattagggaagaaggagaacaatgttttatttttttgatatcttaatctaaccaaaattagattaatgtcaactagagaaataataatctttatgtcttattctgcttcctcatgtgatataattatttattgagttaattaccatttagttaacaatatctttttgagaaaattgactgagtatagtcccttgaaaatatgcatcaaatgcagatttttttattatgcatgctgatggatgtaattaatccatatttagttgaaagatagaaagttatcctacaccataaaatcccaacaggactttaatgaacagatacatacattacaaggcatattagctggtgcctttttgacctaaccctatttcattcaggtctggtaatgttgccatatcgccataacccctatcaatcatttgggctatatttttaaaagcaaaagaccaaatctttgttctgagaaaggtaatggtggctaatacatttacaagtaaataaataaattgcagttgtagaaagtatcatggagagcacagagttaggggacctaacatagcctgagagatcagaagaccttcccacagaagtagccctgaacttgtctttcccttttctaagggaggaaagttcttactccttccctgtaaattacatttttttctatgtattacacactccaccctacccttgccccaaatatagtagtttcaataaatcttttcaccttgaattcctttgccatagagtatattatatatatttcttcaaatactttcatattaaatttttaatttaatttttaaaaattgacaataatttacattttcattgggtacatagtgatgttttgatacatataatgtatagtgatcagatcagggtaattagcccatccttcatataaaaacatttatcatttctttgtgttggaaacattcaatatcttccttctagccatttgaaactatatagtatagtattattgttatagtcttaataatatatatagtatatgttacatataatatagtcttattttcttaactatagtcatcctacattggtataagacactagaacttattccttccttctggctgtaattttgtgtcttttagcaaatctccccctatactttccttcactacccttaccagcctctagtaccttctgttctactttttacttctatgacattgactttttttagcttccgtatatgagtgagaacatgcggtgtttaactttctgtccctggcttatttcacttaagataatgccctccatttccatctatgttgtcacaaaagacaagatttcattctttttttatggctgaatagtattcattgtgcttgtagaccatattttcttcatccattcatctgttgttgaacacctagcttcatttcctatcttagctattgtgaatagttctgcagtgaacatggggtgcaaatgtctcttcaatatactgatttcttttcctttggataaattcccagtagtgggatggctagctcatatggtagttctatttgtagttttttgagaaacctccatactgttctccatagaacattcccactaacagtatataagagttcccttttctccacatccttgccagcatttgttattttttatctttttcttaatggccatcataattggagtgaaatgtcttattgtgattttgatgagaatttccctgatgtttagtgatgttgagcactttttcatgtttcttggccatttgtgtgtcttcttttggaaaatgtctgttcagatcatttgtccccccgcttttttttcttttaaagagacagggtccttctctgtcacttagggtggagtgcagtagtgcaatcatagctcattgcagcttcaatctcctgggttccagcagtcctcccacctcagcctccccagtagctgagactactacaggtgcagtcccaccatgcctggcaaatttttttttttaactttttgtggagacagtcttgctgtgttacccagattggtcttgaactccctagcctcaagtgattctcccacctcagcttccaaactgctgggattacaggtaatcaaccatggcacctgtcctcatcggcccatttttaaataagattgatagttttatcattgttgagaagtttgagttccttatatatcctagatgttaatctattgtcatacaagtagtttgcaaatatttactctcattttgtgggttgttctttcactctgttgattgtttcactctgttttcctgcgtgtagctacattcctaccccactatataaaaactcaatttaagtcggttggggagatggatttgagacttatctcccatctgtacagaagcttttagtgtagaagcttttggtttgatataatcccatttgtttatttttacttttgttgcctgtgcttttgatgtcttattcatgaaatcgtttcccagatcaatgtcctgtgttttcttctagtagttttaccgttttgggccttatgtttaagtctttaattcattttgaggtgattttgtctaaggtgaagcgtgggaatctagttttgttcttccggataagaatatccaattttcccagcagcatttcttgaagagcttgtcattttcccttgagtgttcttggcaccattatcaaaacactgggggttcagcctaggttccatttgcctgctgcacagaaagccaatgactgagacaatgagttttgccagggaagaagcctttatttgggtgctgcagctgaagagacaagagaaaagtctcaaacccatctccccagctgactaaaattgggggtttatataatgcggaaggaatgtagctacatgcggggaaagaggaattagggaggaataaggaagaggagtttcagttccataatgctgtcagttctgagggttggtttcctgagaaacgaactcagataagacaaatatgtttcaagctttaagactaggagatcaatttctatgtttattttttttaaaagaccataaacatcagtcttacgggaaatcatgacatgtcactcatgatgttaacctttgtcacatggctgagatagtgtttgccagttttctccattgtaaatttgcatccacactccctctccactcctacttccatgctgtactctttggaaacaagtcactaagctgagctcacacagaatagccagggggaaggagggtcgtgttgctttcgattcattcagcaaatatttttgagcccttattatgtgcctgacactctgctatgtcctgggaataaggtgatgtccacaaccttgtcccgatcttgtagatgttccatctagaggagacacacccccaaaagccaaacacaatttaacatttttaagtgttataaaggggacaaactaggaaaaatagggtgagacactggggctggggctgtaaggaggaactgccttataggtggtcgctgggaaagacatttctaagtggagctatttgcactgacctctgaatagcaaaaagcaattaaccaggtacagagagggcaaagggaacaacaatccgtgcagagatcttgggatgggaaagagtgtggcaagttttaggagaggacagtggaacagcatggctggagcagaggaaatctaatgtggatacagacatgatgtaaatttggagatagaggtcagccgcacagcatgcggaggcttcactgcctcgagcctctactgttgattttaaggaagaaaaaagttcaagggataattttaaaaattggattcctctccttttgtcgatataggggcacgtatgtagggtatgagtagaaagaaaacaggtggaaagaaaatcctctgaaattaggatagaacccagcataattttggaaaccccttatgtttataaaattaaatttaataggtaaaattttctaatgtttataaaataaaaggtagtacttccaagcatgatataatgcttccctgtcttctaaatataaaataaaaactttaagttagtaaaataacctatccctcttctccctcccatgatgcatatcagctcacaaaattatctattttgggaaaaagttagatagcaccttattaaaaaaatcactccacatattttctcctaatttatttctcagttcaaaatactttagagattaaaatatcttcaatcaagtttagaatatctactaatttttgacaaaatgcaggaaacttctaaggcatattttattacaggaaaactgctaaagacagtagtgaaaaaacagatcatatttaagagattatttctattatttacaaataatcatgatatattatactttcttttctttgtttttccataactgattagtatgactttttctattattgtgtttttttgcaagtggagcataacataggtcaagatttcacaaactttgtaaagggcctgatggtaaaaaatgtaggttttgcaggacatgtggtttctgtagcaactacttatctttgtcatttcgatgagaaagcagccatacatggtacctaaatgaatgagtgtggttgtttttcattaaagcttattcatagatattgaaattagaatttcaggtaatgttcgtatgtcaccaaatattcttctttcgatatttttcaaccatttaaaaatgtagaagccattcttagaatggaatatggacttctgctctctttttagacttttcttctattgtccacatagagccataacaacagcagttagctctctaaagattcttcagtttactagactctgttttctcaacctggaatatttccattcccagtgccatcactccataatccaaccagcttcaacttttctagccctttcaggcgttaagcatccttcctaaccctacactctgaggtaagcatgtcctctcatgctcaaggaactgtgtaaaatggaatacgttataattactgtgtttataccatatagatctactaaacagaaagttgatagaagttttcccaaaattaacaacagtcctaaaagtttaccgaccttacgaacaatgagaagtgaagcagagaaaaaaattctaaactattagacatacccccaaaccaatgttcatcgtcatgctagaggaaagtctaaattatctctacattctcgttacagaaaatgttactgtagaattgtcataagaagacttaattgaagattatacagccaaattatagaaataaatgtattagagaaatttgtcagataatgataaatgtcagatagttaattttactttgttttcctgaatgtcagactgtttgttgcatttgttaccttttaaaattttgtgattgcttttgactgatttgctcattttaaatgcacttctatagccatttttttagttataattttataatctttttaataacaaaaactcccaaattatgtaagtttcaatcctaaaagattgtctgtctctgcttgtactgacaacaaattgtcaattctgcttaaaattttgttttgaattgtgatgaaaaaaatcattcatatacctgagacataaattaaattgggaaatgttgagttcaaaaaatagaaaaatgtgtgagcataggtgggtgtttatgtattaccttactgggtaactaatcctaaaataagagtttgagcatactgcatcctgtgacacctttgattgtaagcttttgtgaccagttcttattcttgaaaaatttagactaagtgggtgataattacataattattcaaattctcaaaagaaggaacaaaggagacatttcctgatataagattatatatcataaattatagtgcttaagcagatgaattttttttctcagtaaaccattcagtgcagtcaatttaatccattgagagagggagcatggggctaatggagggtagaaagaggtggggggaaagcagacactagtttcttcatattaaattgaagagctcttattgctgtgtggcaataaggcagtccagtaataaggaattctgttatattcatatgttgatatgttttatacacatactttttaattttcttgtacattttatctcttgttgtgagtcctttaagtataattctctcagcttctttagtacatcctcgagcatgtttgaaaaagatgacgtcataggaaacatccactagaaatgaaaatccaagtcttagccagctaagcagataagagcttataaaaatgctacatcatttcattccaactgaatagaattgcagcatagaatagatttgtcttttaatcattctaagtaacatattatggagatgatatagactaaacacaagtagtgctaaaataaattctataagtagttctggcaatgtaatagttatttttctagccagcctagctgtgtacataatgggggtggctatggcttctgctgaggctcttcacactcagaactgcagcttatggtgggaaaaaggaaggccaaaaagtagagagcagagaggatacactgagtgtaaaaaaggaaggtgcaggtagctatttaagatccaaggtattttattgtataaactaaaataagaagaaaatagtcttagaaaagaattcctgacagaaaaatttggaaagccaccgtactaaaaatttaagtagacttaaccagacatctgaagccctaatatttataagcacatcattgcattctaatatcttaataaaataattctcttgatacctatgttgtctctcaaatctaaaatgaaaacaacttgtgtaaaaacccatctacctagaacactggtttgaaattagttctttactacttaaataaaattacatcctatgatataaaatggcatttgtttgtttttagtcattataacactgtatactattggtgtttactttgaataagaatcatgtggtacaatagggaagcaatttctgcaaatacattacttctttaattcaaaacattgtttatatacaattgtgataacaactggagtagctttagagaagtaggtcacttggtcttaacccctaggtttatgaagtaaattaaagacacaagtgtttgcttgccctaaattgagtatgggggtgcaggagtggaagaagtgtcccaatatgttcgtggttttattagaatacttgcaagaaacataaacccattcaaatagagccaatgttaaaaatctggagaatttccaggaggtagagagttctagaaacaaaacaaaacaaaacaaaacaaaacactggatcatctgaacatctaagcctccagaagtcaagaaccaagtcatttcaggggacttcatctgcaggaatgtgtagccattcatgctacttccctgacactaatgtgacttagccatctacatatgctagtttcttaccatactgccccattctccagagtcccggcagaagtatctaattggctgtctgtccatactatggattggttattcctgttgggcttggtgcaagctgcagtggtctgggaggcaaggtcttttgatttactggactaacttgctaggtgggaactgtgagcatggcaggtcaagctgcgaaagaatgtcgagcatggtagatggctcatagagtaatccataagctcataaggggagcaattctgtctgctgaaagatccatgaaaggcatcacagaggagatgcatttaaacaggattatagtggttgagttggaatttgctatcaagagtaaataggcgaagaaggagggtactctagatagtgaagcaatttgagccaaatggtacagttttatgcctggcactcaggtagatcagtctggctcagcgattctcactgtagctgccctgaatcatctgagcagcccatgtggatgcctgggctccaacctagataaaatgaaacaggatctctggggtttgtggtcagagatatgcagtttcttaaccttctccagatgattctaatgcaaagaggattgagaaccactgaatgtctagagactacaatactttataagtttgtgaaatataattggaaaaggatacttgaacatgacttgaggactcttatacatcaggctaaggacttaactggattctataagtaatagcactagaatgtgctattttattggtttccactcttttctgagcccagtatagttgcatctatttagagttctttcagggcagtagatgggggcagggggagtgggtaggttatgggatctaggtgtacgtcacctagatagctcatggtgctcattaaaaatactgcttatcaagtaactccattaaaaatgggcaaaagacatgaacaggcatttctcaaaagaagacatacgagcagccaacaaacatactaaaaaatgctctgcatcactaatcatcagagaaatgcaaatcaaaaccacaatgagatactacctcacaccagtcagaatggttattattaaaaagtcaaaatacaacagatgctggcaaggctacagagaaaagggaatgctcatacactgttcatgagaatgtataataaattagttcagccaccatggaaagcagtttggagatttctcaaagatcttaaaacagaactgtcatacaacccagcaatctcataactgggtatatatctgaaagaaaacaaatcattctaaaaaaaagatacacatactcacgtattcaccacagcactattcacaataacaatgagatggactcaacctaggtgcccatcaacaatggactagagaaagaaaatgtggtacatacataccatggaatactatgcagccataaaaaaagaatgaaatagtattggccatgtgcggtggctcatgcctgtagtcccagcactttgggaggccgagacgggcggatcacaaggtcaggagatcgcgaccatcctggctaacacggtgaaaccccgtctctactaaaaatacaaaaaaattagccaggcatggtggcaggcacctgtagtcccagctactcgggaggctgagacaggagaatggcgtgaacccaggaggtagagcttgcagtgagcagagatcgcgccactgcactccagcctgggggacagagcaagactccatctcaaaaaaaaaaaaaaagaatgaaatagtgttgtttgcagcaacatggatgcagctggaggccattatgctaagtgaattaacacaggaacaggaaaccaaatactgcatgttgtcattcataagtgggagctaaacatcaggtactcacaacataaaaagcaacaatagacactagagactactagaaggaggaggaaggaagggaggcaagggttaacaaactattgggtactacgttcagtacctggatgatgggatcattcatacctgagacctcagaatcacataatatacccatgtaacaaacctgcacgtgtacccctgaatctaaaataaaagttagaggggaaaaaggaaacagtttactcaccgcttctcttctgtaggagtggatattctaattccagatttagttttcctaagcagaatatattgaagttttgtaacgattctttcttctctctctaggggagtaggttgcatctttgttgaaatgatccaaggagttgctgcttttccaggaatgaaagacattcaggatcaacttgaacgaatatttctggtaagtcctttacagagtatttctaagaaaaattggtttctaattagtcacttagtgacaaattctacagcagtctgtggaaaaataatttaaaacaaaatttgttgtcacatttggttctaacatattttggacctttgaaaaagcaggaaatcagttaagaattatgtttttatactactgtacgtgaataacatgtcaaagtggtaagaaggaatggggtgggagaggcaatatagagaaagtaatgggttaaaaatgaaggttctgacagaataattccaaataattgctatatagatactccctccccatcatgtaggtggagcttaactcccccgtcccccttgactgtgagctttgataactttcttccataaagcagagcagggagagtgggaagatggtgactttacagtggagacaccagttaaacagtacttccgtcaggttttcaaggctatcatcatcaaagataagtcatgttagtgggctgtacccttgatatgatgtgttgataatggcacctcacctctgtggtcttcctccccaaaccatagccccagttaaatcacaaaaaatatatcacacaagccaaaactgacagacattctacaaaatacatgactggtagtcttcaaaactgtcaaggtcatcaaaaacaaggaaagttcgggaaactggcataaaccacaggagactggggagacatgacaagtcaatgttatgtggtctcctggatgaaatactagaaaggaaaaacattattaagtatgttgttaatatcaatataccaatgtgaatttcttagctgtgtcagttgtaccatattatgtaagattttaattagagagagaaactgggcgagtggtatacatgagctctctgtattatgttttgtaactttcctgtaaatctaaaactattctaaaattaaaagcttatttaaacttttgaaaatgtgtaaaatgtaagtgttctggagccagactatctgggcttatcacccttctctgtcatgttttagccatgggactttaagcaaggggcttattagttctctgagctttagttttctcatgggtgaaatgagggataataacagcaccttcttcataggtggctttgaagaataattgactaatatagttcttttaggactctgcttggcatatagtaaatactttacatatatacaaatcgttgttattttaattacatcattttatgccagatattcagtagagcttccagtagagctaatattcatataaacctataatttaaaacatgaaatcagagttagacaaattaagtaagcgcaacgtttaaatacagctatcatattaagaatacaatctgcagtagaacgtagcgatacaaactgaggccccatcactattgtattcccttaatgtcagcaataaaatggtaagaaaagaagactggaaactaggaaattaaagcacatgtgattcctctatgcagtagcctatatccctgtgagtcgctgtgtgctaacaacaaatggacaatcagcaaagtccctaacatagaaaccatcctcaaagtgttgtcctgttggttttgttctttcagaaaccatctgtatccacttcctttcaattttattttattcaatatgtataaattcccacacacaaatgttaacatgattataaaaatagtgtatttttataatggaaaattcctacagtgtcaaaatgaaaaaaagctgaaaaatcaccctttgtcctactacccagagaaaaccacatctagtatttggacatatatcttctatagagtttttctatatgtatttgaaaaaattgaatcatatcttgtatattcttttggaaccagctatttccactaaacaatttgtaattaacacctttcaatgaaaaataaattcagaaacctatcattcttaatgactgggaagtgtttcattatatggatgagacattatttacttaaccagccccatattgatagcttgttttcagtttttcattataataaaatgctgccagaaactttcattgcacaatcatcctgttagttaagaataattattagaataagaagtccttatttcaataaaatttaatttttatagatgtagactatttgttcatatccatcccttcatttaaactcatgaaacctactcccaagaaaatctcttattcactttattgagattgtactgagtctatggaaataatacaaaattgtactttcctatccacgattaaattattcaattttatggctgttagcataaatgtacagtttgtataaacatgtttggttttttgttctactcaagactttacttttattcaattattttaaataactttttcacaataagtttcttaaaaatataaactgttccatatattttgtattgacaaaaatggccaagagagaactttaatgggctgtagtttatataaatttttatgcaaagacatatctccaaatatttagcatttttatttacataaagctcatgtataatgataataatagtataaccaaattatattctgataattttctgaactttagactccacttttcagcctctgatagctgttgaacaacaataatgtaacttgtcaaattactgatttatggtagaattattactgtactgtatttgaaagcagaaaactttaaaaagggaattatactgaaaagaaagagctcaacttacatattactttaggttgaattataaaggaaaagaaattgttatataactgagatatattatacagcaacagaacaaaaaggtgagttttataaaagcataatttattgacatagctttgtcaaagctttcatttgaaatctttgtttaacagaagtaatttctgttgggtaatatcttgttggattatttcttgtatgaaatttttgctattattttttaattttatggcattagtttcccaattttatgggtattcagagacctttgagctatgactaggcttttaataagtcagataaataaatcattttaaatttcccatgggattattgatacactaaactaccattgctcttgttagagtacagagaccctcaaatgcagataagcatcatgatttatggcaataattctttcatttactgtagttattttacatgtctaatgcctcttacaataaaatgtcctttgataattaggaaatgaagatcatcatctatataaaattactgctgtagaattaaatgatgctatgttttgccctgaagaattagacaaagccagataaagagaaatctaaagaattcttttgacattaaatgttatcaacttaaatattttattttctccactgaattgtttaaatttgcaaatattagctatattatcacacaagtagactctctcaagactggtgtgatccttggaggaggaaattttataaacccagtatggttaaatcactgagaaaaaaaaaatgcttttcctctgtgaccttttatgtctaatcttgggaggaatgactattaaatagtaattagatccactttaacaggcctgtagtataaactgccagagactcttttctaaagtggcaattgtatatctggcctctggtaaagcattgccaaggagataatcaactttgtaaagtcatgaaacatgggattatttggtttgttttgtgttttaatacaaggattaagttcattcatttgcctgtgaactgtacatagaaaggtagttaataactttgaagcacaaaattaatagcttgttacccaagacagctaatataattagctcccacacactgagtctttataaaatatgtgaaaggaaataaagatcggttagtaaaagtctttatgtttttctttctaaggttcttttttccctattctctttttttcttcctttggttgaagggagcagttcacaattttaacaagttcagtgaattcatttctggaacataataaccatgttcatatgtatataaggtgagctgggatatgctacaatctgaaatttcactgttaaatcattttccttgacattgtgatacatgcaagaaaggaaggaagatgatggaattttgatgaattatattcaagacattttgaattggcaggtaaataggcacctaattctccaagcagtaactctgctcttaggtggaaagagtatttattttcacttctttagcattacccagtttttaatgtggcatggtgtattctattcacctccattagttgcaaaataagcagcaaatgcattcatccaggtgaatatatattcagagtgacaaaatcacaactaataaaaaatttgtattctaaacatattattctgaattgaaaaagaagggtacttgtacaaccctgggaatatgtttctctctcacttcaaaacagctgaacaaatggcagggaatgcttgcacagctgtctgaaacctttggcagatgcttctgggtctctgtggctcatggcccattgtgtgacagtcatgacagaggagctggaatgattctgtttttcagatctgttctttttctctctgcatttgaacgttgataaccctgacaaatcacacctttccttgtctcctgggtctcctggcttataatgaaatttcatccactggttgttaaactattgtgcattatttgactggtacaattgttaaaatagtcctcttcatcaatatatgccattcagaatttgagtgtgtttgtgtgtgagtgtgtgtgtgtgtgtgtgtgtgtgtaatgagccacatgcaactttgaaagctactatagtactcagtctggcttttgagttggattattccttaagccgctgtgctttgcattaaactgactgtggaggtatagtttgcagattcagttcctgtccttgtttcctccacatggctccgattccagggtctttagaactggaaccataatcctgcagcttcatgattggttagggaagccttgtagaatgtaagggaaagctgatatcacctccttgatggttattaccattcaagtggatgtattataacagccacatggttaggatggaatattgctgtcacagatttgtatcatcattaccattactggatttgctttaggttatttctgccatactacttcagcagttactctgtagcactaggtacaatgaagacataaaagaattatgtgtcatggtgtcagcctgtagtctctgtagcactaggtacaatgaagacataaaagaattatgtgtcatggtgtcagcctgtagtaatgaccatgaaaatcaaggcaggtgggcaaggcatacttcaggaatggaatcatgaataattgctgagcaattggtcagcagatgtgagacccagcaataacggtggattctatattagttaaaatactgaacgctaagagttaaatgttgtgctctaatccaaggtttttgttttctacccgccctcacccactacccccagcaagccaccttttcaaattggacagtagtttctgcatctgtaaaggaggaagttaaactaagtgatttcaatattgtcttgtagctgtaaccatttttaatttttttaaatgcttgatgttactgtattatgtataaattatgggtgtttaaagaaaaattgctaagaaaatttgtattaagcactaaagaaagtataagattttgaagtgaaaataagagggaaaaggagacatcaggcagtggtataggagtgggtggaaggtgaggttgaatgttcaagactgcactttgatagtttagtatttttaaatctcattttatccataatgtaataaaacagtataacaggagagtaatgttaagagcattttaacaaaaataatacagtacagtgtggtagtatgtgcctatggtcccagctacttggaaagttgaggtgggaggatcacttagcccaggagttcaaggctgcagtgagctatgattgtgccactgcactccagcctgcgtgacagagtgagaccccgtctctagaaaagaaatatacaatgtggataaaatgataaattcaactgtataaagactggcagaagtagagaattaaacaacacctgttagggtgaagaacattgaaaatattaagctacaatttttaaatcaattttagaaaaacaaatagggacaatagattataatactctacctcccaccctggaacaagtacctcttaatttgtacttgtttccttcaagcttcatctataggcatagtcatttacatggcgaaaaatctttttcagagaatcaactgtatataagtaaaagaaacgtatgagaaaaaaatcaccactgagatataaccaacattaaacatttttgtattcccttttctagattttcacaattgagttcatgataaatttatggttttgtgtttagcttctctttaacaggaaatagagagccatttccaagccattaatatgtaattgaaaatgttattttaattatactataatatcttacaaatgtgcccaaatagagaaactccaacatttctgtattactagataatttgcttgcagtttttatgctacggtaatcattgcatatttttaccacatttaattattcattcattcagcaagattattaggcactttatgtgacagtcactgtgactatggtggtaaaccaacaaacatagcccctacttgcttcgagaatatggtcagctgagctacatttgaatagcttccaggaaaccaggtcagaaagatgttgcaaaacgattgttacacatcttggatataaatgatgagaaaaagagtcaaagataacttaaaagcttcaaatttggggaattaagtgatcaacgatgtcattgaaaataatgggaacattgaaaaggagtaccactggagggagaggaagaagagaactcaaggtactggactttatgtgatagcggcggtgacctcagatggacatgtccagtatataactcatacacaacaaaatcagggagatgcatgggaatcaaggagccattcacccaaaagagacaatcttggttcccacatcgtattagttcttgaatcataagaaggtagagggaaatgcagtggaccactgcctaccttgtaggggatgttcatgttttgggggattggagggctagaccaggggagaaatcagtacagtgacacaaatcaagggaagggtgaccagaagagaaatgaagggtaagaacagaaaaagaaaatcactccctggagcaagataatacttcagctcaggtctgttcagcgggtaggggtggtgggttatgaagccagattcccttccttgcttgttcccagcatgttctgcacactgctcatgtagtttgtggcacattgtatgtgcccagtaaatgcttttagcccagaggaaaagaaagatttcctgccccaaaagtgtaagagtcaacacagaaaacacacatgggtttattaagaaaggttagactttccatggttattcaaaggagacctgtgattctccttgatgttttggtgatgctggagtgaaggtgggtatagcctcagagggatgcactaggttgtccactcttggctctgcttctattaagattttgcatgtgaaacagatcccactgctgaaagaaaggttgaaaaaccctggactaataacatcttaaggtcctccctggtcaatagttctatgaaaagaaaaagtctatgtggaagaaaagtgttcagaagagatccagtgaaaatgaagatgttgcaaaaataaacattgagtggttcatgtgtggagacattagatggatgttctaataaagaaagttctatgcttctaagcgaatggaaatgttggtagcaaactccagtaaggtcattagtcttacatgaaagctaagacagtgggatatccatctatagaatagctaatcacattactgcttaaaaagaaacttctattaaaagacaacctgtttgtgacccagagatttgaattaactcacatagtgaaaaaactttttttacttcagtgtttttgcattggagtaccacaaactttctataaaatggaaaatgagaacactttaattaaatcattcattttctaagttattcatttatgcaacagatatttattacgtgcttactctgggctaaataatcttttcatggtttgaggagaccgcagtacacaaaataacattcctgctctcatagaactgatattcctgtaaggaaagatagacagtgagaaaataaatatataatgtgtttcttaagtgctattctgagagatgccattttacataccatgttctggggagttttctctcagaggtgatacttgttcactgaagtttgtaagggcaccaaactcacaaataacagggatcagagcatttgaggcagagggagtagcaacttgggtgggtttaatgataatagtattaaatgagaattctcatgcctgcatatgttaaattaaggaacattctcccatgtattgaagtcatcctttatatgaagcattttcttacttgggaaatgcttgctttgtgtggaacattaaatttctgtatatgttacaattcaggcattagattgagtgaatccacggagtttgaagtacaactgaatacgtattccaagtaggaattatgctggggctagggatttgggctttctgagtcagttcaccatgagagttagtatagatacaagaaaatcgaagtgtttctgttttggagagtagatgatagttcagaagggagaagggaggaagaatgtccagaggatgaagagacccagagagtgctttttttgaaagtcaaaagtagaagaatttcaagaaggaactatgtatcagctgcatcaaatactcagaaagctgagacaggccactggttggtgacttttgagtgctgaatatgtgaagccaggttacaatggatttaaagggtgagtgggtagtgaagaattgggagacactgagcctgtagacaactttgagaactgggtcaatgaagagaattgatgtcaccttgaggatattttacaatcaatattcatatattttataatctaagtatttttaaaataatgaaaaccagtatatttgtaaggtaaaggacaccaaagatccaaaaaggcatactggatggatcaaggtattggagcaggcaagagaggatgggtggaggagacagtgccttgaaatgtggatgaaaaatttttctgaaagaagaaggggaaggaaggagggggacatttcaataaatgttttagaggagagagaagaaatttgaagattttatgatctgcatgattcctacgtgaaagggagtggggtatggctggcacagtgatgtgcatatggagggcagatgttgagggaatggataatattcataatgctggtgaaataataaatgatttgcaactgatatgataggaaatagttgctgactagatttttaatctattttttatctgagacattattatggaaatagaaatgttgtcttcccaatttgtgatttgtgatagtttatttacttttctattaacataagcttttatatcttcctaccacctgtaaatatttcccagttgtagtaatttttaccaaagacttttctggaggctatggtttacctctgtgatctgtcttaaatgttttgaaaaaaatttaacctaatgtattgctgtttaatattactatctttttaatatacatgactttatttttaacatatatgactacttcctggttgttctggttattttttctcatgtaaccacctcaaaaccccctagtttaaataaacaatagtcatttttaaattttcttttatggtttcagggtcaggaattcagtaggagcttggctgggcagctctggacttgggttgcagacacatggtagctggagctcgactaatcagggctggagcagttgggactagccaaacattcctgtttctttcttcagagtcttagggctctccaagggttcttgccatgtgggctggtttggacttccttatatcatggtggttgggttccaagagtgggtggcccaagaggaccagatggaaactgtgtggtttctcttaatttagcttcagaagtcatgcagtaactctctcctggtcagagcagtcacaaactctcacccaaagtgaagggaaggggacatagatcccatttgtacataagaatgtcaagaacgctgggactgtgttttcaagctgccacactgaccatgtaaattttcattagagcatatcaccaagtcgagctgataaacagctttgtagggaaaaactccaggaaacaattttatcaagttcctgaattttttgtttttcccatactccttatagccattatattactgcttcccgtgctaaatataaagcatgaattgtcaagagtgttacttcgtgggtcatgaggtccctcatttgctcacccttttttcttccctttttgactaacaagttcatggatgtgtcagactgaaaaagatggcgaaatactgccatagtgtgacacatctgaggcaagtgaggaggtggtgacacttcttagcagattccctaaatgttctccataaagcgtgttttcataattcccattctgcctttgagtaaaactttcatttgcagaatacttccccacgtaaatctgatttctcagaacattacatatgttatctcttgaggtgagcagcatctaagatggctcctagtgtgcccaccgcctggcgtttatgcccttgtgtaatgctttccccttgagcgtgggctggacctcgttactcacttctaatggatagaatatggcaaaaatgatgggatatcacttctgagactaggtgacaaaatgattgttacttcttgctcactttgtcttcctctcttaccggctcgctctgagggaagccagctgccatgttacaagttgctctgaggaggggccctcatatcaaggaactgatgtttccagccaacagccagtgtaaacctgaggcttgacctaagctttgtgaatgagcttagaagtggatgcctccccagaggagaccacagccatggttaacaccttaattgccccctcatgaaagactgagccaaaggcacctagccaagattcattggaattcctgaccaaagaaaactgtaagataataagtgtttgttacttaaagccactgggttttgtagtaacttgttgcacaccaataattacctaatataactcttttatagagatatactaatagataactaatatatcccatgaccaagaaagagtagatactattattactcttattttatagcagagaaaattatctttggagatcatatgaacttccctaagaagacatgtttagtgtgtgccagaactgagactaaatgccaaatctgcttactctttcatcagaatactctgttttgtctttttgtttggttgtttttgctctgattcttaatcaggagtatgtcttagagttatttgttgaatgcacattcttagaccccactgaggattctgaatccgagtctcaggggatgggacatccctctgtagtaaaacagataagcagtccctggttgatgagttctcttaagaactctactctaaaagatacatggaattctttgaaatgttaagcatgttttaaatttcctggccttatgtgacaaccttaaaacctagatagtgtggacattctatctggaatgtggaagtcattcttcggttagactgagtcctttgtttctcacagagatacttttgataggacctcaagggaccctcccttataatgaggatattcatggctttgtgctactagtatcaggtgactattattagaattgcatacacaagcaaatgaatatttgtaatcatcatgtcccagcactgtgacttcttatcttagctggccacttgattgacactctgttttccactctcattttgcaacttaccttttcttatgcttcagaagtctttaccctcaaggataaatctgtccaggatgttaatcttttagtgaggcatgagttcatttaaaacctgaccttgtatcatctcttgcccaacgccctgcaagaaaaaagcctcctcaaaatattctatcctaaattgatttcttatgtctcactattacataacttgataaaaagctatggctgtttgattaagatttatcataaaataatctacccaagtcattgaagcatttcccttagagaacagttttattctaagtcaagttaacagattatctgaccttggagctgaatttgtcctctatctcatttgtctcttttgacaatgacagtcatacgtttccaggtaatgtgtatgtatggaggctatggctttcatattcttactaaaatctctttgtgggtttagttgtactggaagtgttgaaaactgtattttagatataccattcaattaaatttttcttagtataatacctaatataaattcaggcttctattaattttgaataactctagacatgaaaattgtcagtgaatctgagtctctgtgtgggcatatattcttctccaggacaaaagcaaatgtcagtattgtcatattttacctttcatgttggtcaatccctggtaaagatgcaagaattggtttagagacacatatggtgctattaaacttctgtgtctaagtatctgccagtttttcctcttcctctctctccaatgtctaaatataacccaacattcaaaatatatgaaatgttccccctcaccagtgaatttttctctgatttttcaattggaaattttctttcctcctcctggacctcttggtctctttgcccaaactttctggtgtctctcttcagtgtctgccttgcactgcagctgttttgctcttattctcctaatagagtttaggatttgagagtagaggtaagaatataaggactactttgtgtggagcaaacagtatgtgccctgacatggcttagatattgacttgtgatgacagaattattgcagaggccaaggacatttcttgaacttctctgtgtccctttttaaatacatcttttggagaattctgtgggaatgaagttagaaccaaagtttaaaaattaaagatggttttccttctttcatttgtttgtttaaaaatagatgcaaattcatgctttttgttagtttctcctgttgcagttctttgttctaataatacctaaatcattaatggcagataacatttaacattcagatgcagagttcatttccttgaagctcaagagaacaaattactatcaatttgctctaagtaaaatttggtattaaaaatgtttcatgtttgccaagtagaaagtaaacagctgagaggtgttaataaaacctttttgggagaataatattaggttcttttcttggctctcatattattcataataaaatgaaatactgcttatctttcatatagaatagtgatatatgcacatttaatttgattattgactcttgggatgtgattcaagtcattcagcagttgtgagtgtctttagtaagcctgacagtgggcttcagtgaacttctattttgaagaagtttgacaaaatttttattgaatgttctttctactgcttagtactgggaatgccactctgaggatattatgaaggtaaaataataaaggaactaaaattgattttcaattccttattaattttctaccttataccaaaaatcttttttaggcataaataatcagtgcatagagtggctcatctcattattttgatcttcctaatataccatcatgtcaaattagatgtgaaatggaaaaaggattaacttgaatgacattttaaccacctttctagcaaaaaatattttagatgaatataatgtgttttttgtttatctttccaaatgttaagctaatttttacaagcaataaaatatgctattatatgagaaatctcagtaccttccacttaattttgttgtcaacctaacactgctttaaaaaataaaatacatgatttaaaaaaaggatgttgtggatgaataaaaacagaatactgtccacaaaatccattctttttttttgaggtaatagtaagattgtcctttcaggaatttcatcttctgtcagtgagacacagtgcagaagtgaatagacacttgggcaataaaaatatttattctctgacagttttatggaaactgtggtaggtggggtagagaggtatcttagtccattttctgttgctgtaatagaataccacagactgggtaacttaaaaagaaaataggccgggcgcggtggctcacgcctgtaatcctagcactttgggaggcccaggtgggcggatcacgaagtcaggagatcaagatcgtcctggctaacacggtgaaaccccgtctctattaaaaatacaaaaaaattagctgggtgtggttgcaggcacctgtagtcccagctactcgggaggctgaggcaggagaatggcctgaacccgggaggcggagcttgcagtgagcggagatcgcgccactgcactccagcctgggcgacagagtgagcctccatctcaaaaataaaataaataaataaataaataaatttacttcttagagttctggaggctgggaagtgcaaggctgaggggctgcatctggtgagggccttcttatgtcgtaacatcgtggagagcatcagatggctagagggcaagagcatgtcagctccggttctctttttctcttcttataaagccaccagttccatcatgggggagtttatctagttctaattacctcccaaaggccccatctccaaatgtcatcaacacgtgaatttgtggattaggtttccaaaactcgaagtttgggggaacacattaaaactgtagcaggaggtggtgccaaaataagcaaatgccaggctatgaagcagaggaattaacggtataataggggatcaagctgaagcattaaaaacctgtcaccagggccgggcagggtggctcacgcctgtaatcccagcactttaggaggtcgaggtgggcagatcatgaggtcaggagtttgagaccagcctggccaacatggtgaaaccccgtctctacttaaaaaaaaaaaaaattagccaggcatggtggcgtgtgcctgtagtcctagctacttgggaggctgaggcaggagaatcacttgaacctgggaggcggaggttgcagtgagccgagatcatgccactgcactccagcctgggtgacagagcgagactctgtcacaaaacaaaacaaaaacctgtcatcagtactctggggtaggaaaaactgttgggggacattgctgctgaccttctccttcctgtgtatttaagttgttatgaattggttaaaatggcagcattcgcttatttgagcagagctgtgtcaacattacttcaaaaaaggtaagaaatgcgataccgtattatcattcacacaaaactcagcaacttttaatagaaaataatcaaccttctactcttgagttttaagagtggcctatttgttcaaacataggtattttgcggtttacaaaaaattattattacttagtagtataactgttctgtctcagccaccactttagcatttctttaataccaatttgaaaaaagtaatgactgggccatatgaaatagtttcgtcttctctagagatgtatacaattatttgacttctagtttctaaagtggtgattttatttatgaaaataccacaataagcaagctgaatttttttttattgcttcagtaagccaactgcttggtatttctttgcttagaaagttagctgaaaaatacacagcagaatgctcacttcctcttgctttttgacttaccatcccctgtaggcctgcagcccaagaatggagtttgacaaatgccaggaatctagcctataatttgtgtttagtgttcaaaaccctatacttaagtaaaaagaactacaaaccagtcttctgtaggctacttccaattcactgctcaatattttgccatctctttttatgtgatcctgtggctatggcttactttttgccaaaaaacagctgtggcttactttttgctgatgtacacacttattccagattgtttccaccaatagccaggcctgacatgccacaccatatgtttataacattgggataggattcaagaaagtaatagaaggatatagccgagattcgtgttagtataagtagtttattaaggtgttgctacaatgacagagagtactctttattccctccacataacccaggctgctctttgagaactttttttgcttcagggctacctgtgacaatatgtaggacaagttttagaaaacagaaagacaaagatgagaatttgttttaagaggctctttcccaaagtcttaagaaaggagattatctaagtgaggtcttcacatttaatgacattctcaaaacagcagtttgtgaagcgaatcatctagaatgtttatgctttgggaagttcaggaggtcaacagagtaactaagaggattacacatttaaaactcagtgcatttctaaatgcctttattcatatttgtatggtcttcgctggaataaaatttatgggagcaagctattcatgtcaggttagtttttggaaatacataactaaattcagaaatagcaactacagatcagcaggcaaaaatattagttttttgttattgttactgttttttttgtcttaaactctgaaaactcttaaaattaatctttacctttgtgctctgaagcagcttttggttagagatgctttcttttcttttgttctagtccatctgtttatgaaaaaatgttatcccaatgaaataggcttttaaatattggggagaaacagtatactgtctaggatgacagattaattcccttcttttccccttaagggagactagtaagaatttgaagacatattgatgctgatagcttacccctaaggtctgtgtgttctaccaaaaataatgaaagaaggaaatttagtcctgctactgactctcagaatacgtatctttgataatagcagcctgtcgcttcagatggtaagataaaaaaatcactcagaagagaaagaagaaagcaaatgaagagattttatccacgctgtgttgcagcttaacctgctggataaataatatagtgataatggaaatacaatatgaagcttccttcaatagtggctccgttttttattgtttctttcatgggaaaggcaatacttttttcaaatatgaatataaagaaactttctttttatcctcttactctctcctttacttctatttagtatttcattaatcccactcaaacccaagagggaaaattaggatatgtggcagtaatttgcgtatgtatctcctagcaatgtcccaggaacaaagttggttgagcctagcaccctgtgtgctacctccattaaaataaccgacacataaacctttcatgtaaccagagctgtcagagcttaaacccagttgttgtctttaaagctctttgtctttgcattacactatgtttaagcccaatgtaagtgatacaacttaaccatttgtaatgaactaatggagtttatgactcaaggaggtgatagtaaatatggaagtatgtcaagtttatttaaggtaaattctggaatgaaagattacctctggactggttgttggaagacccaacctgtagtcccgtctatttgtaactgggtttaaggagggtttgatttatttacctatagaatgaggttaaagaattcatagcctgcaaataaaaaacatattagtgtaattgtttgttgaaatgaaatttcaccaataatgccaaatttcccctgtgtagtatccccccaacctccttagagtgtctccaagaaagtacaggactccaaggaacatactatgagaagcactagatcaaatgatgtttacagtatctccaaaattgtttcattttctccacactagttatatttgctttatgttataatatctcttatatatttaaaaattaatgtcataaagatttctttatgcctttatgttctgaatgtattacctccattaaaatatttgtcttctgatttttcttagctgtttaattattttgatcacttgtgtagtgtaagtattttgatcccacagcagttttttccataactcctagtatgaactgccttttactaaaactaagtattcataaaccaactcaaccaatatgtattgagtatctactttatgtcagttactgtgttagaacctaggatgtaaaagcaaacaagacattgtcttcaccttcagggatctcacagtctggccaaggagaaagataggaggcagatagtcatgacaccatgtgttaagtgctgaaccccagcctcttgaatctagcctcgtgattaatttatcttcttggatgtttaataagaatatcagatgtggccgggcccggtggttcacagctgtaattcagcactttgggaggccgagacgggtggatcaccaggtcaggagatcgagaccatcctggctaacacggtgaaaccctatctctactaaaaatacaaaaaattagccgggcatggtggcgggtgcctgtagtcccagctgtttgggaggctgaggcaggagaatggcatgcacctgggaggcggagcttatagtgagccgagatcacgccactgcactccagcctggcgacagtgcaagactccgtctcaaaaaacaaaaaacaaacagatgcaatctatctaagtcatagctcttaatatatcaaacaaaatcattcaaatttgttcctctccaatttttcctatttcagtgaatggcagtttaagagtcactcttaattcttatcctgtcctcatcccatgcatcagatgtatcagctagttctactaattctagttgtaaaatagatattgatccacagttttccaccatactagtcctagtcatcattatgtctcacctggtcactgtcgcagtctccatatcacctccattttgcccccaccccttgacaacactcctgtcatcttaaatggcagccatggtgtgttagctagcgtattggtttgcctactgaaaaagaggcaaaaatgacatgtcttagaaaaaaataaatcgtttgttcctttctcatgtgtaatgcaagctggtagatggatgggctgtgctgcatgaagtccttcaggttcctgggtttcttttatctggggtccctctctctccttgggtattgccatcatctacatagtagaagctgggtaaccaccacagcatcaaattccagaaatccaggagcttcttcctaaaggtgtgacctagaagttgcacacttccacccatataattttgtccagaaccctgttacatggccagaacaagataataaggagattgggaaatgtaacctctagctgggtcactgggtgttcatataaaattcaagaaaattgattgtttattggagaaaatagaaaatgattatgggggcaggcagtaagtaaactccattgcccagggtggttattttaaaatgtcagattatgctggtccccgtgtatcaccctttgataacttgcagtatacattgactaaaaagccagattcccctaaacacactgtatcaaaatatgtggaatagagctaaagcagtgcttagagggaaatgtatagcattaaaatcttatactagaaaacaagaaagatttaaaatgaatgatctatgcgttcatactacaaagtagaagtatagaagcaaattaaattgaaagcaagcagaaagaacaaaatgataaatatgaaagaagagatatatgaaattgaaaacataaaaccagtagaaaactgcgatgaaatcaatagctggttttttgaaatgattagtaagtgtgataaacatctagcctgacttactaagaaaagaaagaagagatgtcactttccgttctgaagacattaaaaggctaataaaggaacattgtgaataaatatatgctaataaagttgataacttagatgaaatggacaagttccttgaaatatacaaacctattaaagcttatttgaggaggtacaagtaaccaatctactggggagtggtattggtgaggggcatttccaactattttcttttaagcctaaaggtgtgtgagcaaggtcaatagaaggacaaagccagtattaaaattttggattttgaaggagactcctatttccttaaagaatatcaattgatgtcatcttctggtagtaagttgttggtaagttggatgacttggaacctaaaggacacaggggaagttttgaagtgaagcggtgagtagcgtgcagatctgaccatggtaaattaatattgaaattaatgaatagcactgaggcccaatttgaggtttaaagttgttgcattcaccaatggatggttatcatagaagtttcctgtaccaatcagggttcagtctggtcaaaaccacactataatttgaacaaggatggcttaatatacttgtgaactatttacaagggatttgctactaaaaggatataaaagaaaaatctgaagaataccctgaggctgagggagagaacccaagaaagaaaccagcgtggaaaggctctccctcgccaagttcagattcagaatctcattggagaaggagtggtgtggtccactgggtgatggagaggttcattgtgttaccctgggccagatctggcccatagcagcaggacagaggctggtggcgtgagattccaggtcagcattagctcactggtggcttccctctgggtgccagtgggcccaggttggtgggcagggcattgtgagcaggaaatcccctcctgggttctagcaggctgaggctggtgagccagcagggaactgctgacaagggctggaaagctggaaggtgaacaccacttcgtggtgggtgcactgctgggaacacaagccactggatcaagatccttcctcgttcagggtccctccagcaccatctacggacaaaacttagcatcttgtcagctggcaggggagaaatattccaatatcacaaggaggcaatggaagatacccttggagtggaacagcattacacgtaagcagaaacttaaggtctaccctgagcactaattaaaaatttcaaaggctttatttttttaaatcacacatgaatacatatcattttattattaaccaaaggagaaataaatcaatcttacacattgtgggtcaaaggttatagctcctagtccaagcaagatgacagctgaattccaattcagttgacttgtggtcagggcaccctggaacataagcaatttaaactgagttttctacacttggataaaatggcacattttggcagaattttaaggtttacagtttcacattccaaggtgtggctgttgtaccattctgacacagaattggcatctctaattaacgttatgtaaaacagaggcctgtgaggcagagctggaggagaccgttccttgtgaggcaaatagtggtatttttagaaccaaaccggatttttcttttggggtccacatggcacttaacagatggtgatgtgggcgactgtggtttaagatctgactcggttcataaagacacccagtcttgtcctggtcccaccctataggcagtgatggctccaggctcatccaaacaactctgcaacaagatggtgtcagccatccacgtgggtggacaccgctggaccccgtagacaggcagcgcctggactgcagggcatctgggaactcagcctgcttcagcctgctggcgatgttcagaattagcataagcatgcttattttaatttggaaaagaacttgaagtttttcccctcatggctctttttagttcttaaagaatataagtttccattgaaactacccttccccaaaggctactacccttctttgaattgttctttaatattccattctgtctgctatataggctgcattttttcagaaaccaattctggcaagttaagtagaaagaagagagaaagccatttaacatgtgctcattttcttttttcagaaaacattacacataactcctggatagaaattccttactaccaacacacgtgctactaaattcattttcttaatttgatcacattttatttttaaaaataatttgttccctatatcaatatcctgttccacttatttgaaatttatttgatcttgtctttgtgatttgttgaattaaaaagtactcagaattccactagattttggaaatatgtaaatttaaaaattaaagttatctccaacctcactataattccctgtctggtaatgtttattaaaactttcacttatatattttcttttatgcccatgcaatcattcacataaacagtatgtgtttgtgagtgatgtgtgtttcaccccaaaatgatacaaacatcgttttcaacttgcctttgtcacctaaatcagtcacggatagctttctcagcaatttcatataaatcttcattttgcttgaacagttgcataatgatccattctatggctgttacatatttatcccacctattcctgaaaatttaggtcatgccaattttgtttttgtttttgtttttactgtcatggaacgacaagcctgctgcatccttgttcatactcagagctttatgcactcatatgttatcttggtagaaacgattcctagaggaggattgctgggtgcactttgaacatttttataaattttgacaaataatgctccagaactcttgaaccagtctacactcccatcagcagtgatacatgcaccctcccatcccaccttagtgccagtgttactgactctccactagaagctgccctctgcctggactggttggcacttgagttaacatttttgttcaaccgtgatttgctttcctaagacacaataaactcaacaaaacctggttttcaatcttagataatttgccgcagtagcattattccctggagaacagtatcagaccagactttcctgggacttaccaaagcatacactgtgcatagtcaggtgtgggccacaccactaagttaaccagggtcagttttccacatcccatggaaagggagattaagttatgttagttattttctacaccgtatgcatttccagacagaacactgctagacacatttataaaatgtataacaatcagataactgttaccagtaattggcagccaagcaaatccaccccagctacaaatccacccaccacaggagcaaaataaatgttatttttcctttttcccagatgaatagaaccctcagattcatttcagctgtatagaatgaaaaagccttccagctagcagctgtcagtaaactgttctttttttctgtatagacaatataacatcaataaagatagtttgtgaaaacaggagggaggaaaaaaaaaacaaaaatcctgacaagtactttatttttatttttacacatgtccttctatgtccatctgtcagtatctttatgtgcttgaaatctttttatgaatacatttttacattatattttcattataaacacaatatttcattagatactccatgtaagagttgcagcctttgtggtcagtgtgtgtatggttcagtgagggatggtgctgacctccccagaaaagacttctgcttctttagatattccagtattggattaggattgctcattctgggtataccagagccttacagggtgcctagaaatgggagccagtgccgggagaaggccaaaaaaaaaaaaaaaaaacaaacaaaaaaaaacagtggatggtggaggcagcattcgttgcagtaattccactcaagaatttgttgtctgacacttcacaaagctctgctaactcaaggtgaagccagctagcaacctgaaattgtgaatttagtgtggctggcgggataaccagaataatcaagggtgagagaaagacaggcaggtgaggaaaatgaacaaacagctacctgaacaagcagtgcagcctgtgatctcagtttagaataaagaccaaatgtaaactttcttaaattcagactgcatttgaagtcattgtttgaggtttcatgtgtttttgttgtttgttgttaattttgctccttccttccctccctcccttcttgtatttgtattatgtcccccaaatgcctattatttggcagtaatttttttttcttaaagcctttaatatcagaatctcaaaaagactggaacatatcaaagtgagtgggggagaatttgcagttggaataagcatattcagtttttctttttctgtcaggatacttgattacttctgaaattttaaataacagtcatgaaaggcttaagggttttatatttaaaagagggtattgagttaactaaagtgtagaaatgctactgtacaagaatacaaagttgtattccatgttaaatttttacctctttatgtcattctttttaaaaattttaattactttatcagggtataattgacatactgtaaattgcatgtttaaggtgtacagcttaagttttgacatgtgtataatcccatgaaatcatcaccacattcaagatagtgatctatccatcattccccctcaatttctttgaacctccttgtagtcccccctttccttccctctttctgcttccatccccaagcgactactgatctgtctgctgtcactgtagattagtttgcattttcttaaattttgtataattggaaacataagttatctacttttgatttttgccctggctttttttagtgagcataactattttgagatccatccatgttgttgctagtgtcagttgtttattcttttttttattgccaagtgatatgccattgtatagatatttcacacattttttaaactcttcacctgttgatggacattttagtttccagttttgttgtacctttctattacaagtaaaactgctgtgaacattcatgtaaaattctttatgggacatgttttgtcttccgttggattcccgtaagagtggaaagctcaatcaatacggtgggtgtatgcttaactcttttaaaaactgccagtctgttttccagtgttgccataccatttacattgccaccagcagtgtatgagttccagttgttgtacatctttaattttagacgttttaataggtatgaactaatattccatagtggttttaatttgcatttctctaatgattaatggtgagcatcttttcatgtacttgttttccatctatatgtcttctttggtgaagtgtttgttcagatcttttgttccttttttattggattactaatttctgatcattgagttttgagagtgctttattctggatgagaactttatcagttatttgtaaatattttctctcagtctctggtttgctttctcattgtcttcacagtttcttttgaagagcaagagacataattttgatgaaatcccaagaaatcttgatctaccccatggtcacaaagattttcttctgttttcctccagaggttttatagttttaggttttatgtttaggtctaggatcgatttttagttaatttttgtttatggtgccagggacagattaaaattcctttttaaattttatttttgacatatagttttttaatttttccattgccatttgtggaaaagactatcctttctccactgaattgcttttgcaactttattgaaagtcagttggccatgtgtgtataagtattcatagactgtttcatcttgatgtcagtgccacactgtcttgattaccgtggctctataataagttttgaaagttaggttgtataagtcattcaacttatacagacttttctgaagtttggctattttagatcctttgtattcccatgtgaatttcataatctgctgatcagttactacaaaaaaaaagcctgcttggtatttaaatgagattatattgaatttatagatcagtttggagataactggcattttagtaatcttgagtcttccaatctatgaacatagtgtatctctcaatgtatttattctataatatctcagcagtgtttcatggttttcagtgtataggtcttgcccatcttttcacattcataactgttaatatttttatgctattgtaaatggtatttttgtttagaattctaatgtttcattactagtatataaaaatgaaattggtttttttatattcatattatatcctgcaactttgttaaaatcaacttattctagttgtttttttggtagattacatagatattctatgtaagttatcatctctgtgcataaaggtagtttttctttttgtagtccttatgtttcttttttctccttcttttccttccttctttccttccttctttctttccttccttctttccttccttctttccctccttccttctttccttccttccttccttccttccttccttcctccctccctccctccctccctccctccctccctctctctctttcttttttttttgccttatactggctagaacctccagtataatattaaatgaggtggtgagaatggacattcttgcattgttcttaaactcaggtgaaaagcattccatctttaactactaaggatgatgttagctctaggttttttgtcgattccctttatcaggctgaggagcctgatactgcttgcagacaattgatactgctttgcagacaatttttatcgggaatggatatcagatttggtgaaaattttttttcttgtctactgagattatgatatcatcttgcatcatcttgaacaacaacaacaaaaagctgctgttttccttatctgtatcctggaataggtattgtccctacctgaggcatgatactaggtgagttacttaataaataggggagagggttgggaatcacagtcctcagcacctagagggttaagtgtccattctgtgctggctaaataattgaatgaatgaagaaactgctttaaagatattctctttatcactggttttaagcaatttaattataatgcattttggtgtgcttattatatttttgtgcttggcgttcagtaagtttctggatgttactgtataattttcaattttggaaaattttaggctattgtttcctaatatattttgtttctgcctcctattcttgttcctctcctttagggtctacaattacatgtcttttgggcaagttcattgactgattatcacatgactcactgattctgttttcttttttctgtctcttttccctacttgtttcagtttgaagcatttctgttgctacatctgcaagttcagtaatctgttcttcttcaatatctaatgtatcattaatctcattcagtgtatttttcatctcatatattgtaggttttatctctaaaagtttttaaaaaatctctttcataccactgcttaacatgtatagtctttcctctaactttcttaacatatggaatacctatgtaattttcttttctacaaagtctgtcatctttgtcatttctgggtcactttgattgattcagttgatttttcttctcattatgggttgtattttctttctactttgtatgcctggtaattttttattcaatgccatatatcgtgaattttttcttgccagattctagatatttttatattcctaaaaatattcttcagcttgttctgtgacatgttcaagttacttgaaactgtttcagccttttggtcttgcttttagactttgatgggcaagattatcaaagctgctgcatttagcctaggataaatttttctgcactactgaaacaagatcctttttagccctgtaaacaatgcctgtgaattttgagatttcctactctggccatgggaataggcaccattgtcatccctgtgtgagctctgtgcactattccctcaatattttgggtagtcctttccctaactttgagtagtttcctcaactttatgcactgacattacttaactgaatcatcaaggggactttctgcagatcttcatagttttctcttggtacagatttctcctctttgatcctctgctttgcatattatagtagccttagccttcctggacttccagctatgtgtcttcaactcagggagtttttcagacttcctctgggtttctcctgtctgcagattttcttcaggcagcaaattggagcaatcatagattcaacttgtttgttacctgtctctagaatcacttttctttattaccctatatttaagtgcttgagggccattattttatatgttttctatggtgttgagttgcttcaggcaggaaggtaagttcaatgtctcttacttatcttgactggaaggggaagttgtgactgattctttatgtcccctagcatttaacatgatgctagatatatagtaaatactcctcaaagggtaaagatagagagtcatttacatagattcatatacaaataaaggggtagtgtgtaagtgaaagaaaaatatgtaattttttgagagggcgtaacgttaagtaggaaatgtcagacaacacagcatttctgagcaggcttcctgggattgcaccatgctctggccagtcacttagtgcactagtggggcagaattttaccttcttccagcactgctgaataacagcaataacgtgggcatgaaactacttaatttactacctaacctgattgatcaaagccagtgggagaggcaacaggttatcactactctagaagttcccaaacacaggcctaggtttacatagtaaactgaaccccaaatttctttttcctttgttctcttcctttcttctttgcagcttcctgcccacggcctcccttagggaggtcttaccaaggcttctgatttgttcttcagtaggagatagaccagctagtattaaactcatctattttcactttctactttgagttctgctttctggcaatggattgttctttgcttctgtccacttgcttctaccaattattaaaactttgtatttgacttcattacctatgactaacaattttataagccctgaaactgagtcaagattttaaagaaagacattctagaaatcatcaaaggaaactaccagttcattttccacagggagctttttctcctttcctgttaaaatgtcactttggcactaagaaaatttgagcaatctggttgaaacctacgttcctgtcctggcaattaccagtgtttttaaggaaaaatctttctgtggatcacacggtctcattgcctctgtttttttttttttttttttctttttttctctactgcttctccttgatttaccttaagttaagaaagagtggttctgagttaggagaatcatagtgtctcacaatgataatcacaagctttatataacagaattaattgagggaacatgtaatgaagactcaatctgaagaggttttttagctttgcacaggagggaattctagagagcattttcaaccctgcatgagtctgtgtgactagcgaaataactattaaaaatagggaaattgaactggaaagtaggtgacctaattttttcttcttttatagttacatatgtggtgagagtaccttacataaactcttctggtatttaagctgaggacggttttattagttgtcaaggtattagaaccttgaaatatcacactagatgacatctcttgtctgtctacttgtcccattaccagaattcacattcagtttatcataatccagtgctgatttttgaagtcacatattagaaaaaccaaagttttaatacatacattcctggtaatgaggagttgggggttggggaacaagggagcagaatttaactgtaaaattacacttttttgtttatattaagctgtgcactagttggcccccttgctttctcaaattagcttatatttcagggatttttctcttttgcaactcaacattttattatagacaagagaaatctgaaacacaaaggtaatccagaacagaatttgatattactttgtgaacttttcgttcctttcttggagtcaaacatgagatcatgtttagaatgatttagcccatgttctttttccaagagttttaataaatgagtttagagttaccaactataaaacatacaatgatgatgatttttcccttatttttattagaagactatgttgtgaccaagctaagtgtgatgtagaggtagcagtagtattaaacaagcatagggattctgaaagcactaagcaagctaatatatcaaacagccataccatgggttcattgtcattaaagtaggttagctgccagtaaaggttagctatgtgtattgttactaatagaagtttgttcgatttcagatataaatattaaattccattatggtgcacgccccagcatgggtgaggagcctgagtgtccacctgcctagctgtatggaccgaccatttctaaagatgcctggttgactggggcaagggccaactgtgaaatcccctttcagtttttcaaagtctatgattagttccttgttgatatgaaaattcatattgcttgcttgcagctaagtctttgaaacctatgtccattgtcactaattttccttattagcatacttagtatttttctcttataggagtctatctatctttatgtaatagataatattctgtgtaatgtgtcatttgactttgccttaatctatttgtgtttttgctaattttttttctgctttatatgaagtccagatactttaatctcttcttatctgtgtcaaccttacttgcccattgttcctctttaacaaatcagatcagttttcttactaattaaggtcattcttatttttctttccttgagcattaactccttcctcaagacactccctgttttcactcccttacccaagttctgtacattcttcactgctatggggtctttagccccaggatgctcttccttttcataattactcttcactggcaattcagatcaaacagattgtacttaccctatatgccatctgctcccagaattgctcacaataattgaagatgtatcctgtagcattcatcttcccaatgaataggtttgttgggtctccctaccccagcagagtatgtcttgggttttttttttttttttttttttttgagactgtgtctcgctttgttgcccaggctggagtgcagtggcatgatctcggctcactgcaagctccgcctcccgggttcaagccattctcctgcttcagcctcccgagtaactgggactacaggcacccgccaccatgcccggctaattttttgtattttttttagtagagatggggttgtcttggtttttttataccttacttcatggaatatgggtatgaatcagttctgtgtttatataccaaaaaaaaaaggcatataaacatttcacaaaaatatttgttagattttcaacaagcatcctaaaatgatagttgatgatttacatgttagcagattactatgttttaattacattttgggaagttgattgggattttggggttgacatgtactatatcaaaatatttctcatttaaagtaatgggaaataggttatcagtattttcatggagaacattggcttttcagatatggataactgacctaaagtgagcaatgcctatatgaaccatcattaaataaatagatccctgctgctaacaccctggaggatgttgtgtggagctacatagagctgcccacaagaaaagcagccctacaaccagtatctaccttcagaacaatgcctgtaggttagcacttcttccattatgaattttgatttgagaatatttgaaaaccaatgtgttttctctgctgacaaaacatagtactctaacatgtttgtttctaccaatcaccctttacacacgcctctcattttaccatgattttttgtggcctttcaggaatcacagactgaattttgtattcctcaatttagacggtcctaaacatgctctcatatattgatgaaaagccatcaagccattatcctaggtggtacaatgaactagatagatacttaaatttagattataccctgttttatggtaccatatggctccagctagactatcaacctcttttgaaagtgagttatgcattttaactacccctcctcagcccacccaacctggttttcaattatttcagatgttgagggagtacttcttgagagctttgcagttcaggtcttaagcagaattgtagggtgcgtttgaaatttgaataacatatttatctctgaccttgctgtggcaaatccactgctactatgtatgctaggtagtttttatattcatcatctatagcatgttttaaggtttcggaacctagattctattagaggaataggagtgatattttttcataagccaaactttcaaacaaaactaaacaaagcattgtctatagtaacttcgcatacaccagtgaaggcacagaagatgacctagaagggacctttgcgaaagcctcccaaaaacttcattgggcctatttttcctattaagaaaaagaagaaagggaaataagcaacaaaatgatattaaggaagaaggcaggcaaaattcctatggggctcttttttgactgttcttgagcccccagtggtgtttcctttcttcactttatctgctggaatgtatttgtaatgagcaaaaataatttaagtacacaggtctattttctatgaagttaatacttcttagtgagatatatttcactttttaagagtgattgacttaagaatttattccccactgttttctccaatagaagaagctctttaagatatataaaggaaaaaagctaagtacaaactaggtctaagttcacattagaggaaggaagagaaagtggctaaacagatggacatgatacaatatccagggcatgcagggaggatttctagctggtggtttcttacagggctcaggactgggcctatgctaacagactcactttttattaaatactctcaaatattgttaattgttattttgtttttcatatgtgatattttcctaataatttttaaagttggagtttaaaatgcttttagagagatgaactcttttaaaacaaggtatctccaggtcagctttcatatacactttaggctcagcagtaggtgcttggtggtgctgcctgaatgatggacttttggtctgtgtattgctattattgattacttcagatggtcgataggtgtttgtgtttgacatagacagaataaatgggcactgctatatgatggatgagtatcacagcgtctggaagggctctgccttcacataactcttttaggaagggctaacaccagtgtgttctgatattgcttttgttctctgagtaggtgaatctgtgcacagagataacaagcccttttgaattacagggccactagggtacaaatgctagccagccttccagattattttcataactaaaaatgggctgcaaaccagcttcatccaatttcggggattggatgaaaccaaattagatctactgtgcatcagacagaggttgtgctggcaaacagcagacatataaatgtgaccatgtttcctaaaagaggcatgggggacagtggtatttctgagtgaatttataactgatgacgtaaatggcaagtacatacatactggataaatttgaaatcttcagtacaaaggaagcaaaagaaacaggaaggaaaggaagccatctttgttctaaagcctgaggagcagtgtgatcttgtagaaagaacctaggcctttgggtgtgagctccccattcttcttcttcctcttccatttactagctgtttgtcctcatacaatgaacttcacttcctgacccttgtctgtatcatgaacataagagaactgtcttagtctctttgagttgccataacaaaataccataagctgggtaaattataaacaatggaaacttacttctcatagttctggaggctgggaaggccctggcatatttggtatctgatgagggccctctttctcacacaaaaaaattaataaataaaaaatatcttcttgcagagtctacacatggtagaaggggaaaactctatctcctcaactccttacaagggcattgatatggtttggctgtgtgtccccacccaaatctcatgtcgaattgtaatccccagtgtgagaggaggggcctggcaggaggtgattggatcatgggtggatttcccccttgatgtttgcatgatagtgagtgaattctcccaaaatctggttgtttaaaagtgtgcagcacctcgcccttctctgtctcttcctcctgctctagtcacgtaaaacgtgcctgcttccccttcatgttcctccatgattgtgaattttctgaggtctccccagccatgtttcctgtacagcctgtggaacagtgagccaattaaacctctttataaattacccagtttcaggtatttctttatagcagtgtgagaatggactaatacagacattaatcccattcctgaggactccaccttcatggcttaatcgcctctcaaaggccaaatctcctaataccatcacattggggattaggttttagcctgtgaattctggggggacataaacattcagaccacaggaagtgcctaacttattaggatcattgtgatgattgaagataatacatagaaagagagtttttagcagacagagcctggcatatagtaaactccaataaataagaagaatttgctgttcttgttggcagagatgcagcagccactgtcctgagctggctttctcttcatcatccccatcatccctggtagactggcttgctcctgtgaatggacagctccattcaactaatggcttcctgggactacttctttcatgtctgtaacgttaagctttagcactcctactgcatccttacccagggaaaattacaccaaatagatctagctttgatctgttttcaattttgactgaattatgaacaataatacatgattttaaagtatagccagagactccaggctacaaaaattcaaaatctttttagtctttttagatcttgaaagtagatgattaaccattgtcagctctatattgacttgggctttcttggctattgaacttctggctccaattcacacctctattctccctttaaacctgtataatatatttttttgtaatgccttaatttcagaagtacatatttatgcattggttttgttattttatcaaaattatgatatttgatatcataaatcctaaaagctgcttttagcatagtgattacaaagcatcctatgaccaacaaagggactactaaaggattaattatacctttctttactgcttagggctttcttcccccagaatgccattgctgtgaaataccatgctaataaggcctctggcagaacagaaatccaaagaactcttcctattccatgaccatgctgcataacaaaccacttaagaattcagcggcttagagcaattgtttatttttgctcaaatgctcatggattgatcaaggttggctgactcaagctcagccatcaactacaggttaggtccagagttgctccacatatttttcatcccccttggaccagcaggctaatcagggcatgctcttctctggtcatggtagaaagataagaagggccaatggaaacctgtgctgcctcctaagtcatatgcttgtaactgcccccttttacttccagccccattccattgaccaatcaagtcaaacctccatggagggattgcaaagtcctatggcagagggtttagttatgggaatggttaaagaatcaagatcagtaataaactgaccacatctagctttaccattaaccatcaagggactttgagcagtctccaagcctcagattctcaatgattacattcattcgtgcatgcaaccaatatttttaccacctactcaatgccaggcattgtcctaggtaatgagaatacagcattgaacaaaataaaaacccttgctcacatggatcacatattccagtcagagagatagacagtaaataatgtgtgtgtacatgcatgcatgagtatataatatgtcagagagtgaaaatgcgataaggaaaaattaagacaagcgaaataattcacctttccctgccctagagcttgccactgttaacagtttggtgcttgtgtttgaggggatgaatagtggagcctgaccactgggatttgaatccctgttcttccttttaatagttttgcaatcttggacatgcctattatttttccatggttgcatgacaaattaccacaaacttagtggcttaaagcaacatacctttattttgtcacagtttctatgggtcaggtgccaggcatagcttagccaagtcctggaatcaggatcttacaaggctacagcgtgggtgttggctggactgctttcctttctagaacttggaatcctctttcaatctcatgcagttgttggtagaattcaatctcttatgaccatagaactgatgtccctaatttctcactgtcagctacaggctgttctcagctcctggaagtgccgtagtttcttgccacatgattccctagaaggctttctcatacagcacggcaacttgctccttcaaagccagtaaaagattttctctctctagtctactaagtctcctatgacagtgccttatataacataatgcaatcatgggagtgactctgccatcaccattgccatatactatcaactagaagcaacatcacagtttctgcctgcattcagtgggaggggtttgtacaagggcatgactaatggatgctcatcttagagttctgtcttcacaacatgggacttaacctctgtgtcccagttttctcctcagtaaaatgggagtagtaataatatctacctgataggatggctttgaggattaaagaattattagttagaagtaaagcacttaggacaatgcctgctgcatagaaatttctatatatgatagctgtttttattatctacaaaatgtgaggattttgtgagatgatttttaagatcccttccagctccaacattatggttttgttgccacacactgtgatacaaaaatgaacaagtacaagaaatctactgactagagagatagaaaaagcataatatagagacatgttgaaattaacctaaatagattttgcattacaaagaagcaagattcattcctcttttattttgccatcagtggaccctccataagttcttcctgatttgaaattttgtggaacaccttgtcaagggatccctttgggggcctgaattcctccaagtaaatatttctttgtaagaaactttcattggtcaccatactccctcctaaattaattgaagcctgtgactcttaaatatactgttgaatgatgccattggattgtaatataacagtttgaatataggtgccagtgctatgtttagtatatgaaagtgtgagtagattttaaccaaatatttttaaacatgaataactaggacagttcagcccctaaatgccctcttagacccacagaagcccacaaagagggggcctgacagtcatctctccaagatggctgaggaaacaggatgggtccagtcttgctgttatggctacctgtgctgagagctgctggtgaaagctgttcctcctccaccaggcaggaaagtgccagaggctgagggactgtgtgtagaatcacttccattccctgtctctttgggtgatatattctgtctggggcagtgaggagccaagaggcagcttcagtagttgtataattcatactctgtgtctttatgttctcttcgtaaaggctcatcatttagagtagggtttctcagctactgacaatagtttctcactattgaccttttgagctggtcctgtgcgttgtaggatatttaacagcagccctggtttctatcaactaaatgccagtggcattcttctccaaaaatgcctacagaaattgtcaaatatcttcagtatattttacgtatttatttacttgcttatttctcatgcattttttaagtaagggaaatgtgcatgattttaataaatccaaacaatacagtaccaaagagtaatagtaaaaaatatttatcttatgccattactccagcaaaatgttctcccttttaaaggcaaacacgttaccattgttaaggctacaggagatctccagagattgcactgaatttcatgtaaatgcagttatgggcatatacttataatacatgcagctgtgtattacatttttattagcagctttttttttcatttgtgttcaagatgacaagaaaatgaccagaatgaatctgctttagtttgtttccattgtattgtttaaaagctcattagatctttctgagctgatatgctgcatgtaagaagaattatttcctgcccactaggaagctatgtccttttaacttattccctcagcctctggagcttctcactatggtctctttaaagactgatgccgtatggctagaagaaaaaactctttgggcttcaatatttcaagcctttgaagtatatattttttttttttcgtctaatgaaacaactgaatcctttgaaagtactaacaactatttttttgttgggaacatgtgaaacttggtgtttcttgatttcctcatgctactgagaatgtccaccatgatgatgtatttttcatattatagcactaccttattccacagtggaacatgatgttcatgtcaagacttgtccattaatcagtacacaatttactgtttttcataataaatgcattactgttcctgctgctctgtaaatgtgttttctgtatcctagtaccataaaccctaagtttggtttttgttggtgatgggatggtggtgttcttgattttcatgtcttctatgatatgttatcactcggaagatttttcaaagagacaatttctactgttgacaagatgaaataagtacttctcaatactcttaatgggattataagttgatataatgattctacagaatagattactaagaatttttaaataccatttggctcagacactagacttctcagagttgctaaatactcactaaatgtaaagatttctgaggagttcaattatagggaatagatagacaaattattttaattattaccactactattgttgtcattaggggacaaagtactatgctaagcatttttatgcattatttcatgaactctcacaatgttgggaaacaggtgttatcattatcccatattccataaaaggaaagtggttttttgttttgttgttttgttttgtttcattttatttttgagatggagtctcacctgtcacccaggctgaagtgcagagtgcaatggctcgatcttagctcacggcaacctccgcctcctgggttcaggcaattctcctgcctcagcctcccaagtagctgggattataggtgcacgccaacatgtctggcaaatttttgtatttttagtggagacggggtttcaccatgttggccaggctggtcttgaactcctgacctcaaatgatctgcccacctcggcctcccaaagtgctgggattacaggcatgagccatcatacccagccagaaagcgtatcttaaagaagctaagcaacccatccaaaatgatgatgatgatgatgatgatgatgatgatgatgatgataatgatgtcagctgatatttactgagtgccactatatgttataatggtatttttagtacttttcatgtattaccttatttaatctttttaccaagaatccagtgaggtaggtagtctttgttatacctgttttatcaaagaggaaactgactcacggggaagttaactaactagaataaaagagtttaaattactgggttcaaaatatttaagttggatgctgggcacagtggctcatgcctgtaatcccagcactttggaaggctaaggcaggcatatcatcgaggccaggagttcaagaccagcctggccaacatagagaaaccccatctctaccaaaatacaaaacttagctgggtgttgtggcacacgcctgtagtcccagctactcaggaggctgaggcaggagaatcacttgaacctgggaggcagaggtggcagtgagccgagattgtgccactgcactccagcctgggttatagagtgagactctgtctcaaaaataaataactaaacaagttgggacttgaatgcagatagattgatttcggcagccgcactctaatcgtagtgcctttccatgatcatgtgactggtaagtaagtggcagacctggacccaaacctaggtctggtagactttctcttaaccactgagcagtatagctaattagttcagctaagtctatttgataggttgtctttagtatgtgatgtgattatttaccctcttcagagctactcccatgaacactccttataccccactaatagttttctgctagtgattgattcccttactccaaatgcgatccagccagttctcaaatgcaaatactgttgaataattttgaagtaatttaggaatcaaggatataagtcttttggtgtttgctcaactgctttgagacacaggcatcaactgaaatgaaggaggccttgttaagaagtgggagggtctgtgtaattttgaagtgtttgtttctaatctagtaacagcttttcatggcatacattaataaaagattcaaattctgttttatattatgaatgcaccataacaaaactggattgctttgcactatactgcggttgtacctggcactttgttcttctgacctcctaagtctaaaatcagccacagatgagcctgttaaggtagagaagggtttctgccaagggattgtccaaagattgtccaaagaagtgtacatattaaaaggcatcttggggaaacctagctattccattcaagcaggaggtagtttaaggcctactcagtgagtaatttagtaaagaacagtgagttttatgacttaaatctcatgaaatgacattaatgtaagcatggttcatggaatgagaaagtgatgaaaatgatgttgattgttcttggactcaagtgtggtactttaatgtattataggtggccttgatcatatggttgctgccttcttctgacaaagctagcaggagaaagaaagacacaagtggctctgtttgggcattacagtgtagcctggaaatgctacattattgaggatgatcttttgaaagtgagaatctgaggcaactgcctgtgcactgcctgtgcctgtctctagagcagtatgggaaaaaaagagtagcagtgaaggttttcttcctttttcagtttaattttgtatattctaaaagaatgagtccccaggtctcaggcaggagttgcattgttgccagtcctaatattttatctttcaaaaatgcccactcactgtcaatgtcttttcctcaacctgttgtgctgtaagcctattttattgataagaaagagccagacaaaattggctgaaaattaaaaatctaggtgacatattttagaggactaagttacctttttttttttagtgaacataatcattagaagactttgcaccttggttgggctgtccctttgctcctctttgttgacaggcagtcttctaaggctgtcctttctccctgtaacctgtcagcagaatagaggcatagtggggagacaatgagaagagctgccttcttgagagatcagaggaagagtagaacagaggcacagcggagagacaatgaggagagctgccttcttgagagatcagaggaagagcaactgctgacaatttcagctgtgtaaggaggccatgccgtgtctactgtctagattcctaacttttgggaaactttatcctttactgaaaacaataaaccatcttggcaatgttttgtgatgtgttgataatccagagtgaaaacaactcttaaagtaatcacaagacaggatagtcttatagaagtaagatggaaaataggaagagatactcactgttagcccaacctctgatgtgttagagtatctttgatcttcattctgtctttcatatgagggtaaaattctccatcaaaggtcaacatatgtgtttaaattaattttctaatataatcttaagggaagatcactagagtccagagaccatcgtctctcccctccctcaccagtcaccattagctgcgtgaccttcggcaagttatgcaatctgtttcacacaccatttatatatgtctgcgtaaatcagtgcttcccacttagggtttattgttcattatatcacatttcatagtcatatatggtgaggccccctcctcctaactcctctgaccattataaattccctgcccaaactattatgaccattataaattctctgtctaaactatcatgatgctggataaattaaaacgtcatgtgtttcttgctggagctcctctagaacatgttcccctctttgtttccttggtacacttaggcaaaagatctcttaggctgcctactgctaccctttcctgcgtaactgtggagataacagtatcagtgttcaaaaaccactgattaaagggtggggaagaattagatgtatatctacttcagcattagtctcttagctgattcatgtataacccacaatacgtaactgttataatttctagatactggaaaataatgggccaaatatatgactgatgtagaaatacattaaagtataacatgtagttaaccaggtaactcacaacaatctaagctggtgctgaggaagctaaattaacatcagtttacaatttgaaccaaaactaacagcaactgagagttgcaaccaactgattgtaatactgacaattaccccatatctcagtgtcatccagagaactgcagacatccactctcgtcgtgtgccagtgttgttaggagtgccccaaagtttcaggacttgcttggcagccatacttcctcggaagatgcctcattttcaactctatgtaatttactaattttagattatgcataccacgttttagtattgggattccaaatactgattcttgacccacaagcttttaggaataagtagcccatttgtaggtgaaagtctgtactattgtatgtcagttgccaaaagagcattggatggggaatgggagctgattctttttttgttgctgttgttgtttttcaatagctttaggggtacaagtggtttttggttacatggataaattgtatagtggtgaagtctgggctttagtggtgaaatctgggcctctcctctcccctcccctcccctcccctcccctcccctcccctccccttccctctcctctcctctcctctcccctcccctcccctcccctctcccctcccctcccctcccctcccctcccctctcctctcctctcctctcccctcccctgccctcccctcccctcccctccgctcccctccgctccactcccctccgctcccttctcccctttcccctctcccctgtcacccgaatagtgtgcagtgtatccaataggtgatttttttttatccctcaaccctctctcatccttcctgcttctgagtctccagtgtccattataccattcttatgcttttgcatacctatagcttagctcccacttataaatgagaacatgtggtatttggttttctgttcctgagttactgctcttaggataatggcctccagttccatccaagttgctgcactgcaagacattattttattctttgtatggctcagtattccacgacagacacacacacacaaacacacatacacacacacacaccccccacattttctttttctgctcatctgttgagcacttaggttgattctgtatttttccatatattgcatattgcatagtcctacaattaatgtgggagtgcaggtatcttttttatatgatttattttcctttgggtagctacctactagtagaattactggatcgaatggtagatgtacttttagttccttaagaaatctctatactgtattccatagagattttacaaatttgcattcccactaacagtgtataagtgttcccttttcaccccattcacgccaacacctattttttgacttttttaaaatggccattttcactgggataaagtagtatatatcattgggttttaatttgcatttccctgatgattacttatgttgagcattttttcatatgtttgttggtcatttgcatatcttcttttgagaaatgtctattcatgttgtttgtccacttttaatgggattatttgtttttgtttttgtttttgttttttgctggctgtcttgttggagtttcttacagattctggatattagtcctttgttggatgtatagtttatgactattttctcccattccgtaggttgtctctttaattctattgattattaatattattattgttgctatgcagaagatttttagtttaattaagtctcatttatttatttttatttttgtcacatttgcttttagggtcttagtcataaattctttgcctaggccaatgtccagaagagtttttcctaagctttcttagagaatttttatggtttctggtcttacatttacattcaagtctttaattcatcttgaattgacttttgtatatggtgatagataggggtccagttttgttcctctgaatatggctctaaattttccacttttatacttttggttactatgaccttgttgtataatttgaagtcagataatgtggtgcctccagctttggtcctttttctcttaggattggtttgactatttccgtcttttttggtttcatatgaattgtaggattattttttctaattctatgaaaaatgatattgatcatttgataggaattgcattgactctatggattgctttgggcagtgtggtcattttcacaatattgatgctttcagtccatgagcatggaatggttttcatttgtttgtatcatttctgtttttttttttaatcggtgttttatagttctccctgtagaaaattttcatctccttggttaagtgtgttcctgaatgggcttccttctctctcctctcctctcctctcctctcctctcctctcctccgctccccactctcctctcccctctccccttccccttctgtttcctgcagctattataaatgggagtgagttcttgatttgattttcagcttggtcattattggtgtgtagcagtgctactgatttgtgtacattgatttttgtaacctgagactttgattttgtaactgaattcatttatcaaatctaggaatcttttcaaaaagtctttagagttttcaaggtacaagaccatatcattgacaaaaaaacatagtttgacttcctcttttctaatttgaatgccctttatttctttctcttgcctgattgctctggctaggatttccagggcagtctgttcttaaccagaagtaggcttgtagggccttgtggccccagagagtatgatgaggatcaccctttatcaggacctatatttttccatacttgtatcctagcttttcctaggcaaaaataagctctcaataacttttgaaaataaatggatacatatgtaatagtatacacatattaaaattttaattgtatatatctaaatgctatatatacagttgcaaaaactataacaaaatattgcaaatgtagtacatttttatagaactattttgacccaaatttttaaatagatttcctaacgttaaacttaccagaggtttagttgtaactcacacattcctgcatacctcattcaaagccctaaaaatagcagcgtctttttttagaacaggtaaatgtatgcattttctttcagtatacaggctctgacctacatattcccaatataggaccagtccttagagagcaatagttactgtgggcatagcacccagaggctccatcctgctctccctcccaaccactgcagacacaaaaacacagaggaggtggcacctcctttcagtattctccacctcttccaagagccccatattctgcctctcaaatgccccatcctaagtgcaagtaggtgcccctgtgaaagaggaggtaagactgtgaagaagagaaagaaaatgcaagcctgtcacctggtagaggcaccctgcggctgcctcctgaccccaccttgctgttgatccccactgaccagtgctaaaaatgcagaggaaactattcactttttgaccatccctcactccttccactagagttcttgtcacttcttctaagtcaccgttccctttcagttcttggcctcagagtctccctcccagtatctccctgggcctagaagcctcaggccagcctgttccctcccttggctggagttgctgcctctggctaaggctaggtgagacttcaggaaaagaaaacaggagccttgtcctgctgcctggtctgcttctataggagtgctgtgatttccctggtgggtgcattttcatcaggaaggctgttgtaccagaatggtttggctctgtcgtcctttttggtttattatgaattaagcagccttctgtgcatcagccagtggactaaccaccatgtagagaattgtttcttcggggaaatatattgtgagtctcaaacagctctgaatctgttggaacacaactccattttaggtgccaatattttgtttttgcactgtggaattttatagtggtaaagggacaataagatgattgctgctaggctttacttgctatttttgcatgatgtgattttcctttctgtatcatgagcagaaacccataaacaatgcaaatgctcatcagtaggcaagcagatgaataatattccctttcgataatcgtcatacaggagtttggacgaatcttagcaatgtaatgttaagtgaaaaaaaaatcccaaaatattagatacagcattatatcttgtatgtaaaatttaaaataattaatattattttataattgttataaggacaacaaagttacctaaaaaagaaatgtagagaataatgaacatgattcaggatggagcttacttcacttgggggaggtcaggagattgcatggggccttagccaaacgattagatgtggattgttgttaaatgacgtagtgagttcatgggtccttattaagttaattaaaataaaattccctgcatcaggttcaaagcaagaaaaaaataacaaacatgttcttttctccttagttaaggataaacactgttacattttccaggatgaaataagaataaatcacaaacttggttttcataggaaatatccatatgggaatgtcgctccttgactttgaaaccaaacaaagtatgtccagtaggtcagcagaagcacagcagcacctgctgggagaaaaggagtcatttagctagtgaggtcacccagttgagcactcaccttccgtctgtcagtctttgccggccttgcatacataagcctctctttgtgagtcaatcgagatgaattaacagtcctattagtagtcttttaccagacagcagggggaagggcacctcataaagggtcatacatccaggttgcatcctggttctgttcttctcttccagggcacctaggcagggtcccctcttagctttcattattatgtcctatttcgttgggttgatgcacactcataaaataataggtgtaaaattgcaaatagtaaaccagcttatgagaagttgttattcctgtaactagacatatttccccagatttttctgtttacttcatataccttatatgtataaactatccttgttgagtatcatttacaaataatatcttgtaaatggtaattttactctgtagtaggttaaataatggatacccaaagatagtaagtccttacacctggaacctataatccaaccttatttggaaaaatgggtctttgcaggtgggattaagttgagggtcgtgaaatggggtaattatcgttgagtatccaggtaagccataagttcagtcattgatgttcttataaaagagaggcagaaggagatttgacacagaagagaaagcagtgtgaagagggaggcagaaattggagtgatgcatccacaagccaagtaatgccagcacccaccagaagctggaggaggcaagaaactgcttctcccctaaaccccccagaggggacaaggccctactaacatcttagtttcagcccattgaaaacaagtttggcttcaggctccagaactgtgagagagcacatttctcgttttaagccaccaagtttgtgttgttacagcagtcacgggaaatcaatacattcatattaacatatttttgaagataatataattttctaaaacacaattgaggatgtcaagcttttgaagtgttctgaatcaattcaataactttgtcgtatttaattttgatgtaactgaaatgaatatttaaattaaaattttaaagcactacatttttcagggtaaaggttgacaatcagcacacattacagaacaacaagatggtgagcaatttgggcatgcctatgtatcattttgacatacgcgtgaggattttcattggcctcaagtttgcagctgaagtaaaagcatcgtggatgaattgagcatttttattattatgtcctgccagcttccagaaatgattcaaaacctcttggagctacctaatctataaggctgttaaaggtagaagagcaggtgcctagaggtgagctgtgacttgcagagtgccaagccagttttccatgcagtctttatcatcagtggtagctcctgacaccacagaacttgaaattgccctcaacccttcctttacaaatgctattttaaagaataatcttacataggcactccagatgaaggtggacctgtgaccataacttcctctcctctattcgtgctttttaggtcgaaaagtccaattagaatgcatcttttaaagcagtacttctcaaacttcagtatgcttgtaaaccacctggggttcttcatgagctgtagattctgattcagcagggagtgggacctgagcttctgcaggtggtggtgatgctgctagttcatggaccacactttgagcagcagggctgtagcatctagtgctcctgcttacaggtttctccctgtttttccctattttgaggcacagtttcaggcagtcaggctggttctgctgcatttgcttggcaacatcacctccctccagcctctgcagcttccacccttgggctgctgcacgtgcacgtacatttccactgctgtggctcccacagtgcacagttggggactgagtctgaagctgtgtcacaataacatcactcagtctgaaaagagagaaaagttgttgagatgagagtgaaatccataagggaatcagggtttagagagacagggaatataaaaacagtaggagaacagggagagggaaaagcatgaaaatttagttggggaaaaacatttgaaatgtgctactttcactgcagaattttccaggcactaagagcattttctggagtaattttagatttatttatttgttatcctcgactttctttagcagccacctgcttgttgtgttcattcatccaccaatcttttgtgaccttctgtatacaggctgaaaactttttttaaaaaaatctctgaactgtataactaagtgctgcagcctctgagagactgtctagttaaattgggccagacagtggtcccaaccgggctgatgttagaatcactgaggaggtttagaaaattctgcatatcttgctgcaccttggaccagttaaataggaatttaggggataggtcacagtcattcgcacttttttctttttctttttttttaatcagtattttaaaatattccttagatgattcctgtgtccagccaagcaccactaaatgagacagtaaccttctagcaggtgaattgaactcattttttaaaaacccctaagagctgtttttctgtgtgtgtgttgcttcctatataaacctttgcaatgttgaaaactctacataatattttggaaacaccctctccttcaatccatcacctgcagccaagcagctgattaaatattgaagctgctttctgaagccctggcagcttttcattttctcagtccagtggctccccctgctgtctttaccaggtagagttcacttctctacagaacctcactacagattctgctgctccgcaaaacacaacccagaatcatagtattttaaggaagattttctaatcccacatcaagcctgtatgttactgccaaaaatgaacattcagaatactctaatctcttacctagtggtagtttaggtaaggcctagggaatgatggaagaaaggaactatatatatgtaaatagataaactcacacctgtgtacacacacacacacatacacatacacacacacacacacacacacacacacacacattgatagcttatctggctaccagaaaaatattctgttagccatgtgattgtgctggttccctgcaaaataattagcattgacactgtagaaagtggggaaggaaagctttcatgactaacttctctgccctccttcatctaattatacccttccttatcaacccacttctccctgtctaccctctaagctgtaattgcagccacataaaaacaaaagtaaatatatgggcatctgtgtgacctcatcttgtcacccagactctgttgtatattacctcaggattaaactagtgcactgtgtctatggaggcagaatttgatccttattttgtctgaatgcaaaatgcaaccttaattctgcctaaacctcataaaggtgctgattccattttacacagcttttatcgttagaatgcccttctttgctgtatatcaatatctttaccccattggtccttgttgtcatgtggctccgcataagtcagtctcccattcacaatgtagcacttaatctattcaaagcgatatcccaaaacatttttttctcaacagcatttccagtcagcccaatgggacatggggcacacccctccccccacccccaacctttctgaatacactccacagaggaccgtttatttttgtcccttgtcacatgtagcatctggtactggcacagcaatccagatgtgttctgactagtatatcatatgattaaatgattacatctgtatgaattgtttattgctgcataacattaacaaaaatgtagtgactaaggcacatttatcatctctcagtttctgtgggttgggattcctggcatgacttagctaggccctctgcttcatggtctttttttttttttttttttttgagacggagtctcgctctgtcgcccaggccggactgcggactgcagtggcgcaatctcggctcactgcaagctctgcttcccgggttcacgccattctcctgcctcagcctcccgagtagctgggactacaggcgcctgccaccgcacccggctaattttttgtatttttagtagagacggggtttcaccttgttagccaggatggtctcgatctcctgacctcgtgatccacccgcctcggcctcccaaagtgctgggattataggcgtgagccactgcgcccagctgcttcatggtcttaaaaggctgtaatcaaggtatcagctggggcagcagtctgacatgagggtcggctggagctcatgtggttcttggcaacactcagtttcttgcaggctgtggaactaaggactcaggttcttgctggctgttggctgaagccacccccagttccttgccttcaggccttcccaacgtggctgcttgcttcctcaaagccagcaagggagcaagtccactagcacaatggctgttatcattgtacacaatatacagttgacctgtgaacaacacaactttggaattcacaagtccacttagatgtggattttttttcaattaaagttataccaaatgtgcctgtctctcctgcctccccttctgtcacctccatgtcttccacatctgccccccttgagatagcaggaccaagccctcttcctcctcctcagcctactcaacatgaagataaagatgaagacctttatgtttcacttccacttaataattagtaactacatttttcttcctcttgattttcctaatattctttttttctagcttactttattgtaaggatatagtatataataaatataacatatatatagttggtaagacttctgttcaacagtaggctattagtagttaagttttgggagagccaagagttttatgggaatttttgactgtgcatggggttggtgccccaacccctgcattgttcaagggccagttgtaatctcagaagtgatatctcatcacttttgccatattctgttggttagaagttcctgctcccacccacactgaaggcgaaggttgtgaacagcaggaggtgggaatcacaggggtgagcttagagtcaaccctcctaatctcttttgacttctagtaggtgatcttatagaagtttttattcagctaaaaaccacaagtctttttttatgcagcttgctgcatgccacctgttcccatcttgaacgatcaattaatagaatctaagtactggactttatgtttatagctatcacattttcctggtgttaggttcagccagttgttcatgccttattaaatatttttgaatcctggttcagccatcagaatactacacatcccttctatttcacgtcatctgaaaaatgtaagacatcccttctgtcttccttcaagtaactgataaaaatcctgaagaggatgatacctaacattatacagaatatacatgtacacctgcatcacatgtcttatagacatacacgtatgtatgtgcatgtgtatgtgtgcgcgcgcatgtgtgtgttgaatgtgagggagagagagcatgaaaaaaacctcattctgatactcaaaacctccttctagggtgtggtcaggtggatatgaattgtttaacaacatctgagccacatttctcagccagcttctcctagaagcagatagtatagctcttcaaagcatggtctctctagtcacaccaacctgatacaggattccagctgccccactttctagctgtgcaaccttgaacaaccagtttgtcagtaaactggttataaacctgatattgcacacatgatatcaataaaggatagcttattttcttgatgcctggctaaaatcgacatatgctggaagagcaaaggttactgcccagacgctcttctctgaattcaggatgttgacaagttttgtttgacccatcttatttagtttttgttttaaatttgaattaagtaattttttgtagaaatttgaattaggtcataggattaaggtactttcacaggaaatccaggtattctccagttcccttagtgaaatgaaagctacagcaatactggggtcctgcactgtgcatggcagcctctggcagaagctgagcagtcgctgctctctgtggacagggccttgtcacattcagtcctgccttctttctccccagccctctccctcagtcacctgcctgactgcttctagaagaattttaatttgcattaccattctgctccaggaaggtagagtaaggtaggaggaaaagcagaaatcttgaaactgaagacgactctcttctactttttaaaaaggttagtttaacatgactttttatttaatgaagtcatgataatttgtcatttacaaggatccttcaggtctatatagttaattaaacaaatatgtaaggagtgcctactttatgtactttgataaaaggaatataaagtaaacaaaaattttaaaaaagacatgacctctttacttattaacacttagagtccaatgaaagaaatagacgtttatcaaattttcacagaaataaatgtaaagtttcaactgtgacaatttttactaagaagcctacagtgctataatggtatattatggtgattgtgccccaatatgcaggggcttgtcctgagaaaaggatgtttcaactcagagatgaaaaatgaatcaggaactaatcaggtggaatgggcacagatgtccaggctttggaaatacacgtgtaaaggccttgtatccacacctaaatctcatcttgaattgtaactcccacaattcccacgtgtcatgggaggaacccagtgggaggtgatggaattatgggggtgggtaatatttctcgtaatagtgaatgagtcccatgacatctgatggtttaaaaaatgggagtttccctacacaagctctctctttgccggccaccatccatataagatgttacttgctcctccttgccttccgccatgattgtgagacctccccagccatgtggaactgtaagtccattaaacctctttttctttccagtcttgggtatgtatttattagcagcatgaaaatggactaatacaggggtgttcccagaagacaacaccagatcacttagagttggcacacacacatgcatacctctgtatctttacacacactctcttctgtctggagtgtccttctcctactcatttgcttgacaagcgcccagtcacttttgaagtctcagttttaaggcttcattttcttcaagctgtcccttcacctcttttcctgggcccccaccgcgctcattacacccctcattgagcagccttgtcatgctgactttctgtttcacatgcttgtctctttgtctctctctccagactgagcaactccaaggcagacactttttaaaaaaatcgtttatcttctacacataggaaaggggtggtcatgttgtcatcactcagtacatttctgtttattacatggatgggaaaacataattaacagttgaacaacatgtatatagtataaaatgaaaaagatacataaggatggccagtgaaaaacgtgggtcccctccacctctgatttccagccacccattcccctttccagagaccactgctgttactagtttatttgtttgtttattttttagggatatcctttgcctactctagaagttatctacatagagaaaatgaatatttgattcaagtatgcaattggcattttttaagatttccatgccaaaatttgctctctttggtcatttccatctgtccttggccactcttataatttcctcttacttgcatctttccccttccccttaatatactccatcctttcaacctctgctttttctatcactgtaccctcctcttaaaaaatttccttcttggccgggtgcggtggctcacacccgtagtcctagaactttgggagactgaggcaggtggatcacttgagcccaggagtacaaacctgggcaacacagtgggaccccatctctataaaaaataaaaaatttagtagaatagggtggagtgtgcctgtcatcccagctactcgagaggctgagatgggaggatcacttgagcctgggagattgaggctgcagtgagccatggtcacaccactgttcagcctggacaacagaatgaaatcctatctcgaaaaataaaacaattccttctcaccatcacccatgaggccactggatcctgaaacctttctcctcgccttccacctgccctgtctgcagcacattcgttgtactgtcgggggcagtgcaagctccaggtggctcctctgcatttccacctgattatcgtttttccaggtggagagtgcacagtcaggatcagaattaggcggttctgctttctctctctggctcttctgggaacttcataccatctgttccagagcagggtgtataatattgcagctgagttctgctgagccacttcacaggtttcttttaggacttctcactaaggagctagaaaaaaatcttccagatccgaaagtagtacagctgtgaagcaatcattattttagagatgttatatgtgtggactttcagagttgcagcttaaaaataatcagttattaggttgttctgaagtcccttagaatccacagctgagtccatttaaaatccacatcgccactgtagtcctgcccctaaaacttaaagccttgaagtgggaatctggtgcttcccatatcatttcattaggacacaacttgtgtgagccagttttgtgtcccataggccagaattcctctgtgctgtagtctttgttagagacctctcggtccccttgacccaggaagaaccgttagcaggtcttgttgtacttaaatcacaggtgttcagggaaaagcccatggactcctgttgagcagctctgaggcctgtgcaaaagcaaagactagaaagtgagagaattggtggaactagtgatagtttagaaagataagtaaatatttctgacaaacactagtttgttagagttactctgagctctagaagtttagaatttgcttttctcctgttatttggagtagatattttcacagcgaggccctctttttctcagtatcttctctgcccgacagaggctgacataacgggcagaacctgggccacacctgccagggcagaggcacacctggaggagtgagtatggggccatcattacctcttagttcctcagggtcaggggtgtagacctccacggataagatgagcttgtccttttttttttttttttaacagatgttaaatagtctaagaaatcacagaaaagacttctggcaactgtatatttctgaacagagggacgtgagaccattttgtagcttgcattttggcatttgctatttgttaccatatgtgtgctgaagagttccaaatgtttttctccctctgaaattcctctcccaagattcagacctgtatttccagctgcccaatcttgacctgcaggcatttctaacatttaatagatccagaatgaaactcattgccctcagcccccaaacttgctttatgtctggcattcttgatttcagctaataacttcttccctatataagtggattttaaacagcagaatatacattttacatcatgactcactatgcacacacacaaagatgtaacttgaacaacagtttcataaaacaatatgtatctttacatttatgttgccctctgatatcttctcttgaattccatcttttgaaaagtgccgatgtcaactcccttgatgaattttacttacaatcccccaaccagtcatgtgacttgcaatttgtgaaaaccttaaacagatataaaatgcagtctccttgaattcagcgtctggcctctgcttccttcccatcctgtagcccaacctgcagtctagccacagtgttatccagacacaccattcattcattcagtcagtcaacatttactgggtgcatatctggtgccgggcacatggtgcactaagtatccagagatcaacatcatccactctgaggaccacaatgcgtagacagatgagtaatctagcaattaccgggtagtggttaggttctaaatagaagtttgcataaagcactcagacatcacaaaaaggtagcatgtaacttggaccagagagtccagaaggtctttcaggaaaaagtgacccttgtactgaagctacaaatagaggtaggagttcagctggcaaaattagggcagagcgttagggaagagaattcactatgagaagacacgggggctgagcatcgtgttaatttggagagctgaaagtgttctgatataagcctctccttataaccgtatactctactgtcactcccaccctttctttacttggcaaaccatgactcagtgttccctctcccactaaaccaccctctcccggtagcatttctccctgcacccagggagactcaagcctcccttctttaggctctgacctcactctcccataccatcagctttgttttgttgaaggccattcatcaccacccctgttcatctgcatcactagaccaggagcacttcaaggcagagtccaagtccttacatcttctgtgaggagtacaataagtgttagccaaataaagagctgaaccaataaaagaaacaggagatggacaagccacagacacaagtttagggtaaatctgcttaaatggatgtgtagaagacttttcagtatatcacagatggaaaggggcttcaagtgtcatgaacctgcttatttacagagctggggaccacattttaagtgttcgtggcacctcagttgcaattttctttttgtttcatttgcaaaagataatttttgacttttagaaaacattctttttcttctaacttaaatgtgtcttgttaatggaacttgttagtgaattaatagaaatgaaaatctggcatcagagaccatacatactctccttagtgcacaggtagccagtcattgctaatcatacattaaacccaaacaattttttccaaaatggcttttacaggaagcaaaattaatttttaattattcttttcctttgcccactttctgcccactttgccttttctgtgtaaatggttcagggttgtaagcaggacagtttgaggtctggaatctcaatagttaagcctataattgaaaaagaaaagtctaatgtatttgtttctttcctggtaatttttatggtatgaccataatatatcataatcactttgaaacagaacactggatatggatgaggataatgcctacaaaaaagttttgctaacgcaagcattgtagaaacagaggcagccaggaaaacaattgtactttattaggagcaagagaacagggctcagattctggctggacttttcattgtttataaaacttccatagggtctgttttcacatgtgacagattggctgtgttcaaattgtgcttttgagctgacatttcctccctttgttgctaaagtttagtactgttgaactcctttgtccttgatgcaaattttagtgagaacaaagtggagcatttccagattagctgtatgtgctgcctgcaaacttaattgtctcctcttgaaataatggttggaattattgaaaagaaagggagaaatgccttttgcagacactgttatcataatcgtttatgtcagagacaatgcttttgtctcttttctcatgttacaactcttcagccctcttgcctgcctccttccccttcgtcatccagcccatcaataatgtgacctagtttgtgtagatctatctattgatgttagtattaattagtgctggaaaaagtaaccaagtatgagtcttaaaagaatttttattttctcatttgttgatgctggattcatgtttcagccaggaacataaatacatgtatttaatcctgattcaccagagtaggaagcagggagtttggcacttactgtatatgtgccactctgacatcactgccatgtcacccactagtaaataaatgcatgaacaatttgagccctgtattaccttattgcctagtagtgcctacaaatcctcggataaagtgaatatgcttcatttcctctgttgacaaagagtcaaactctgtaaaatatttgaggagatttattctgagccaaatataagtgaccaatggcccatgacacagccctcaggagatcttgagaacatgtgcccaaggttgtcaggctgcagctgggttttatgcattttagcgaaacatgcgacatcaatcaatacatgtaagatgtatattggttcagtccagaaaggcaggacaactggacgtgggagcttctaggtcataggtggattcaaggattttctgattggcaattgcttggaagagttattacctaaagacctggaatcaatagaaaggaatgtctgggttaccaaaaggggttaccaaaagggtggagaccaaggctttatcatgcggatgaagcctccaggtagcaggcttcagagacaatagaatgtaaatgtttcttacatttacagacttacaaagtctgtcctatcagtcttaaggcctgtgttgatgtttctgctggtcagctgtgcctaaattccagaaaggaggcaggtataatgaggtatgtccagctccccttccccatcatggcctgagctggtttttcaggttaacttgagaatgcctttggctgagaggaggggtccgttcagatggttgaagggcttataattttatttttggtttacacctctcataatatctagtggtccttcttctcctctgctggtttccagctttatctcttgccctttctaacctgtttgtctatccatttatccaatatagttggaatgacaccatctggcactcccttgaacatacagtccctgtggaagaagtgggcagtctgaattttcccacatggctggagcctccctgatccgaacagacccagttttctgcgggttctttgagtaatacctaatactgacatagtgctatgtgccaggtagcgttctccacacaattgaggtagatgctgttaacaccctccagtttacagatgaggaaattggagctcagtggggttatttctcagcccaagcttacatggctggtaaataggggagcaaggatttgaactcaaggtgtcttcagagcctggcctcttaaccctgaatctcccctttctaggttcttaaccctgaaactctgttctcagtcagtgatttgccatgatcattgagtgtaagagccatagatcatggaacagaatgttccaatggaatgtgcccagttacatgtgagctgaaattgcccattagttcctttccccagatcaaacattgtagtgatagaaaaatagatggagaaagaaggtagacatatggatagaaaaaggaaaacatgtagaaagaacattattttggcaaaaggaaactgtaaatcacgtaattacagattttaactgtaatgagagaatttgagcattctaagctgtcgaccctgcctctttgaaacattatgatgctcagacagaggatgtggggtagaaatggaagaattgttggaactgttaaatgatgagacatgtgatactggagtgaaagacaaaagctcatgaaagaatcatgagggacacatacaaacttcattcagcagcatgaagatgacagctcattgtttgattccttagcctacttattaagtttggacttgataaaatatagcagatttaacttgtcttaccacattcagctgtatttgttataacacagagattcatcttgggtggctctttagctgggtttgtttttactgaaataaaatctctggcatacgataatggaaaaaaaaataccagagtttcataatatgtagtgtactatttttctacacttgagaattttgagtgctttggaaataataaggctgtttccacaatctcctactctccactaggttcttggaacaccaaatgaggacacatggcctggagttcattctttaccacattttaagccaggtatgtttcattaattacagatgactaggtgcttcctatatgcaaaaggtgagtatataaatgttccctctcaagcaatataccaccttgaaaaattctggttacttttgccattgtgtactttgtctattaatggaattgtccttttattttcacaaattatttgtctgtgaagacagagttaaagacatccctgatgattttcaccatatatactttattttatttgactggttgatcttgcagtaaccattaatttcatcatcagttagactagcatccatgtctataaaaacaaaatttaaattgggttgctgtaatccatctgtgtcacttcttgtagtaagtgaccaggaaaagtattaaattgtaaaaaggaaaaatcatatttttatttttttacaaaactagtaaatatatggtctataatttgagtttaaacatgtaagatgctctgaatgttctattgtacagcattcaatatgttttcatgtaaaatatttaaacctgaacactgaaaaatctgaaagaaatgtgaacttttaaagtaagttgtccttttttttcaccagtaggtgtcaggcgtgaaactttgttttaataattacacttaacagatgaatctcaaatatggtctgatttttataagagaagggaaaggtttggaattgaaaatttaataaaatcagtagaatgaattattgtaaaatgattctcttgctggttgttgtgtttttttttcttttctcagttataaaacatggcttacaaaatgcagacccaccataaaattactgaaagggattttatagaagctctaatagtctattatcctatgagggaaaagagctatgaataatatctgttagaggagccaagtgtattattttgcttctcttcccctcttttggggaaccatcaggaataaattatcagttccaaagaatgactgagttgggaaactatttttactcttaatatttttcttctgaaagtgcgcagtgtgttcagaattcttttatcttcttcagctgccctaaagactctttgtacttttactggaaattctaaataacttctatgttctgaaagactatagaaacctaacaattttaaatggactgactttcttttttaagcaactaagaggcatcctctaactgatccacgtgttcttaatggagtgaagaacacagttccttataaacgatccaattgtgggctcttaaagaaggttaacttccctgtgttaggacctaaaatttatgtcctaggcaaatgaaacaggagactttaaaaagatttgaaatgaataaagttagatgcaaaaaggaacaattaaggtgaaatcatttggccagcctagtttctggattagaaaacatggagtaatttatgtgttttggtgggaatagaatttatcttcatcaacaacatacaaaagcatttattagttgtattttggaaagtacgaggatgtggtacccattaagctaacagattgtgaacttcatgacaccagggactgttcattgtacatatgtggtgttcaataaatgtgtgttgcacttgatcgtattgaatgttaaaacagacattatgtatgtgactcctctggtgggcatatacaaactagaatatttatgtttaagttattaacattatgtgtaagccccacaacagacacataatgcatagaaggtaatggggaaacagaaaagtaacatatgaagatggtggaaagcatgggtggtgatgagcaagatggttattccaggcaaagctcagggctgtgaaccacagcacataagtgtttcctgagtttgcttgagaggagtcaagaggagacacaacaacagactgagtcaaaggaaacaaatttccaagtccttccaagcagcacttaccagaccatccaggggagccccagtccctgacctcatagatctcatagtcctggggaagaaaatatacaagcccaaaaaggaaaatatcagtgctagggtccgcctgtcccaactccactctccagctccttgatttaccccgaagtgtgccctagagaatctggaaaaggtaatctgagacataaggacaaactttgtttaattttctaatagataataaatttaagcaattaaaaatatcaagcaataggaacaaggagcgtagtgcagagccacctcccctctgccaacttcccctgaaccactgaccccaccacaggccctcagcatattcttatatttctttcctttatgtaaatgtaagaaattaatattaatttttagttttctcatattaaacacaattcctcatcttgtttttctcattaatgcatctcattgatcttctcatgtcactgcaaggaggaggccaatgtggtgtccctcttgtctcgtagagcaccattgttttctggatttaacccattcactaattagggacagttgggttgtttccagtgctttgctattataaatattaatgcattgagtacccttgtgcctatacatacacatacacattgcatatatgtaaatatctctgaaggataagttaggagaaataaggataaagagccaacaagtatagacaattataattttgaccactttcatcaaactgttgtccaaaggggtagtatctgttgtctctgttgccagaatacaggagaatacttcttcccacagctgcttctcctctctatgctatgtgaccaaacttttggattttgccagttagatgacaaaaggaatttcagtaaagttttaatttgcatgtgtcttgtgatgaggttgagcatcttttgatatgtttcaggatcatttgtatttccttttctctgaattctttttatcttttggccaatttacagttgagttgtgtttttttaaacctatttctagaagttctttatattttattttattattttatttttagcgatgctgcccaggtgggactgcagtggtgcgattacaactcactgcagcctcgaccttccaggttcaagtgatcctccctgctcagcctctcaggtagctgggactaactataggtgatgccactatgtctggctatttttttttttaatattttgtagagataggggtcttgctatgttgccagggatggtctcgaactctgggctcaagcagtcctcccacctccgcctcccaaagtgctgggattacaggcgtgagccgccatgcctggctgagttctttatatttaagggaaattatccctttgtccatgaaaacttttgcttctttgagatttgaaaaatgatcctttctaatttttaagcaattttgaaaataatccttgtcttatgctctcttgtcttccttgacttgcctaactgaataagttttgccttgaaaagaaaagcccatggtgtttttagaatagtggagttatgatttaaaaacaaaaaatagagacaaagtcttgttattttggccaggccagtcttgaactcttgatctcaagtgattctcctacctcagcctcctaaagtgctgggattacaggtatgaaccactgtgcctgaccacaatttttttaaagaccaatttctgttataggtgtatgtacaaattcatatatgtgtatctgtgtaagaaaaaccagtttgggttttcaaatgtattgctttatggctatgatctaggccatgaataaatctcttggttttaacatatgctaacctaatttcccagtagttattttttaaataacttattttttagttaatgtctatgaaataagttaaatacacttattatttcagcaatatttcctgagcaccacttatatgtctagggactggagatgttgcattgaacaaaaagcaaatgatccttacagggagagacatatagtaagtgaaatatatcatatattgggtggtgataagtactgtggaggaaaatagagcaagaaactggttcaggaagttctgagaaaggggagggggtgatttacagtttaaatagggtaatcaaggaaggcctccctgaaaagaagacatttgactgaagaatatgagagacagagccaagaagatatttgagggaagaactcttcaggcagagacaagagcaagtaccaatgccctgaatggggaggagtggagggctgataatgaagtcatagacgacgtggggccttgagggataccctgagtcctttaccattgatctgagtgagatagaaagctctagaagattttgaacaaggcagcacaggagctggtttatgttttagtaagaccaccccagctattatactgagaattgggggccagagaagaagcagggggaccccttaggaggctataacaggaatccaggggagaggcgatgaaatgtactgtgaataaaatgacctccctttttcaattcctatgattatcccagaactcaacatggttttcccttggaaaaaaaaaatatataacaaaaatggagaaacatttttaaaataattattgaaatagtgaaagaacaattagttaaaaactgaactttattctttactatataacctgtatatcttcttctgtgcttacacaaaacttaagctcagcatattcccatagcaaccaggcaactacaacaggtcacaatggtattatatattataaagtatgtgcatgttacatacaataaggagtctgtgtaagtctcatttgtgttgctataaaggaattcatgagactaagtaatttacaaagaaaagagattcagttggctccaggatctgcaggctgtacaagaagcatgacaccagcatctgcttctggtgggggcctcaagaagcttccaatcaggagaaggtgaagggggagcatgcatgtcacatggtaaaagagggagcgaaagagaagagaggacttccctaaagttagtgtcagaggtgaaagtagatcccatgtctccgtgggtcttagttgagtgtgcttttgcttttacttttgttttccagcctccattatgaaatagcattctactgaatgtgcatcacaatttctcattgtccttctaaagaacagtttactggcaattagactattttaaaaagcagaaaagtagagaagatctgatctctgggaaaatatgtacagtaatacacacaaatattaaaatattacaccaatacaaggctctttttaacaaccagatctctcacctgaattaatagagcaagaactcactcattatcctggagaagacactgagttattcatgagggatctgcccctatgacccaaacacttcccaccaggcctcacctccaacattggggatcacatttcaacatgagatttggaagggacagacatccaaactatatcagagtctaaccttggaagctgctatttttccatcatttacttctatttaaatttctcttaaaagaaatggaaaatgggcttgtttcttttttgaacctgattaccttcctgtttcttttcccttaccctcagggttctgtggttaatggtcttttaaaagtaggtctccttgtgtctccctcactctctcattccagagtgtttccttttgtcactgtgttcaggatacttgctgtgggaaagtcttgaggtgagagattgtgctgtggtgttctcagtatttcagtaattccataacttggtgtgagattcatcacaggcaaacccatgctctaacacaaagtgagagtccactgtaaaaataaatcatattccttttcatgggttcatagttattcactaacaggaggcttttgcataaggctctctgctataaattcctcctgggataatgagaggctcccctatgtgaatcccaggatcactttcttctaccaggtttaccccctgctacatcccatcgacaggtgctgtggttcatatgtctctgctaaagtgacagtgcaatttttttgttgctgttataagacagacttatcatttttaaaagatgcatcttgcatgcatgtttgaggggttgtttaagcttcatagaattgtggtaaccccagatcagggcggaatacacgtagacatttgaggttctccagaccagtagaatcagagtaatggatgaagagttctgtcaaggctttgtaatttctagctgtcaaagagtaccctggggctgcatgagctgagagtgcgagtggtgtttgattgtgccttaagcaaagtgaatgtttgagctagagggaaccccagggagcatctagtctggctttcttcttgtgaagttaggaacctgaggtccagagatgttaaagaacttccctaacattagtgtcagaggtggaagtagattccaggtctccctgggtctcacttcctgagtgtgtttgtgtttttgttttccagctttcattatgaaatagcattctactgaatgtgtattacaatttctcattgccctgctaaagaacagtttactgacaattagactattttaaaaagcagagaagtagggaggatctgatctctgtatttggtaaaatatctacacaaaaccaccaataacacttcgtataaaatggtttagcactgaaataatgtgtagattccatgtatgatactttcatctctcaaatgcttccaacaaaagggaaaggtacattcaaaaactatttaatggattattcagatgctcaaaaaggaatacactgtgaagttcagtgaggaaaaaaatgctgctagaccagaagcaattaaaagtgatgaaatttagaataaaataattatattttccaaaatcaagcaagagaatagagcatttctaaagtggttatattacttctaaggaaaagttagccaatggaaaagactatttgattcaggaaactttgaagaaaatggactgtctcccaacgaatgaaataatataaagaatttgccattggaggcaattggggaatggtgatattttaaacacactctgctaaaaactaatcctacagacacattgaccttaaagggaatgtttacatacggacttagctgtatcaaggctttgtaatgaggcaaaaaaaaaagccgtctctttaagtccttcctcttctctggcctgactgggaccccaaaaccaaacaggtccacacttttttgttccagagggaggaagtaaatcatttcagaaataaaatactatggtgataacaccttacgttttatgctatattttattatttacaaagcattttaatatattatctcatttgatagttagaataactgcattataataatgcttttttcctaatattgttatcccatttacagatgaagaaactgggaaattgaggctcagagagatagtgtggtttgcccagagatctcatccctccaggctgtagcagagccaaaactcaaacccaggtctttcaactctaagccattctcagtgatgcctcctcctctctttaagagagcttccctgcccacagacctagacctacgaaggagaattgtcaggctcttcccaactctgtcttgtggcatcttggaaaagacctctgtcttcttgtacataccagatccaccctccacttgctaggtatgggcatattcttccgccctttaaacctatgcctccaataaatcatcagctccaaaatctcctctgcagatgtttagtctcagatgtgtagtccttaacacatactatcggaactgcccactttcctcatttgcagatgtgaggatgtttgaacccttagcctttattgacattcttggcttttcctgagtcttttagaaggtgatagaaaagctgtggatgcagcagaaattgttgtcggggtgggatattccatgcaggaagactgcgggggggctctttgtgccatgatgttgccctgcacagaccacacctgcagtgaggggaggcctgtgaagtgctgagataccttccttactcttctagaagagtcatgtctgctccatccagcctacagacttgctacgtaaattaaatgagataaactatttttacattcccttcaatatttgttatttatactctacctatttttaagcagatttgagctagctgacataattgatataaaagtacttttaaactgttaggggcatgtaactgcaaaataatttttttttttttttttttttttaccatttatataccatgtgctctgcctgctatctcctttcccacttactctttacactttacctcaggaattttaaattatttttatgattgatagcaactataatgattatgggttaggtctaggtgtatgggctgtaactatgtgatggttattaaaatggactttaaaaattattacgtaaatatctgctttttatctcagattttattgctaaaagccttgtgggtctgcttgacacaagccttagggtatttagagctctccccacccaccatcagctatcacctttgtgaactttgctgtccctcctcccacaaataaatgctgctttaatcacatagtgaaaaagccagttaattactaaatttatgaactatgtgaacattataaagctaaggaagtaaaatatgtaaacatgacaggaagggcagactgcactttctggttgagccagccatactgggaggtcactggtggttgctggagagcagatgctaaagttgagagtcggtgtttgcatcagcagtaactgctttacatctgcttatgagcttggattcctgttgagtgcttactaggtgccaggcagtattgtgggtgctaaagatgcagtttgaacaaagcggatgaatcctttttcttgcagagctcacatgctagagaggggactaataatagacaaattacaacttaccatgcctgtgagcacagggacagcggcaagaaacaattcaggggggcaggtccttggaaagccaaggtgaagagtcaggattttacttgaagtgtgagtggaatcatcggagggttttgaagagaggaagaaatcaatgctttatgttttcagaaagacctacaggctacaaaaagtcacggactcatttcagagctggaaagaggtttcatctgaagtgtgaaatcctcttgattggtcatttctgcctgcagccctgggtcaagaagggtctataaaagcgagtactaactcacagggaaattattctcctaccagttagcagtgatgccagagacacaaaggatatttttcctcataggtccatagctgaccagggatttgttataaaataaatcgtagatatggccaacgatatgaaataaaaataaaaaagaaacaaccaaaaaccttgataatcacttaaaaatgtaaaattagcaattcatttcccctacaataggtaggttaagaagggaaatccctgtaggaatgttgtaaacccatttcagtacaaaggagggacaatctgtactttgtctggatgtacttgaagaatttcacatttattttcactagagggcatcagtaatgatggagactagcagaatgtctagaaaatgccagaaaaaaaagtagtaagattaaattttcaagggaaaatgaagttctactgatagcagacttatttttaaaaatcccaaataaactggttttattagttctactcgctggaattttgtaaaatttattttgggagttattcacacctcatatcgctaaagttgatatagagggccaatcaccatataaagacttctttacctcttcagtaattccaacccacctaagagtattaaaagtcttgtatactgtccaatttgtataatttggttaaagtcatattgaagaaaagaatttaacttttagcctaagaatttatagcagaattaaatgaagacagggacgatttacttgatactgaaagaactgtcatctcttttaaaataaaacatttggttgagttgttatataccagtggcatttccataaactggccgtacacttttaattgccttcctaagtttgtaacctaatgttttatgtttatccttcccacaaattaatgccggcaagtatataactaggaatctatgcattgtataaagtcctccataactcctcaccctgaacttttaggtccctttccaaaaacttttaaaaatcaagatcttaggaagggagatgaggggattggaagtttggatgtaaaacaagaaaacgttgtccctcgtcttcaaggtgggtgttgaccacagtaccttgagtaggacactgtatctttagggaagaagtgggacttcactaagccaaaagcttgcacagctgtccagtttgaccggggattccacaccactatgagagattcgtgactaagtggttgacccaagggtaggatgaagattttctctcttaggtgcctggaaatattggaagcacagagaacagcatggtgttcggtaatctgaatattcatataaatttttcagcatgtgaaaattctttttttttaattatactttaacttttagggtacatgtgcacaatgtgcaggttggttacatatgtatacatgtgccatgttggtgtgctgcacccattaactcatcatttaacattaggaatatctcctaatgctatccctcccgcctccccccaccccacaacaggccccggcgtgtgatgttccccttcctgtgtccatgtgttctcattgttcaattcccacctatgagtgagaacatgcagtgtttggttttttgtctttgcgatagtttgctgagaatgatggtttccagcttcatccatgtccctacaaaggacgtgaactcatcattttttatggctgcatagtattccatgctatatatgtgccacattttcttaatccagtctatcattgttggacatttgggttggttccaagtctttgctattgtgaatagtgccacaataaacatacgtgtgtacgtgtctttatagcagcatgatttatagtcctttgggtatatacccagtaatgggatggctgggtcaaatggtatttctagttccagatccctgaggaattgccacactgacttccacaatggttaaactagtttacagtcccaccaacagtgtaaaagtgttcctatttctccacatcctctccagcacctgttgtttcctgactttttagtgattgccattctaactggtgtgagatggtatctcattgtggttttgatttgcatttctctgatggccagtgatgatgagcattttttcatgtgccttttggctgcataaatgtcttcttttgagaagtgtctgttcatatccttcgcccacttgttgatggggttgtttttttcttgtaaatttgtttgagttcattgtagattctggatattagccctttgtcagatgagtagattgcaaaaattttctccgatgctgtaggttgcctgttcactctgatgggagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctggggtttttatggttttaggtctaatggttaagtctttaatccatcttgaattaatttttgtataaggtataaggaagggatccattttcagctttctacatatggctagccagttttcccaacaccatttattaaatagggaatcctttccccatttcttctttttgtcaggtttgtcaaagatcagatagttgtagatatgcgacattatttctgagggctctgttctgttccattggtctatatctctgttttggtaccaataccatgctgttttggttactgtagccttgtagtatagtttgaagtcaggtagcgtgatgcctccagctttgttcttttggcttaggattgacttggcaatgagggctcttttttggttccatatgaactttaaagtagttttatccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcgttgagcagtggtttgtagttctccttgaagaggtccttcacatcccttgtaaattggattcctagatattttattctctttgaagcaattgtgaatgggagttcactcatgatttggctttctgtttgtctgttgttggtgtataagaatgcttctgatttttgcacattgattttgtatcctgagactttgctgaagttgcttatcagcttaaggagattttgggctgagacgatggggttttctagatatacaatcatgtcatctgcaaacagggacaatttggcttcctcttttcctaattgaataccctttatttccttcccctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagcttattattttgagacacatcccatcaatacctaatttattgagagtttttagcatgaaggttgttgaattttgtcaaaggctttttctgcatctattgagataatcatgtggtttttgtcattggttctgtttatatgctggattacatttattgatttgcatatgttgaaccagccttgcatcccagggatgaagcccacttgatcatgatggataagctttttgatgtgctgctggattcagtttgccagtattttattgaggatttttgcatcaatgtttatcacggatattggtctaaaattctctttttttgttgtgtctctgcccggctttggtatcaggatgatgctggcctcataaaatgagttagggaggatttcctctttttctattgattggagtagcttcagaaggaatggtaccagctcctccttgtacctctggtagaattcgactatgagtccgtctggtcctggacttgttttggttggtaagctattaattattacttcaatttcagagcctgttattggtctattcagagattcaacttcttcctggtttagtcttgggagggtgtgtgtgtctaggaatttatccatttcttctagattttctaatttatttacatagaggtgtttgtagtattctctgatggtagtttgtatttctgtgggatcggtggtgatatcccctttaacattttttattgcatctatttgattcttctctcttttcttctttattagtcttgctagcggtctatcaattttgttgatcttttcaaaaaaccagctcctggattcattgattttttgaagggttttttgtgtctctatttccttcagttctgctctgatcttagttatttcttgccttctgctagcttttgaatgtgcttgctcttgcttctctagttcttttaattgtgatgttagggtgtcaattttagatctttcctactttctcttgtgggcatttagtgctataaatttccctctacacactgctttgaatgtgtcccagagattctggtatgtggtgtctttgttctcattggtttcaaagaacatctttatttctgccttcatttcgttatgtacccagtagtcattcaggagcaggttgttcagtttccatgtagttgagcggttttgagtgagtttctgaatcctgagttctagtttgattgcactgtggtctgagagacagtttgttataatttctgttcttttacatttgctgaggagtgctttacttccaagtatgtggtcaattttggaataggtgtggtgtggtgctgaaaagaatgtgtattctgttgatttggggtggagagttctgtagatgtctattaggtctgcttggtgcagagctgagttcaattcctgggtatccttgttaactttctgtctcgtggatctgtctaatgttgaaagtcgggtgctaaagtctcccattattattgtgtgggagtctaagtgtctttgtaggtcctaaggacttgctttatgaatctgggtgctccttattgggtgcatatatatttaggatagttagctcttcttgttgaattgatccctttaccattatgtaatggccttgtctcttttgatctttgttggtttaaagtctgttttatccgaggctaggattgcaacccctgcctttttttttttttccatttgcttggtagatcttcctctatccctttattttgagcctatgtgtgtctctgcccgtgagatgggtttcctgaatacagcacactaatgggtcttgactctttatctaatttggcagtctgtgtcttttaattggagcatctagcccatttacatttaaggttaatattgttatgtgtgaatttgatcctgtcattatgatgttagctggtgattttgcgcgttagttgatgcagtttcttcctagcctcgatggtctttacaatttggcatgtttttgcagtggctggtaccgattgttcctttccatgtttctgcttccttcaggagctcttttagggcaggcctggtggtgacaaaatctctcagcatttgcctttctgtaaagtattttatttctccttcacttatgaaacttagtttggctggatatgaaattctggtttgaaaattcttttctttaagaatgttgaacattggcccccactgtcttctggcttgtagagtttctgccgagagatcagctgttagtatgatgggcttccctttgtgggtaacccgacctttctctctggctgcccttaacattttttccttcattttaacttttgtgaatctgacaattatgtgtcttggagttgctcttctcaagaagtatctttgtggcattctctgtatttcctgagtctgaattttggcctgccttgctagattggggaagttctcctggataatatcctgaggagtgttttccaacttggttccattctccccatcactttcaggtacaccagtcagatgtacatttgatcttttcacatagtcacatatttcttggaggctttgttcatttctttgtattcttttttctctaaacttctcttcttgcctcatttcattcatttgatcttcagtcactgataccctttcttccagttgatcgaatcggctactgaggcttgtgcattcgtcatgtagttcttgtgccatggttttcagctccatcaggtcctttaaggacttctctgcattggttattctagttagccattcatctaatcttttttcaaggcttttaacttgtttgccgtgggttcgaactacctctttgagctcagagtagtttgatcgtctgaagccttcttctctcaattcgtcaaagtcattctccatccagctttgttccgttgctggtgaggaactgcgttcctttggaggaggagaggcactctgatttttaaaattttcagtttttctgctctgttttttccccatctttgtggttttatctacctttggtctttgatgacgatgacgtacagatggagttttggtgtgggtgtcctttctgttcattagttttccttctaacagtcaggaccctcagctgcaggtctgttgaggtttgctggaggtccactccagaccctgtttgcctgggtatcagcagcagaggctgcagaacagcggatattggtgaatagcaaatgttgctgcctgatcgttcctctggaagttttgtctcagaggagtacccggccttgtgaggtgtcagtctgcccctactcgggggtgcctcccagttaggctacttgggggtcagggacccacttgaggaggcagtctgtccattctcagatctcaagctgcaggctgagagaaccactactctcttcaaagctgtcagacaaggacatttaagtctgtagaggtttctgctgccttttgtttggctatgccatgcccccagaggtggagactacagaggcaggcaggcctccttgagctgcgatgggctccacccagttcgagcttcctggctgctttgtttacctactcaagcctcggcaatggtgggcacccctcccccagcctcgctgccaccttgctgtttgatttcagactgctgtgctagcaatgaccgaggctccatgggcttaggaccctccgagccaggtgtgggatacaatgtcctggtgtgacgtttgctaagaccattggaaaagcgcagtattagggtgggaatgacctgattttccaggtgctgtctgtcacccctttccttggctgggaaagggaattccctgaccccttgcacttcccgggtgaggtgatgcctctacctgcttcggctcacactcagtgcactgcacccactgtcctgcacccactctccgacattcaccagtgagatgaacctggtacctcagttggaaatgcagaaatcatttgtcttcttcgtcgctcacggtgggagctgtagactggagctgttcctattcggccatcttggctccactcccccagcatttgaaaattcttagaaacacagaataatggcaaaaattttaagtgtcacatagctgatgatgctagtttgcattgcatagctctttcctgtgtatcaaatgctttcatggatgctatctcaggaggtcctctcactagggaaggtagacagggcagatggacaaagccgaagctcagtgaggaaaatactgtttcatgacacaaaaacaaaccaccccaaaggtgtactataccccactaagtatctggcaattactacacctgtgtggtgagctgggtttcagctggtgttggctgggccctgcatttctgggcttctagctgcaggttgggttcaggtatgttccacacccctctaatcctctttggagtggcaactatggaagaatgtccttcttacagtgaaaggcagggcacaaaagagcagacgtaatgccacagtcacatttcaaatctgtgtttgtgtcattaccactgtttatgcaaactgtcagtggggcagagaagtatcatccactcatgaaagttggaagagaggagggagtgattatttgctgaataatcatctcatctcccatagtaggttctgactcctaggcttgtcagctactcctagctaaaacaagtgagttcattttttgctgtttaaaaaatccttttaggccattatcacatagctccttcaagacaaatgcatgactatggaataataactcttattctaatatataggagaaagaaaaaaaacttcgtttccaatacttaagatggaagcactgttttgcccccaaaatgttaaagtcagaccaacaggatgataaactgactactaattattcgctccggcgtaagatctgataagatttccttcacgtacactgtccttcatgcagcactggcagagagcacctttgtagctaacaaacaataatactcccaatggagattgtttaaaaaggacataagtatgtatgtaaacagatgctcatgcctttagagccagctttgtaaatccaattaataatctctcaactgtaaaaaaggaggacaattgacatcctctcagaatgccaatcctcactctccactagtgtattagaatcacaggattatatatcgggagttagaggagcatcaacgtatttgtggattttattcatttgactgttgcctcaaaaggagtaatgtaggatagatgaagcatttgccctccctggagtaatactgctttctatataccatatgtctccttctgaagtatataactgtaaaagatggtcagtttttcaagtatattattattaatagtttcagtggcaatattaatagctaacagatactgagtgttttttttatgtgtcagggacttatcagctcttgagatgcattttcttattgaacattcctagtaactatgaagtgggtactgctgttatcccaatttgagatatggggaaactgaggcatggaatgattaagtaatctgttcaaggtttctagaatttgaaagacatatgtttatcattccctgtaaacaaaagacagatttattctcctagacttaaaaaggtaaggcactctgacgcaggtggaaagagagttgggagagaggaatgttgagaatcttgtttgtatgcatgttcttatgcatgtttttcgttgctggtcaaggagttttgatctgtttgttctgctactagctttgtgcattatcagggtagcacttcaagtctctaccatttaagacccagaggggtgtcatggtatagtgactaggagcacagactccagatctacactgtctaagttcacatctctgctctgtcacttatgagctgtgtaatgtggacaaattggtcaatgtctctgtaccatttcaccatgtaaaaaatggagataatcatacccctacccatagcattattacatggattacagtgagttcatatttgcaaaccacagaggatacaagaaacatctgttaaacatcaaataggagtcgtgggtatcctagctctttggtaagagtagactggagtagagtcctggttcagtctctgtcactatagcccgcatcacagcctcaggcaactcaacctttctagcctcggtttacccatttgtaaattaagtggttaggccacttggttgcttgggtcccatctagcactcagatcctctggagctgctctatcttcccctttagagagtttggatgggggatttggaaggggaaggggatgcacagagagtgagacacaacatttttctcctgctttcttttctgggagctgtaaatttgttcttgtttatgaatagtatgctttagactttaataaatgcctaacttagttctctagagaaaaatgtcttgtggaaagagaagtagtctatgacttttaggtagagaaaggtgtagatggtttggcgacctcatctgggaacatgcattgactaaccccacaatgttatttctatgttagaaacacaaatgtcatcacaagcaataatgtttaatgaatacagtagaacatttgtttccagaagttgctcaaagattactcatttagaaaagcatgctgttagtaattgaaggatgatttcctatagccagggcaagttcagatgctttagcctcacgggtaaaggactgaagaggctgctcagcattttaaggtagctctactgggtggcagtgacagggcagtgcaattctgttcagcattgatgtgttacatcaaaacctctcactgataatgctggggctgtgtcaaatctgagccattaaatatcttaggaatatcaagtgttttaaaggtgtggattgcagtttagagtaacatacatattattctaaaatgcctgttggaatcaccatgccctttgggagttaagatatataaaatcctaaaattttgggaaaagtctggccctctttatttgaggtcaactcttttctgctgtacacaaatactgctttacttctgttccaaggactatagattcagcttttaaaatatcttgatcagagtgttgactgaagtgttcactgatggcttggttttcctaacagatataagaaagtaaagtgtgcataaaaattcttgtgaatacttgtgagtgtagctttcttctattgaaggcctctcagtattggttcgcatgatttgttggaggctacttgtgaccttgtatgtttgctgccccactgtattcacagtccctagcaagttgcagacacacaataagtacttgtagaatgaatgaataaaatactgtgccttctagccaaaaggatttgagtgtgttatttgtaacataaacaaataattagggtaactgtttgaaatgtaaccagagtgatttatgacagtgttaattgttcatccttgtaagggactggagccttttgccttcatggaagcaacccccagaaaggtactgggctcagcatctctaccagatgatgaagcgcccttcagtgtggccacggctttttgcttaaatcattgctactttttttttaccagctcagtaggagtgaatgcatgtgttacaacgaaaaataatcctaaattgaaattgtgagtaactgaatatatgatttagaagagttaattatgaagaacagctagaatttcatgtggcatttagatgtactcatttttatattgatttataaactaatgcttgttccatggtattgtttatactatatgatgtcaaagccatttgcaaaagatctactgaagtttgagcctttttatgatccttctatggacccccctctttgtctgctcactcccactcctcccaaaaaaagaaagaaaagtgttagctacaaatctagtttcagcctttcaagtcctttgaacatatgtgaagttttttattggttgtttgaactttttattcatgtctttctgtcattgaagttaaaaacacagcagtataagatacaaaaacattggtgagaagagaataaggaaaattaaaattaatctcctgaagtgtacactgcatgcttatatgcaaatgagtaaaatccaatttgggttttatcttcctgtgggttaaagtttgctttgtagtgcctcaagacatttcaggtgtagcttttttaagccaagggactttacaatatgcagcattgttctccagttgttttcctgtggaatgtcaacgaattgcagtgcttacgtgcatggcggtttgagagaaaacctttccaatcttctgttccctgccctgtcacttagcaagtgatttcttctcggcaagctctcctacctgatctcctgctgtgttgggatcatcctctgcaatgtccctgcactaagaggagaaggtgaaaatcagcctgcaggttcaaattaattgcacttctcagttatgctgtgagttagccagtgctttaaataatgacattctaaacttctagtttaaacataattggaaagagaaagttgacattaaagtaataagtgagagtaaacttaagtgaaggagaacagtgtaaaacattcatatgcaaatactcaaatactcttgataaaattattcataggcagttgactattttattaaatatgcttgttgtcaacttggggcaccaattttaacacctttttgttttcaaaacttaacgtggctaattatgttttttcatctaatggaacattacttttatttatgatggaagtagtttgtaaaataaaaattttattctaattataaatgtcatgttcgtggcagaaaacattagaaatgcctccatttgaaatcatgtactttggcagttatgatctgaaagctgttggatataaatgatgaggctctgtgtgttcctggagctagcttccggtgtttgagtttgtcctgtcttcatttggaaaagaaacagatgcagttagtgtctctagctgtagtctctagtggggactctgtctgtatccatactgtagcatttttcattctgtatctgtaattctatatttagttttcaatgccaccgaactgtaaccaggacttagttatttttatgtgcccattgcccaatgtagcacctggcacacaggcacatgcccaggcaatatttgctaaaagaattaaggttttatgtgaataaaacctcataacatgcctcacatggcatgtttcactatcaatttagtctcttttgtgcacagctaaaattagcattgtatttctggaaaaaaattatattagcatatcctgtcaagctctaaaagaggtaattcttagaactaatatttatgtgcaattaattgctaagaataataatttacttataaatgcaagattgtattacttttatctgtaatagaattcctattcatcctgaaatcatagcaaattattaagcttgctttgcggatagtacaaagttaaggaaatcaaatttgttttatgagggcatttgacttaattaatttttaaaatgtctcttgctttcttaataccaaactttagataattttttaaaaaagaacttcatacaaagaactgttcctcctgtttctcctttgtcagttaatcctcaaacctagactatgcccttaaattcctattctacaccaactggctgaattatgttgcatcttgtaaaatgcagcctagtagagaataaactcagaaattagacattcctttgaaacaaataaatacacatttgttggtaagcccttttgcctgtgtctgtagaacaatggatgtttgtaatcggggctgatcttcagctaatgcacacctttattgcataatggctagtttctgttctgactggtcaatgcctgtgcctaacaggttattaaatattttgtcaattacccctgtttgattgataactccaaaactccaggagaactcctctttatataccttctgaattaccacagaaagattaatttcttctccaaataataattgagttgtgtgtgaaattccacatctttgtaacctggaaattggagatcagtcagtgctctatgaatcatcgactcctccctttctgtcgcacttcatttctaactcaccagcagatctcacttgttcatcctccaaagcattttccgactctgatctccttctcactgcattcactcggttcccatagcccaagtcatattgtctctctcctggacagtaataaccttttgttgggctccctgcttccaaccttgccttctgtagtgtactttccaaatagaagccagagtgataccttatattaaaaaaaaaaaaaaaaaaaaaaaaagcccataccagatcatatcttaaaggccacaaacccttctgcctgtctctgtctcagcctccacctctctctcctgggttctatgtcatatgcagctatcctggcctccagcacattccagcctagcatactcgttatgggaatgcaagccccctgcaaatagaaaggttttttggtttgtttctctgctgtgtcttcagccccaagaattatatacctgacacacagtagttgctcaatacatagtagttgaaatgaatgaataaataattgcatagtgtttaaagataggaaactgagtgtgtgtttttctttttgttcttcttatccaatggtattcttgtacatgaaacataccataacaaagcaatataagtcatttttattttctcctttaaaaacttataattaaaagcagacaagaagtcaggcacagcggctcgtgcttgtaatctcagctactcaggaggctgaggcgggaggatcgcttgaggccaggagtttgtgaccagcctgagcaacagtgagatgccatctctaaaaatagataaatacataattagtcaggcatggtggtgagtgcctgtagtctcaggtacttgggaggctgaggtggaaggatcccttgagcccaagaattcaaggctacagtgagctatgattgtgccactgcactccatccagagtgagacaccatctctaaaaaaatttaaatttaaatttaaaaaaagcagacaacactgaaaaaggacaccaaccattattaagcagaattaagcctaataagtattaaatcattaaaaagaaataagatcaatactttaaaaaactaatgttactgaaggatgtatatgtgaatgctgtctaaatagaaagacacaaacgttttacatcatccttttcaggttaatatatattttaataggacacaatcagatttccaatggaaacattttttaaaattttttgtttgttgtttgttagcacagggtcttgctctgtcactcaggctggagtacggtggcacaatcatggcttagtgcagcctctaccttccaaactcaagggatcctcccacattagcctcctgagtagctagaactgcaggtacacaccaccacacctagctgatttttcaatttttttgtagaggtgggtctccctgtgttggccaagctggttgcaaactccaaggcccaagcaatcctcccacctcggcctcccaaaatgctgggattatagccatgagccaccacacccagcctgtgtattgtgttgactaactgttttattttaaactggtctgtccttataagaagaacctaaagtgttctcacactggtctacatcagatctccttgtttgctttgctagaacacttaccactttctaaaattaactcatttattttgttgttgctgctgctgctgctgctgctggtggtggtggtggtggtggtggtagtgatggtgatggtggtgtttatgtttttattgtctgtctcatgtttctagaataagagctccgtgaagaaagagacttgttctgttttgttcatgcctatattctcagcatgagaagaatccttagcacatattaggaaccattaactatgtgtggaattaatgaaaaaggaaatgttcaggctgggctttgtggctcatgcctataattccagccctttgggagtccaaagcaggaggattgcttgagcccaggaatttgagaccagcatgggcaacatagtgaaacttcacctctaccaaaaaaattttaagttagccaggcatggtggcatgctcctgtagtcccagctacttgggaggctgaggtaagaggatcagttgagcttgggaggtcaaggctgcagtgagcgtgattatgccattgcactccagcctgggtgacagagcaagaccttgtctttaaaaataaaaaaggaaatgttaaaaaaaagagaaagaaatgttcaaaacttgccccaataatttttaccaaaaaaaaaagaatactagtaagaaaagacatttcctagataagaagagccactctaattaaaacactatgatactgacataaatagataagtattaaagagtccaggctcttatatattttggaaagtaatataggataaaggtgtcacttcaaattatcagagaaagagtgatccataatgattgatttttaccgaatcctggcataattgtctgtcctccttgaacaaagaaaatgtcataccatatttacaaaataaattccagatagtaaagccaagaagtaacaatttgttaaaaaaataataataagtaggagaaaaatgaagttattgtttgtataaaatcaagatcagggtctttttctttaagcaagacaagaaagccaaaagaaaaagaataatttggggcagggccaagatggccgactagaagcagtggtgatctgaggctctcatcaaaaagaactaaaacagcttgctatcctgcactggcaaccaaggtatccaggttctgtcatggggacagaccaggcagctggcatgatccaccgagaggaaggaagagcagtgtagtgcggcggcccacctgagagccacatggggcaggggacccctcacccccccagccaagggaggcagtgagtgagcgtgctacccagcctgggaaactgtgctttttccacggaactgtgcaacccacggatcggaagatcccactcatgagcccatgccaccggggcctagggtcccaaccatggagctgctcagattctcaacagccactaagctagaatctgcttaagcctgccaagctcctggtgggagggccggccatcaccacagctgcgggtgcctgctgtctaagccctctgtgctccttcagggaggggcagcagccaacactgggactgctagctgcctaacacactaagctcccagggcggggtaagggcagcagccatctctatagctctaggccatgctcttcccctgctgaagccagggaggctggatggcttggtcccaagagggattccccacagcccaacacactggctgtggcagattgtggccagagtacctcttcagacctgaccctgactcatcttttctcatggggacggggcatccctgcaggaactccaacaactccaggcaggggctcaggggcagaactctgatctctctgggcctgagcccctagggggaggggtggccatagtctctgcagaccagcagacttagtctttcctcctgctagttctgaggaacccaggcagcccagatgagtaggtttccatccagctcggcacaccccctccaccaagggacaaccaaagtgcttcattaaatgggtcctgctccccgtgccacccaactgggcgagaccctcttaacgggttgtcagacaccctatataggaatgtttctattagcatcaggtaggtgccccttgaggtcagatatctcagaggaaggagcaggtacccatctttgccgttctccagcctcctcaagttcactccaggtgcaggagtgaaacagataaatagggcctgaagtaaatgcccagcaaaccacagcagccatacagaagagggacctgaccattgaaagaaaaaacaaacaaacaaatagaaagcaacaacagcatcaacaaaaatgttcccgcaaaaacctcctccaagggtcagcagcctcaaagattgacactagacaaactcatgaagatgagaaagaatcaacaaaaagatgctgaaaacccaaaaggccagagtgcctctactccttcaaacgatcgcaacagctctccagcaatggcgcagaactggacagaagatgagatggatgaagtaggcttcagaaggtgggtagtaataaactctgctgtgctaaaaggagcatgtactaactcaatgcaaagaagctaagaaccttgataaaaaccttacaggagcttctaactagaataaccagtttagacaggaacataaatgacatgatggagatgaaaaacagcatgagaccttcgtgaagcatacacaagtatcaatagccaaattgatcaagcagaagaaagaatatcagagttggaaggccatcttgctgaaataaggcagccacacaagattagagaaaaaaagaatgaaaaagaacaaacaaaacttccaagaaatatggaactatgtaaaaagacagaacctacaattgattggagtacctgaaagagacagggagaatggaaccaagttggaaaacacatttcaggatattatctaggagtacttccccaacctagcaagacaggccaacattcaaattcaggaaatacagagaacaccataaagataccaaccccaagacacatgatcaacagattcttcaaggtcaaaatgaaggaaaaaatgttaagggcagccagagagaaaggccaggtgacctacaaagggaagcccatcagactaacagctgatctctcagcagaaaccctgcaagccagaagagagtgggggccaatattcaacattcttaaagaattttcaacccagaatttcatatccagccaaactaagcttcataaatgaaggagaaataaaatcattttcagacaagcaaatgctgagggattttttcaccaccaggcctgtcttgcaagagctcctgaaggaagcactaaatatggaaaggaaaaactggtagtagccactgcaaaaaacacaccaaaatataaagaccaatgatgttgtgaagaaactgcatcaactagtgtgcaaaataaccagatagcatcatgatgacaggatcaaattcacatgtaacaatattaaccttaaatgtaaatgggctacatgccccaattagaagacagactggcaaactggataaagaatcaaaacccatcggtgtgcggtacccacgagacccatctcatgtgcagagacacacatgggccaaaataagggatggaggaaaatttaccaagcaaatgaaaagaaaaaaaaaaagcagaggttgcagtcctagtctcttgacaaaacagactttaaaccaacaaagatcagaaaagacaaagaagggcattacatgatgataaacagtacaattgaaaaagaacaactaactatccaaaatatatatgtacccaatacaggagcacctagattcataaaacaagttcttagagacctagaaagagttttagactcccacaaaataatactaggagactttaacaccccagtgtcaatattagattaatgagacagaaaattaacaaggatattcagaacttgaactcagctctggatcaagtggacctaatagacagctacagaactctccaccccaaatccacagaatatacattcttctcagtcccacatgacactttttcagaaaacaactaaataattagaagtggaatcactcctcagcaaatgcaaaagaactgaaatcataacaaaacattctctcagaccacagtacaatcaaattagatctcaggattaagaaactcactcaaaaccacacaattacatggaaattgaatagcctgcccctgaatgactcctgggtaaataatgaaattaaggcagaaatcaagaagttcgttgaaaccaatgagaacaaagagacaatgtaccagaatctctgggatgcagctaaagaagtgttaagagggaaacattgcactaaatgctcacatcagaaagttagaaagagctcaaatcgacacccaagtatcacaattaaaggaactagagaagcaagagcaaacaaatcctaaagctagcagaagacaagaaataactaagatcagaggagaactgaaggatatggagacacaaaaaaacccttcaaaagatgaatgtatccaggagctggtttttttgaaaaaattaacaaaatagagcactagatagactaatgaaaagagagaagaatcaaatagacacaataacaaatgataaatgggatatcaccagtgaccccagagaagtacaaactaccatcagagaatactgtaaacacctctacacaaataaactagaaaatctagaagaaatggataaactcataacacatacaccctctcaagattaaaccaggaagaagttgaatctctgaatagaccaataacaagttctgaaattggggcagtaattcgtagcctacaaaccaaaaaaagcccaggaccagatggattcacagccaaattctaccagagatacagagaggagctggtactattccttctgaaactattccaaacaattgaaaaggagggactccttcctaacacattttatgaggccagcatcatcctgataccaaaaccaggtggaaacacacacaaaaaagcaaacttcaggccaatatccttgatgagcattgaaacaaaaatcctcaataaaatactgacaaaccaaatccagcagcacatcaaaaagcttcatccccaggatgcaaggctgcttcaacatatgcaaatcaataaatgtaatccatcatataagcagaaccaatgaaaaaaaccacatgattaactcaatagatgcagaaacggccttcgataaaattcaacatcgcttcatgttaaaaactctcaataaactaggtattgatggaagtacctccaaataataagagctatttatgacaaacccatagccaatatcatactgaatgggcaaaagctggaagcattccctttgaaaaccgtcacaagacaaggatgctctctctcaacactcctattcaacatagtattggaagtcctggccagggcaatcaggcaagagaaagaaataaaggatattcaaataggaagagaggaagtcaaattgcctctgtttgcagatgtcatgattctgtatttagaaaaccctattgtatcagcccaaaaacttcttaagctgataaggaacttcagcaaagtctcagcatacaaaatcaatgtacagaaatcacaagcattcctacgtaccaacaatagacaaacagagagacaaatgatgaatgaactcttattcacaattgccataaagagaataaaatacctaggaatacagctaacaagggatgtgaagggcctcttcaaggagaactacaaaccactgctcaagaaaataagagaggacacaaacaaatggaaaaacattccatgctcgtggataggaagaatcaatatcatgaaaatggccatactccccaaagtaatttatagattcaaagctatccccatcaagctatcattgacattcctcacagaattagaaaaaaaaactactttaaattttatataaaaccaaaaaagagcctgtatagccaagacaatcctgagcaaaaagaacaaagctggaggcatcatgctacctgacttcaaactatactacagtgctacagtaaccaaaaaaaaaaaaaaaaaaaaaaaaaaaaaaaaaatcatggtactggtaccaaaacagacatacagaccaatggaatggaacagaaacctcagaaacaatgccacacatctataaccatctgatcttcgacaaacctgacaaaaacaagctatgggaaaaggattccctgtttaataagtgatgctgggaaaactggctagccatatgcagaaaactgaaactggaccccttccttacaccttatacaaaaattaactcaaaatgaattaaagacctaaatataaagccccaaatcataaaaaccctagaaaaaatcccaggtaataccattcaggacttacgcatgggcaaagatttcgtgacaaaaatgccaaaagcaattttaacaaaagctaaaattgacaaatgggatctaattaaactaaagagcttctgcacagcaaaagaatgaatagagtgaacagaatgaacaggcaacagaatgggggaacatttttgcaatctacccatctgacaaaggtctaatatgtggaatctacaaggaacttaaacagatttacaaggaaaaaacaaccccatcaaaaagtgggcaaaggatacaaacagaaatttctcaaaagaagacatttatacagccaacaaacatatgaaaaaaagttcaacatcactgatcattagagaattgcaaatcaaaaccataatgagaccatctcatgcctgtcagaatggcaattattaaaaagtcaagatacagtagctgctggtgaggctgaggagaaataggaacacttttacactgttagtgggaatgtgaattagttcaatcatggtggaagacagtgtggtgattcctcaaggatctagaaccagaaataccatttgacccagcaatcccattactgggtatatacccaaaggaatataaatgattctgctataaagacacatgcacatgtatgtttattgcagcactatttacaatagcaaagacatggaaccaacccaaatgcccatcaatgatagactggataaagaaaatgtggtacatattaaccatggaatactacgtagccataaaaaggaatgagatcatgtcctttgcagggacatggatgaagctggaacccatcatcctcatcaaactaacacataaacagaaaaccaagcatgttctgactcgtaagtgggaatttaacaatgtgaacatatggacacagcgagggaaatatcacacacaggggcctgttggggagtcagggggcgaggggagggagagcatcaggacaaatagctaatgcatgcagggcttaaaacctagatgacgggtagataggtgcagcaaaccaccatggcacaagtatacctacataacaaacctgcatgtcttgcacatgtatcctggaacgtaaagtaaagtaaaaaagaaaaataataatttattttactaaataaaaatttaaatttttatgtggaaaaaagtgtatacttatttcacttttatacacacacacacacacacacacacacacacacgggcaaacttgatcatatacaaaaaaattctataaactgattaccaagaatccaatattaaaattggtaccttgataaaaaaccaagaatccaatattaaatttggtaccagctatgaaaagtgaaatttgaaacagtagaagaaatgtaaatggccagaaagcgtatgaaaagaagtccaagaatgttttatcaagtgtagctttggcaacatgtaaaaaactgataacaaccaatgctagaagacgtatggagaaagtgacatactttttcatcactggtgggaaaatgaaaagtactctgtcggcatttattaaaatgtaaaatatgcataccgtttgccaagcaattctatattggggaatctatccaacagaaatgaaagcatctgtaggtagagagacatgtacaaggatatttgctgaagtattgtttgtaagggaaaagaaattggaaactacttaaaggttcatcaatgggagaacagttaaataaattatggtacttctattttatagaacgttatacgattttaaaacaattgttacaggccaggcgcagtggctcacttgtgtaatcccagcactttgggaggccaaggcaggtcgatcacctgaggtcaggaattcgagaccagcctggccagcatgatgacaccctgtctctactaaaaatacaaaaattagctgggtgtggcagcacatgcctgtaattccagctacttgggaggctgaggcaggagaatcgcttgaatccgggaggcggaggttgcagtgagctgagattgggccattgcactacagcgtgggcaacagagcaaggctctgtctgaaaaaaaaaattgttacatatattcttgatttgaaggactatccagtatattttgttaagtgccaatagagtttcaagggtaatgtttattgtaaaatccgttcaaaaaatcaatggtatatatgttcgtacataaggatgggtgtatttcataaacaaaaaaatatgtgaaaagggacatagcaaatcattaacaattggtatatcatcagaagtgaaagaatttgcagctgaagagattataatgtctattctgtatcacttgattgtttaacttggtaaaacaaacatgttcctttttaaactaaaacaaatctaaagattgttcactgataaatgtaaatatacggtataggaccctggtagtttggctttgagcatgtataaataccatacaatataggaaaggagacccaatattattgtatttggtcagagaaatcatcataggaaaaaaacagcaagtctcacttgacgaaatgtgttgatatgcttttgtaaatctacttacaggttggaggtttggaatttgcatttcttttttcaactcaattaaaacttagttgttctaagaaatagttattaggaagccaaattatgaaataaaccatcttagactaaagaaaacaatgcttcaccgtttaatatgttgttatcttcctgttttactctttataactgcccagtataaaagtgaagaccttactatgctggcctaactgactgagtagcccactctttttttaaagttgaagttttttcaacatacttgtaatatatacatttgatacaaagattgtttatcatttttcttttttatttcagaacgctttaccctgtacagctctaaaaaccttagacaagcatggaataagtaagtctttatacagattgtgctcattctctttctttctcttttaatatttacaactcttctcatacgtttttcatggcattgttgattcatcctgctgtgtatttattcattcatttaaccattaaactgctgttaaaccttaactgtgtgctagctactatgttcagcctgagccaacactgtatgaatttgagttcctagagcgatgtggcattgcttcagaactgtaaatcctaaaattccttgtggtcagccttcttgcagctaaattccaagaaatatttttgtatcagcaacatagcatttagaaaatataatataatgactgactttctaatataaatgatgttggtgacaacttttgagctaaagttgatctttcagattttttcacttcgcatatttttcccttacgccttattgggaagctaaatgcatttatgactgaagtgtgtgttctccatttatttcatgtctgttctctcatctgaccttacttcattttatttgttgtttttgagatttcataaaatctgaagatctggattttgtagttactcaggagacttttattgcaagccaatgtgttagaaaatcattagaagtgggaaacagtaatttagtcattcccgtttacttgtgagtgtcacatttcaaggtttatgctggataaaagacaactggaactggtttgattaaataaactgtaatttgtcataaaattttgtctacttggaatttagtgttatactcacattttttcactgttatcacgtttaattttggatactcccagttatgaaaaaaataacaaaaaactttttcatattaaaatgctgctaatccgtgctctcagtggatacagtggacagctaatggcgaggaactcatgaaatgaatacattaaattctgcggtagtttactttagggatttggccatttatttttattaaatttgtacctcgaataacacataggtataatcatttttgtctaacctggggctttgcatgtgccatttgaagagccagttcttaacctcaaggctcccctgggaagcattccctctcctgggagcttcctgtgcatgctcctcttctctgcctccccatttcctgatcactggtctaacatattttaattaagtgcttttatacaccagataatatatacagtatacagttcctaccttaattaaatgatcaaacacattcctctcataggaataagacatcattccttccaaccagataaccactttatgaaacaattcttgataaagccattgaatctctaaacctacatttaaagtaacaggaaaatctgaaactatcatactgtagcatagcagcatttctggagaataggtaattagaattacagaattacagaatttatcattagaattaattcaaaggcatttaataaactgagtcccaccattagtcccactttttaaatattttaaggaaaatgataaaagctgagcttgaggtaagattttaaaattatgaacatgacttgtttagaacgatgctatttttaagtccttgtaagttttgccttaagggtttatttcagaaacactaagtaataaaatcattactaaaaatattaaaatgctactttctggtattccagtattaagtgctgaatctttagagccaagctgtagcctctagccaattcaaaccaaggcaatttaaagagaactaagatgcagagacgttaattatattattgattcttcctccaaatggtccttgcaaccatcatcagcatttcagcatctttcacttaaggagtgagatcagaattcaaaagaactacattaaaagactattacgcgagtgatggttttctctatttccaactaatttgcttgtctatagcacaattactaaactgaagcaactgttaaattctcttgtacagtggtaataggtttaaaataaattgaactaatttgcaagaactaatttgaattcagtttagatgggttaatataagataggtgggttaatataaaaaagtaggtcactgttcaaaattaagtaacaatgcttttaaaaatatgtattaacctaggtattgaagctagtggagatgttaacctgcctaagagagtaggaatttcttgagaaatgaatccttaagtttatttgaatagctataacaaaagacccagtttattttggggccaactctgccctaagtaacacctaggcaattccctgctgacttcatttatgtcagcaaccatgggcataatttcatcctttgaaagatatttttattgttctgggaaaacaaagcagcaatgggagaaaatataagatccaacagatatccaaattcaaaagaataatagaaagaagaaatcttaattatgcgattgagaataataaatatatattaaaaaaaaaggaaagtccttttattccctcatactagaagtgcataatccatgtgggctcttcctccataaaggggattgtggattaaagggagacaaatcttaattttataaaaacatgtactgttttctgactgccttcaaaccattctattttatttcattgcagttatactctccctatttctcttccaaatctctctatttatagttgtctgacattggcatgtatgtgcaatcaaccaagaattttagccacttaaaagatcttttattattttggctggagaagaagccttagtgtatgctctccagcaaagttaaggggaagattccaggaacacatttgcttgttttggaacttttaaacagctgaatgatttcggaggtttgaaagtatcaaaaagagaactaaggataaaccactaagtcacagaagacagatctggaaaagaccgcttgtggctggtaacaagaagcacgtctacagacttgaataggcacaggttaaccttttcctgcttgttcccacacatgttatggttctgcttatcctctcttagttaagtaaaactggatttctcctaagaacttataaaaattggtattctaaattgtgtagtaaatacagagacatttaaacaaaggtacctttctggaaacacaaaaatagagaagaaaaatcttacctgctacaattgaatgtaccagcagagtctccaacctgaatttaaaagatttagaaatgtttcctaactttgtgttcttgaactttccttgagtattttatctgacttgatgtttaacttccaagacatattttaaaggtgacttgctagatagttgagttacatatgcataaaacataatgtatttaaaataatattcggaggaataacgtaactttcactctgtatttatgttggtggtgctctattgtatttttcttgtcattatagctgatgtgtaccattaagatttaagtcagagaattcgcaacaaactgaaagaccctgttttccattctccctaatgttctaagtcgatctaaaattttctaacataataatatattgcaaagtaagctagagttgtaaatgtctttccctgtttaaaaatgtgagaggaaggtaagaacactgttatttcactaggaggagcagttgagttgagtgagttcttaaatcatctttccccactttcacttttttttttcattgttgatcatttttgttataattctatttacttcaaagtaacaattttaatttatttagtgcctggagacttcttcttgtaatattttcaaagaaattattctatacatcactattaaatgtttgagggatgggtttattggatggataaactctaaagcagacactaaagcagaccttttggaattccagtcttataactcaaagggtgagctgcagctgtccactgcccagctctatggatttgagttcagcattagaacactgcatgaggtgtagttcttcaccacatgccatacccttgaaaatgtactgttttcaatatgcagacagtccaatccaagcaggtctcttgtcctgaccctgcactgccatacatagtattgtttggaggcccccaaaggctcacctgcttgcttggaagttgcagttcatagcaatttctggagacatttgttttcataagaatgaatcattagttcagttactaaaagcattatgtggatatgatgtttatcaaaaccccctaaaccccttgccatctaatagaaagcagctcttctaggaaattgcagataggattcttgaaaggaaaaagaggaggacctaaaataggagatgctttccaggccctggtgggagtcctagagagccttggaaaagacaataaagatctgtccaaagattcaggttgcaagcaggtgccaggaggacaaagagaaaactatctgagtggaagatggtaaatttgccaaaggcctagccctgatcactagcagtggcaacagcataaatgtgaaagcatatgaaacggacatagtcaaaggcctgacatgcaactcatctccacagatatagttgtgatggaactaacagttagccttttgcaatgtacattgtcacatccccacatatgcttatggcagtcttttgaggtagggcagatattatcatcttgattgtatagcctaaaattaaaaacaggcttatgagatcaaatgatcagcacaattgaaaataacaactaggaatatatgtactccagtgaatcttatgaagggaatattatccattttaaaaccccatattcatgggagcttatcaatatctaattttattttgttctcgccgcagccatgggtggggatatctcttctgggacctgatgtcattccccatctagatttcatgcagccaggagagctgggacagaacagaagcctgacttcctctgtcctggggaaaacagtgtttgcagctggctgactgcccacaccaccaacttgggcctctcctgcccactgctgggtaatgcaccatgggaaaaaggctggctttgtgacagtctaagtgccagagatgacaggcctgcctgctacccactcacaccctaccagtgaggtttgtcacctcttccacacagctcccactgcccccaagaggttaagccctgtcattttgtgtcattgccagatttcttatccatgtctctttttttgtagcaaagaattcagtgtcattaataacccctggtgatggccaagggcaggccccatgctatttgttatctgttggacacgcgttttttgatccccttctgatagacagaaaatacccatcttctctcttactaattggcagtatgtgccaggcttgggagttggcaacagccattgcttttcatcctttcagattacgtgttggactcctcatccaaaagtgcacgcttacgatgcggctaataccttcctcctgccatccagctcattaaggaataaaacccaaccctacttctgaagtggcacagagcttctagaggcagctgggctgctcatttccctgaaaggaggagatggaattaggctttctcgaagtcttctccaaacagattctagaagcataaactgtaggagttcctctgttctcccaaatatgccatgggtgtttgtattctgcgactgccataacaaattaccacacatttattggtgtagaatagtacaaacatgttaccttacagtactgtcaggcagaagtctggaagagctgagctgatttcttttctctgggtctcacaaggccaaaatcaagatgttgaccaacttggggttttatctagaggctttcggggagaatttactcccatgctcatgcaggttgttggcagaattcagttccttggggggtatggctgaggtctcacttccttgctcgctgtctccacccgctcaacgcctcctgcatgcttcatcacatagccaccttctccatcaaacaagcttctgatctctctgacttcctgtctgccccatttcctctgcctccagcaggagaaagttctctgcttctgaaggttcatgtaattagattgggcccacctggttaatccaggttactctctctgtacagtcccttttgctgtgaaaagttacctgttcaccagcttcaggggttaacaggtggacatctttgggggccattttgcttatcagaagtgggtactagagtttcccattcaatccggagtcatggagtgaagcagagcacaggggagcaaatccagtcctagccaggtcagacaccgtctattttgcctggtctctgacccatcaggtaacaggcataggcttctgacttcaagttgcctggttcacaactggtatctttaaaattatgtataaggaagaaatcagtttttatctctagcacagaggaaaaagagattatgctcaagaaggccgctggcctctgaggtaactgaaagtttggcccgacatttctaggtctgtgctgacaaatgcagtagccattaggcctctgtggttccagggcacttaaaatgtgactactgtgatttaggaactgaatttttttactatatttaaatgtaattaacaagagttaagggccacatgtggttggttgctgccatattgggtgacacaattctagatcatttaaatgctcgtcagtgtaatacaaatgtggatgtctgctgctttggaaacactacactaaagagtcattgcattttgcactcaagtgtccagagatcttgctttttatttttgcttctcacccctatcttttatttgtaaacaccctgagtataatagctctggagtacccaataagcataataaatctgcagggggaatagtggaaatatcaaagaacatcaagcagacattcctttccctgcctcctcccctccagaagccacgctgttccctcctgaggggcgcagcctgttgcaagtgtctctattcctttctccttcttgtgttgtctctctctcttttctgttgggaactgttaggggttagacacacagctctctaccctttttgaactcccttaagaattcacctctctgctgttgttcccgatctccttgatctcccctaactctactcagaaaacaccgtaaaggctcagcttcctgttcatcacatatgagatgctattgagaggggctccattttctaaataagccttccaaataaagagctgatccaggtcttcctcactgggcccctgtgggtgtgtgtgtgtgtgtgtgtgtgtatatatcttaattcttaagttttaggacattgaaaactaccacattttacaaagtgaagcatgaacagaaatgcagtcatttttacctctccttatgtaaaagaaacacatgatatgtgatacctttcctcaaatttattgatatcattttcatttgattaagaaaatatttacaaatttagtgaatgttcagcctcaaaataaagatgaatataagaagtcactggagaaaaacactattcgcttttagcgtttttgttttgtttttttgcagctttattgcccaggctgcagtggcatgatcatggctcactacagccttgacctccagggctcaagcaatcctcccacctcagcctcccaagtagctgggactataagtacctaccaccatccctagctaagaaagagatgattttaacaacaatgtcatccctagtatccactgttacccattccaccttctacttatttgattttcatgaaacaatatatccctctcttcatttggggagactttataatactggggctcaatttctattcattgtgaggatagagctcctagagtattcttattaacacctgcatctaacatgttgtgtacatagtggtcttactgacctaagaatataccatcaataaatagtattgacatagcaaagaaaaaaacagaagagaggaaggaaggttgcacaagctaattattgacacaaatagcaattaaatgcttggagccagcatcatctttggtagcataggaaccaggttcatccctagttccactactgagctgtgtaatattcaggaagctcattaacctctctgagcctcagcttttcaatttgtataacctcttggcaggattattgtttaatctttaagtaaggtaagggtataaattactgggtaccttactagacacagtcctttggcaaatattagtttacctcccttctctttttcagtgctccctgtcctacctcccagtgagagcgtttcattcagctccgaataagcaattactcttgaacatggataccactcctacatagagtccccagacatcttctggaatattctttttaccttcttaggggcacatgctgaactgcttggtcaccaaaactttttttttttaatgcttgttgtgtaaaaacaagatttccccttcctcaacagtttcttcctaagagtggtgtgttaacaaatagcgttgtacataattaatgcaatactgtgatttgttcttagtcttgaaacacattttattagacagttttccaaattagattgaaagaaacccatagacaggtcactgttaccaagttcaaatgtctattggaccttttcttgtaatataacctgtacacaaactgatggataaccctaagccagatgtgtgggatctgggcatccatttggcccagtcatttcagaggtgagactaaaagtaattatccttgctgtttacagcatttaaagggggaaggtagatgaattatctctcaaaacacaatgaataaaggctgggagcatggccatgccatatctgttgtggtgaggaaaatgggaaggggattctgaaagtaactggcctttttcttttagacactgagccacatccataccctaaggcacagatcccatgttaaacggttatttccatcatggcagtgacatttactttaacaacagatttcattatgtctttaacaacaacaaaaatgcactgaaaagcctgaaacacacacatacacaactcccaacacaattatttttctgtcttctctgaaagaatattttaaaatcatttcaacatctttgggatttcagaaaaatctagtattggtttacaatggaagtctcatagagtttatatatatgtgtgtgtgtgtgtgtgtgtgtggttattattactcagactataaatgagacaaatgaatagaaatattaaagggatcaatattctggccctcattatattgttatacagcatatctttgtgtatctctatgtgaattctctgctagtcctcagctgtatttaatccctcaagacttgatatacaaacataatgccaaatagagaacttcccttaaattattcaaatctccccataagtgatttcccactcttcctgcaatagaaaacatttgatcataaattcaattaaatcagccatcatctttgtgatgtttgtccagctaaatcctttagtgactaaaccaataaacataccagctgtgagtgtgcatgtgtgtgtgtgagtgtgtgtttatggcacaactattgcaaaagaatcgatttgaagtaaagatgaagggtagttctcatttcttaggccagattttaactacttcactgaagccagggcttaaaagattaaacttttagggataaaatcatgtgtacttctttaaatgctttggcttttatttgctaatttagaactgagttttaataagttttagatcaaaactgatgtactttggagatgttaggaaaaggcatcaaaccacgtcaaccattcttccttctctttcttccccagcctctcctccctagttaaaacaaagaaaaaatgactgtcgacatacttttaagtttctcagggaaaacggcatgataggactatattactgtttataatttcttatatgtctgtcggctgaagaggtaaagtttatcagaggcttataaatgttgattgcttctcatcttgattctaaagccttttagacacgcagatatacccaacctcctcccctctttttcatcttacctttactaatgatcctatttggatataactgaaccctatttatgcatcttcacatatgtgtatatccatgtggcctgtagagggcagcatgctctgaggggaaaaaaaaaaaaaaacaggcaactgtttatctccgtaaaatatgagatacgcagctatatatatattttccgatagcaaaacaagtaaaatgtctctgttagagaagccagagctgccccatgctttgtctgtccctctctgccacgttaggtgtctgtttggatgatgaatattttttatgaattggctcagcctaccttggaggctacttagggattacaccaggctccatgcctttgccaccaaatgggactaagcacatcattatatttataaagataaatacaaatggaatttttttcatttggctctcatttcttgtcaccctttactgaagtgtagaatttgagtcaagctgtacctatagttctaattttatttggtagtcaagtgggactttaccttcctatcttagaattctgctgtctcacatcctttgcttttagcttgtgactgccaaaaaattctagtgccttttatttttcccaagaaaatgaaaaacatttccacagggacattttctgttcagagtagacgttgggcttaaagctgggctccttcctttgcctgcctcacacttctttggggtgagtccctgatcaggaccccttctctgttgccacattcattgattttctcaatccagtctctaccgttcatctaaagaggcaaatcctcccattgtgtgaactacactattcctttatgagaatgtagaaatttctagaagctgcgttacatattttaaggatatagagcagtactgtccaatagatctttatgcattgacaagaatgttcgctatcttcactttccagtatggtaaccactagccacgtgtggctattgagtaatttaaaatgtggctagtgcaattgaggaactgaatttttaatttcatttaatttttattagtttaaatttaaataaccacatgtggctagagactaccaaattgcgtggtgcaagatagaacataacttctgatcagcttgaagcaagtgttttaccataatgtgttgtgaggtgaattaggattttcagctaaaaacctcctgcccaagtttttatttttgcacttatttctttattatatagctataggcttaaatccaaatcctatgactctgccccaggatttgctttctctcagaacatccgagagattttccattttcaaattcttcgattttgttgaatattgaatgtctctctcttgggtatccagaatggagtttcaaagcatggcatttcggcagcactgattctgtaggcgctggccatttcacagtctaagctctgtcactcgtcacctgtttgtatctagtgttcctaaatatagaaacacaacttagtaaatgtgctaaaatgtgtcgggctacatagaagcttgacacccagctcattaactaagttggttttgtttgtgtgtgtgtgtgtgtgtgtgtgtatgagcagctgtttacattgactacaaataaagcgtaggtttgtatcatcctttttgaaatgacctcaatattattttgaaaatgttcttgtcgccaggtgtggtggcttaagcctgtaatcccagcactttgagaggccaaggtggacagatcacttgagtccaggagtttgggatgagactaggtgacatgacaagaccctatctgtaaaaaatttatctgtaaaaaaaatattttatttatttatttatataaatatatatgtatatatttttatatatacatatataatttatgtatacacatatgtgtatacatatatgtgtatataaattatatatacatatatacatatataatttatatacacatatgtatataaattgtatatacatatatacatatataatttatatacacatatgtatataatttatatataatatatatacatatatgtatatgtagtttatatattttatatatatatatataaattagccaggcatggtggcatatgcctgtagtcccagctacttgggaggctgaggcagggggatcatttgagcctggaatgcagaggttgcagtgagccaagatcataccattgcactctagcctgggcgacagagcaaaaccctgtcaaagaaaaagagaaagggagaaggaaggaaggaaggaaggagggagggaaggaaagaaggaaggaaggaaggaaggaaggaaggaaggaaggaaggaagtaagttattttaagctcccaagtaatcagatgagtttttttttctctctttcatttctttaaatacttccatatctttacatatgatctgcaaatgcctgtcttcagtttcctacattatgccgatattgttagttttaagacatcagtagactggttttttttgccaccagcttctgattcatgttagagatatacccgaaaacctgcatgtacctggaagttataagtagttggaccccagatgatactcaatgtgcagcgttttaatcctatttatttgtctttcttttatttcagttataaaggtgaaaatgctgatcaaaaagataaaaagctctagcaatcatgccaatttgggttttcttaaagccacagatatgaaatgtcacctttccattataaatcattttatataaacagccagatgtagagttaaagtcaggaataaaggactgtgaaacaaaggttgtgctcagttccagtaaaagatagcctcagcctattttatgctcaccatcaaaccacactttggagcatctgtgcccccagatctacaacctcctccacatgagagaggaatgtagggtctgctgggagtcatactataagaataatttgaccagcctcttggaaaaacctaggcatcctcttaccacagggcatgacagagagaaatagaggccatgaagcttttagcagtgttttttagtaatgaactttaagactgggctcccatgcacaaagcaagttccctgccattgtaagattggtagcctttccgttgatgaacatgcgaattatcgcagaaaaatcgtttcactaaagtttctacaatgtagcaactgtttctgtgttgggaacagccaattgcaaactccagaagtactttaggctgtttgataatagcatttcagtcaaatgcagattcagataagcatagagagagaaaatgaaaagtcaaaggcaaggacttgcaactagaaggagaacacgaggtaccactacttaactcttcctcataacatagagttgaaatacatcctgcagatttgttgttaaaagtcactccttaaattacacattcacattctaatgtagaaggaaacgatctttttgaaagaatatccgttgaaagaaatacatgaatttttgttctaattatttgaaaatccctcctccaatgttttcatatttattgcatacatcacagagtaaataaattatttgccaggacttgaactgcagaacaaaaatgacaaacaaaaattttatgcatactaactttagcacctgccatgtaagactttgcagtattttctccctaaacacacatcacagttactcagaattctagcagatttcagtttgatactctgcagctctgaggactggttcagatgtgtgcgtgtcactctatttggaagtattcgagcataaggattgggaacgggaaaagaagaatgaggatgaccaagtagaaagcatgcttttgcactgttgcgttgatcaatctggacctgaggccagcatcctggtgcctactaggcaggaggaaatcaagatgtataaaactaaggtaggccagagaaacaggaaccaatcatggtggaccataaaatgaggaagtcattggacatttagaaaaaggacaaacagagtgggcctgaaggggagattggcaaagagagtagtatactttagtgtgtaacacagcaaaacacagttacaaaatcttcttaaaatttggagacagattctgaagcatatctatcaagagaatgtttctatctcaaggtacttaaaagaatattgaaaatatttgttcttaaggtacctcaccattatcttattttagcaagcatttaaaaacagaactaccatttgactcagcaattccattactgtttatatatcaaaaaagaaaataaatcatattaccaaaatggcatatgcactcacatgttcatcgtagcactgttcacaatagcaaatacatggaatcaacctaggtgcccatcagtgttgaactggataaagaaaatgtggcacatatacatcatggaatactgtgcagccataaaaagaatgaaatcacatcctttgcagcaacatggatgcagctggaggccattaatgttaagtatattaacataggaacagaaaaccaaatattgaatgttctcgcttgtaactgggagctaaacattgagtattcatggacacaaagatggcagcaatagacactggggactattgggaggagggggaggggtaaaagggttgaacaagcacctgttggttactatgctaactacctgggtaatgggatcattcgtactccaaacctcagcaacatgcaatttacccatgtaacaaacctgcacgtgtaccccctgcacctaaaataaatttacaaaaaaggaaaaataaataaaaattatgagacctttttcatatgagttcactcatgatctcaatcctctttacttcatgttttttcccattaattttaaattcttcaatgaggtttctcctaccaaaatattttcagggatgtactctaatttgggaaagaatattgcagtcctaagggactcttttaagtccatttagtaaggtcagtttaattttttacaagtgtagcggtgggggagaagtggtaatagtgcagtatgaagtatcactggctacacttgttcacggcacacgtctgtgcctcacagcatgccagaatgctttgtctgtatcatctcatttaatcccgaaaacaactctcaaattgttttcctggtaggagcatctaagtttattttacaaattttattttcctgtcttcagttattttgtagtctcaagagcagatctaggaagtacctgtctcatttgccatttttataccaaacagggctgagactagagtgaggcatgtaaggtgctcatcttgggttcagaatttaggtggtgtgaagaaaaatctcagcgatcaagataaataacactttaatgcaatatttcaaaaactcgaaagatagcttcagtaccttgtatgctctccatcagactacccttcattagcacccaaccccacatccacaacccacttcttcataaacaccaatactggtgaggttatagaaaaatgagcccattcatttactgcggatgtccctgtaaactggtaaatgtgaaaaacaatatggaaacatctgttagcggccataaagatgtcatggaacattcaagaaatttaatttagtatcttgatgctctggatgtttgggaatgctgtttccactcttatagaacttatcttctagagtagcgaggacagcaaacaaaaaatagacagtataatctcaaagagagctaagtacatgaagacaataaaacagagcaatgtgatgaaaaagagcactggcagcctgtaagcatatgaaagctgggatttttacttttttcttaatccgtgtccttagcgcctacaacagagcctgtcccatagaaggcactcagttcatatttgttgaagaatgaaagtgcttggtggtgagagtatagtgaatgtggggagagtgagagaagaggagactggtgagtgaaagcagaggccagccaaggaatggccctgcaggccagagtttgggattttcctttacttccaacaggaaacctgaggaattatgttttgaacctaccaatttcacttgttagtatttctcccaaggaaatagatcaaccaagtaaaaaccgagttgccccaaaattctcattattttattgtagtttaaaatttttaaaaagacttggtatcaacttaaccaagattaaaggaatggggaaaggtttaacaaatcatgattcagcaactcagtggaatattacacaacaatgttaggaaattacgtatggagattttaaaaacataggaaattctccctatgtttcctggaaaaagattaataaaaaatatatatactaacatattactataaaaagtctgtggactagctgttactgaaatgtaatatacaagatgaaaatggttgtgatacagtagtagaattttgggtgattatttttctactttcccaaaattatctttaatattgtcacattattttaataacaaaaatgttgcttaatttgtgtagagtttctgcttagggtgatgacagggttttggaaatactgtgatggttgtacaatattatgaatgtaattaatgccactgaattgtacacttaaaatgattaaaatggcaaattttcagttatttatctatattaccacaatttgccaaaaaaaaaaaaaaaaaaaaaaacagttatcttctataatcatcagtgtggccagcagccccaaaggtggctcccagcgatcccaccttctggtcttcacaccgttctctcttcatcccaggattggtcttggtgaccaataggatgtgacagaggttattgcacattacttccaaggttaggttataaaagattgcatctcctgtcttgggctctggctccttctatctctgatcactggctctggcaaagccaaccaacatgtcatgtgcccagccctagagagaggctcacatggtgaggaactaagaccttttttgccaacagccatgtgaacgaattaccttggaagtggatccatcagacccaaacttcaaatgagtacaaccctggctatcagtttgactgcaactttgtccctgaatcagaactacccagttaagcttctcccagattcctgatccttggaaactatgagataataaatatttgttgtttaaaaaaaaaagaaaagaaaatataaatttttttatcttgctttcattacagctatcctcatgggtatgcaatagacaccagctcttttttccctaaatttgaagtcttgttttctcctcttttaatggaagtgctgggtgcagcagactttattaattaacattaaaaggagtgctgtgcagtaaagtaaaatttatttatttccatctgacacctcacagtatcatggtcacaaagtcgagtgcatcactaggccttggcctgacatgagatgcctataaccatgtttttgcatatggaggagattcgtaaaactagctacattgctaagagaatattaagtggcaaagtgagaatcaaagtaaacagcccaagtaaaagaaaagtctacaccctcaacaggatacagcatttatggatgtcaaaaattttttcttttcacaaaagggaaaatgaaaagctaatataacctcaaaatggacttgagtaaaattcaggtattgaaaggaaattttattatataaaaacatattcgggccggacacagtggctcacacctgtaatcccagcactttgagaggtcaaggcaggtggatcacctgaagtcaggagttcgagaccagcctggccaacatggtgaaaccctgtatctactaaaaacacaaaaattagctgggtgtggcggcaggcacttgtaatcccagctacttggaaggctgaggcaggacagttgcttgaacccaggaggcagagattgtagtgagccaaaatcgcaccattgcactccagcctgggtgacaagggcgaaactctgtctccaggaaaaaaaaaatacaaaaaaaattttcagtggttaaaaaatacaaagaactaaatttataaattttcttggacctctatacatggagttaatatatctaattgatacaaaaaattatatctagattacacactaataagatttttttttgtatacattccaggattttctgagtgctctagaatcatcatgtcttactttcataatgagaaaaaaaaaacaagctataaatatagcctatagatggaatgatacagggaagagagctccaacatttgaggcgtgtaatgggctctgcctcacttgctgtgtgactgaggctacgttgctcctcctgtctgaacctcagctccttcatctgcaaggtgggatggtgatgatcacctcacaggctgggtgtgtagtataagggagatcacatgtgaaaaacatcgctagcacgtagtaaaccatatgtttccttcccctttgtatatcttcccccagtatttagaacaagggttccatctcctggctggccatgtcttctgtgtaatgggaagagatgagatcattcaccaggtagttggttcagtgtgcagttgggaagacactgtgggttagagaaggcagataggaaactccttgtaggagtggaaagcattgagagggattctgacatttctttcttagagaacagggcctgtgtaaaggatgctcaactattcagcagtcttaatccaattcttgctttagacataagccgtttatctttctttcataatgaaagcatatattttcaaattccagatgcaatgtcataagataaagaagctgaaattagagtgcccagcaaatagatttttcatttgctttgaactaaactttaataacccatgacctccgacctaactgaatattctctcattttgatataaatgggagcattatttttggtgattttctgcagtcctaaccatttaatacgtttagtctacaagataattttttagggatagcattaggagatatgcctaatgtaaatgatgagttaaggggcgcagcacaccaacatggcacatgtatacatatgtaacaaacctgcatgttgtgcacatgtaccctagaacttaaaataaaaaaagaaagaaaaagaaagaaagagaaaaaaaaaaagaaataaaggcaaaaagagatgaggaaacatctcttctatatcaacatagagtgctaaactatatattgcctttaagaaaagttcctttttacacttttcttattatcttggatcatgtccaatctgtaaggaaataaacatgtgaagaaagagttctgtggaatgttaactgctctgctatttttcttctttttatcatggcccaagattcaccaaagttgagataaattcaccatgccttctttaaaaagcgtgacagcaaggcattcttcctgtaggagtcagactgtaaaaggtgatttccttttactccagttggtttaagcctgtaaaaagcattaagtgaaaaatctgatatatttttagggcatttattgcattactaagttatactttcagttctcagtgaaaggtttattgagaacataaactttgaagaggtttgttcaggattaaagatatattttttcttctcttttcatgaaataatattatacaaaattatgcctttcaagagctatttttagtgctacttatagttgaaggacatactgttccaaaaccttcctctgatgatgagatttgtaacttctctagggtttcagaagaatgaaaggctaggtagccaccatttctgttaactccatttaccataatgcagatgcgccaataagttacactttttaccagagcctctgatggtgaaaatgtttttcatactgcttggataatttggactaaatatttataaccaatctctctgaaacataagccattcctaaatttttacatagactgaatttttggataaatgaagatttgggtttaaacacccattcaatcttttatcataaaaaatgagagttgtctgtttcagttgaaacagtgctttaaccaaccactttgaattcaggaaaattgggtaatctttattctccaaatagtataaatattcaaagcatcacaggagtataacattcactaacaatttactttgcttcactcttgatttcctaaaaacattttaaaacctgtgaagtcggtgaaataataagatgcctataatcgatttaagcaagttatggtaagaaaaggtcaatcttcacagcagtcctgtgaagtaggagagggctattaactttatcctaatctgtatccagaagttggaaaggttgtgagttacctaatgtctttcaggtaacaatgggatttcatacagggtgggtttgtgtggttatgaaggtctagtgcttattatagataggctataactgtaaataaaataactgggaagctggaaatcaattctgttgaatacatgtctttgggtttgaggatattctatgctgacttgtgaggttagacttttaagtattctgcaaaccttattctgattataaaggtcagttattgtaaatgtatttttcttctatcaagtcttctagtcagagggttgaaaagtaattattggtgcctcttttgctgtttactgctttgttgaagtaaaatacttaataaaaattataaaatcatataatcgctggttcactaaatctagggatcttttctaaaatataactgagatacgagtataatgactgacaggtttgtactaccccatatatgaaaaatactattaatgtttggtgatctctgataaatcataggagaagtttttaattatgctatttatgcatgtagaattatagtttaagtgcacatggattatagtgttctgtataaattattaaaaataaaacttcatcactgaaaacagtcactgccagtaggcactggggaagattgcaaaaggaattaaagtggaagctctgcaaaagcaatgtagtgaagcagttaccttattctgtcctgtagacagtagagcggaaacatgatctacttttgtaggagttaaatgaaaataagtttaaataaacgagggctcttgttgaaaagaatataacaaattcatatatattagtctatgaatattttatgataatgtctgtatcaatggatttatgaaaggtaaatatgaaaatagcatcatattagtacgcaggaaaggctgctataattatgtcataagttaacagatttttaaaaagcagatcaccctttctttggttttggaatgatcttaaacatttgaagacatctctttttccaggaagggtagaaaatagtaataaataaaatcaaggctggggaattactaccaagctaagctctgaaatccaaagcaagaatttaatattttcatttttctggcccacttttggcagtttagaatagccttagaatgtcagtgctagcattttcaaaaacttgattcatttcagatcctgctgagggctcttcaacactttctgtacttttccatcaggtagagttgactgcaagggcagctgtgtattgagtaagggttagatctgatggggagacctagcagtgtagattcgtatgattattcatcttgttcatgttaaggctggactctccccattgtccttatttagcataggacagtggaggtgttaacaagaatatagaaagaatagtctctatagcaatatagttcaaaattaaaggaaaagagagaaatatggaaaaatgtaatgtgttcttaaggaaaactttaggaataatctaataacccctttaccaactgagtaatgtacagctagcaataactctttggcatggcatgcaatggacactaagatgtaagtatcagaagtctgaatactccccattttgtaagcatgaccctttgatcatctggatcaaataaaataatacatgggaaggcattttgtgaactgtagagctgcctacaaatagcattattctaatatagcattggctgtcaagtgagctgaccattatgggaatgagtgtctgccagggagattgtggcattaaacaatttcattagaataagtgaataagtattgagtatttttatgtactaaaactacagcctatttacagaaactaatataaaaatgttatcagtttgttttgaggggaggaatctcattattttttttacattgagtacagtgagaaaggaagtcccagtgttaaacaactctgtgtcttcattattaatgtaactacgagtcttgcttctcatttcattgcacagcccagcacctggggttgagaagtacactgcacagggctgaatcttttcttctgttagtctttattttccccaagagtttattccaatgtcagattcactcatgttctgcttgaccaatttctgacccctccttgcaaaatgaataaatttaagcctgtttgctaaaagtaagtcattttttgaaaaacaaaagcagtgttatgaccatagtactccctctaagacaaaaagctttgataagagggggttacatgagcatttgagcattttgctttggatgtgtagacaagaagactgctgcatctgacagttctgttcagtagttaaggaaaacagacagacttgtctttattggtgggtggacttcttcacaaatcatccagatcattttcaagagatcagatgttgattaattcagtggccagcacccgcattggtatccttgccacagagatgtgcactgtcaattgaagggatccaggctctgtggctttgctctgtgaagagtgtgacggtgcataaagtatgagtatagaccctctgcatcactcactccaggttggttgttgtacttccaactctgtaaaagaaagcacactattatgcttcagacataggcccatagtgagtgtaatagtatcccgtcaccatataaaatgtaagtgaggaacattctagaactttttcttcccatttaagctttttatatggaattttgtatctccattgaatggtctaatatgtaaattacacctaccacacctttactctttatatccagttttcatgagctaaaacaataaattccagtggagagttttatagagatttagaagccacccttgggaacaaaatgtagcttgccttagttgttatacaagcaggtgtatcatcagttttagagggagtcttttagaactatagtgtaaaaaaaaaaaaccctaaatcaaaacaaacatccatgcagtcctagtttataagttaaccttaaaaaggcaaggatcaacttccttcccacttcaaaaaccaaaccaaatcagaaaaaaaaaaaagaaaatgacatcttccgggggatgtatagtttgaagaggttctttaaggaccaggacctgaacataagatgtttttgctcaaaaatgactgcctacttcttcaatttttatttctcaggtaatgtgaaacctctatagatataaccattgatatactcattactcaagcaaacattcagtcatttagcagatgttgtgtctccacattgtattagaaatgctgccttccggccgggtgcgatagttcacacctataatcccagcactttgggaggctgaggcgggcggatcaactgagttcagggttcgagaccagtctggccaacatggtgaaacctgatctctactaaaaatgtaagaattagccaggcttggtggtgtgcacctgtaatcccagctacccaggaggctgaggcaggagaatcgctggaacccagtaggcagaggctgcagcaagccgagaccatgccactgcactccagcctgggcagcagagcaatactctgtcaaaaaaaaaaagaaatgctgtcttccaggaagtagccctcttcgtcttgccacaaccagtggacctcctctttttcttttttgcaccaccatttttgtcctccactttccattccatcttttcaactttgatggtactctctagtctggcagaggactccaggtttactttgctctttgtctgttttcaggaagtcttagaaacttaggttagattttgaaaaagcgctagtttcaaggttgagtggagagaagtgagaggcactgtttgttcctttcattggtggcagagcaggaaattctggtaggtcagccctggcaggccagtacagctgtgctaactctccctgcctctagttcacaatctggttcttcccagattggaggatatgtagcattagagctaggacaactcttaaagacaatctattccatcttcctcatttctgaggtataaaaactaacctgtacagggaataaggagaatatcctgctctatattcatggtctaagactgtttttcactattcatgttaccttctttcatacatttttttaaaaaactgcaaggagaccgagagagagagagagagaaagagagagagagagagagagagagtgtgtattgcatggataaggactagaaaaatgcagaaaattctttataattagaagagcagcatactgttattttcaactgtattaaaagcacttgtttcatagttattcgcaatataagattctcataccacacatactctgaattcagtagggattgtttatgtcttgtcatccaggtttataattttaaaattccttagtttttttttaaaagagtttccatgaacaacaaacatctttttacaaaatgaatgtagaatgaacataacagtctcttgtcccacatacccttccaggtttttctgaccccttgtgaacatagaggctcattgagtacacccccaccaacctgatgggcccagttccatcagcctgaggcagattctcactcagtgacctgcgatagaacactgaaatctataggagggcctcaccattggcagcagcatctctgggtaggctggagcatcccttgaggcgtaattgggaatcccctcaagacaaggaagttctaatttcagccactcacaggagggcagctttccatccttaatgcctgaatgttctttgtgaaaaatctgcagtcttccatctctctaaatggctccatcttctgaatttttattatagtccccctgacctggccctctcacatggcccaatgttcatccttcttgatcaaaatgtagaaccatccaaaaagattgtccagttcccttttgctaacctctctcaccctccctccagcctatgtcaaacactgatcagttttctgtttatataattttggcttttccagaatgttgtataaatggaattatatatctataagaggcctcttgcctcttcactttggatgatgcatttgagattcatctagacattgtgtggtgaaaaaatgtcagcctgaatcaacttcagataattagtttctgagactaaacagaggtgacctaacagaattagttttaaaagagagagatggggcaatgaaagaataccagggagaaagacctaaaaattataagtgtaggtgattattttgtgattattccagggagaaagacttaaaaattataagcatagatgattttatagtaactaattagattacagggattataaatatatgcctatagggaaaaaaatatctcttctactactcctagtactaaaagtcacctaaaatgctggatacaatacaccaagcacgtgatttcagatgcgcagctgaaccaagaagaaaataagtaaaatctccagaaaggccaagaatgaagaaagacaggaaaccagaagaataatcaaatgctaaagttgcagctgccctgaagttgttctctaaaatagaaacatgaaaccacttggggatcaggaaacaaggccttcggcctgaagaaggtagggaataggaattgagattctccacacagagtggggaccctcaaagcacattagtgggcttcagtaatgtaattcagccccagtaatggactcagaaataactgcttccaacaaagaaagaccacaagaacaattgttggtgccagccttcactatggatggggatgtaaaagtctgatatgagaatttctacgtattcaggcttaaatttacacagtttgcatgctcttggaaaccaacagcaagaacttggagtacccatgtattgggagagcctcaggccttttgacagaagcaaaagaaaatccttatggggaaacacattctcaatccaggcctctcaggtttcccatagattaacattagacaaccatgggctcacaatccaaaaattataaagcatatgaggaaaaagttattgcaagtgaggatcagtagcaaaagcaacaaaattgaactctcctgtcacccagcattttaggtattgggagttatcagacatacaactatatttaaaatgttgtagtaaagaaataagatcatataaaaaacttaagagactatcaaaactgaataggcaaatttgtcaaagaattgaaaagaccttataaaatcaaaatgaacagggaaaatagcatattagatgcaattgattaaataattcattgaactgagcgatggctctgaagtaattgcccagaatggaaaacagggacaaacagatggaaaacatgaaagagtaaagacatggacaatttaatgagatcgcattgcatccaaattacaaaatgagagaagagatagaattggggaaagataatatttgaggggtaatggctgggattttttcttgaattgttgaagaacatgaaacctcaaattcaggaaacacagtgagtaccaagcaggttaaataaaaagaagacctaacattgcaattgcagaactctgaagaggaagagaagagcacaaagaggcagaaacaacagaagcctatggaataatgtcttcagagggttaagggaaaatgccttgagcctgcatatagaattattaaatatatacccagccaacccattatcctgtatgaaaacaaaacagaatttaccatcaaatgatgctcattgaaataactgctatcatttgtatttctggcacaaaaaaataatctgggagggaatgtctgaaacatgagaagaaaggtgattaaataaattagtaaacatgggtaaataaaataataacagtaacagtaataataataatgtctaatatgtgtccttaaaaagcatagaaaatagaaataaaatattagacaataatatgatagatgagactgtgtcattagaattaaagtattccaatatttttgtacacgagagtaaaaataaaattgaactctaaattttaagttaaatagagttaaatattaaaaagttaaggagccatccacttggagaactgagggtgaagatgtaaagtatggaaatttatttttatatctttgatggtaaaagatactaagccaacctacaccaagagaggtcactgctagctgcaggttgggcagttctgtagtgttcttggtcatgcatttgcaaagtttctgaggggcagtggagattattatcaggcatacagcatgacttctgtgcaaacaggtgaactatagaaagtcattaccattctaccaagcagctccatgagaggggttaactaggacacaggagaatcaaattaaaatcaggaaagcattttacaagagttttgacctagatgggtaaacctagggaacttcctttctgttgcctcattactgaattaaagaattggtcttgcttttcaggaggttcatttcacgtcctgttactgccatcttcatactccaaagcactgaagatttcaagtgtagtataaagtgtggtacattgaagtagacttcagttatttttacattattttttacatcatttctgtatgctttattcaaaaaatgttttcatttttaaataaccctattgagtgctttttaactaacataactcaaatgaataggtcaggtcatgtgaagtcacacacaggacattctagtcagtatgaccttaaatgaatgttaaaggaaatttaaaagtatggtcttacccagtagtgagaatatgtgaagcaacttacaatactgctcttgtgagaaagaaggcatccaggttctgaataatggtacactgccatttatccaagcctgttgatgactggttatgttttgtaaaatgaagtttcttggagaggctagttgttgtattaaatattactgtcatcatgttgctggttttgggagagctctagtgttcgttgtccaagcattaaagtggaatgaaatatgaagatgcagtaaagttcgtaagacaaaagtgaaatggaaatgttagaagcaagcagtttttctctttggagcagtattgtcctacaatgcagctgcacttcctagacaccagcagtcagagaaacaactcttgcagtaaataaaaccgggctacctgatgcaattgctttggaaatggaacttttaagacaggacccagtttatcaaacatattagccaatgtgtaggcttagcgaatgataagtctaatgaagcttctgcaggagtattggtgagcatttttaccaggcctcaagagcttgacagaattgaaacctctgtatttggattatgatcagcttgtttgaacactcagcaaaagatgcttgtttgtccaggcgcagtggctcacgcctgtaatcccagtactttaggaggctgaagcgggcggatcacttgaggtcaggagttcaagaccaacctggccaacatggtgaaaccctgtctctactaaaaatacaaaaattagccaggcatggtggcgcaagcctgtactctcagccactctcaggctgaggcgtgagaatcgcttgaacctgggagacagaggttgcagtgagccaaggtcataccactgcactccagcctgggcagcagagtgagactctgtctcaaaaaagaaaaaagagaagcttgttgttcaacacttaaagcatgtttaccattcgtttgagttgacctttcctgaaatcatgcagtattgagttatgtgttcttgaagtctattcacattcttgaatcttatcaatatataaggaatatagagatattgggtgccaaaatacccagcataatacttgtatgtttttaatgtcctacagaatttaaaacctaagaactgtgaacagtctatgccttctgtgatttattccttcagtcatttcaaacattaatagtggtgcctgtatggctatttgcctgccactatatgtttataactgccacatttaaaacagtgtacgtcagatttgtgtacccattgattttgttggctttcatccaagtttaatgatgatttcttaatgtctttttataaatctcatttcgtgctattatgaaaacctccattttgaaaatcacaaacctctggttgaaaagttcatgcaaagtccacattgcacagaagcacatatttttaatgtctgtctccagaccaaaaaagtcttaaagttaatttaatgtctgcatttgaggtgcaacttaaaagagaagatctgaaggaggagtgggagagctataaagtagttttagcaaaatgtgtttgtgttgtttaggacatatgctctttagtaaatattttttaaggtagacatgccttatgatggtagctgaaataattgttaataataaaatttttgaaaatcttgtaattttttcccatatctattggaagttgtttaccagctgttattgtttgaaatgtgattgttgtctatctcttcccaacctctcttgcaaaaagagaagttaacttctggtagtgaattgagcagaaatgtaatattttttaagcctgttgctctgtgtaacttaatatttgcatacttaattgttttattatacaatcagtgaaatggtaatgtatattgatgtccattcaaccatatacttacactgtctggactgtgtgtttccagttttgtgggacaaataatttgtcagcgttcaccagcttccaaaaacttgtgaaagcttaaacacctaaattgatgatgaatgcaaaaaagaagacgaaaaattaagaggaattaccaattacatggaaatagaatgcataacttctagaagttatacttctaaaatagttctatctaaaataaacccaatccaaaagaagacaggtaaagagaaaaaaggtaaaggcggacaaaataggatgcagaattaatctggtagcagtaattccaaatatatcaataatcacaaaatgtaaatggactaaactttctccttgagagatgaggattatttaattggataaaaattaaacttagctgaataatatttatgaaagagacaccctaatattacatgtatgaaacattaaaaataagcaggtaacaaaaggtatggcaggcaaatactaaacaaaagaagctgaggtcattatattgtattaatgtgagaataaaatgaactttagcctagaaagctttatgaaagataaagagtgtcatgacataaggattaaagactgaatttaccaagaagagataatagtgctagactgctatgcatttaattacccagccttataatataaaacaaaaattgatggaattccaaggaaagattgaaaaaagtctcccatcacaatgggagattgagaaccaccaccaccattctaacaatctgataatgtacacgtatgacttcagataaaacttccaattaagatatcatacatggattcccaaaagtatcatgtcttaacaacttaggtagaccgaaaaaagaggttctagtgatgacaaaggctctgatgttgaaaatgcatgtagagacttaaaatgaaatttctaaactaaaattttatataacaaatatgtattaactaaatatcacaaatgaaaatatgattattggcatattaaagtgtagtcaatttagtggggaatgggactatcttatattgatgaattccttatatgaggcatatactgtatttaaatatagtcaacaatttactgcagaaacagagatacaactataagtgtttataattcttcgagataatgaaaccatgcttcagatgtgattcatggcttcttggaactggagggactgcagacataatgtggttcatcactatttttcaatagatgagaaaaccaagatcaaaaatagtatgtcttgctttgtatttcatgttttttatactcttgacttctgagttaagtacttgtgcaccaactatcgcaatcacctttctcttcttgtatttacatgcaatgtaacaacatacagtttgggcgattaataatattcctttttttcttttaataatagttatttgtctgaatttaggaaaatgatagcagtattaagcctgaaactcagatctagtcctaatctggttgttctattttatcaaaactatataaaattgatatgaacatactgttcaccataattaactatgaactgtacattcaatataacttttaaccatgaagcctatctcaaactttgcgtttgattttttaaaaatatgaatgaaaagttgtactagtgataaagtcttgggaagaggaaggaataatatgaatggccctgtgccctcttaaaggggaaaaaactgtgaagaattttgagaatgctttcgttccctgtggacaaatttctctcttccagggagagacagttaaaaccaatccattgatccatttttttcgtgaacagccattgcagcagccacacattgaacccatttgtgaggccttcacataacaagatgtagagagaaagtctcttagtttggatctttgtgtaatatttttctttgcttttcccctttttccttctctacccaaatccattacctcatcttctcttcatacccccatccccaacaatttgaaataaatactaaagaattggttgaggaggggaaggaggagattgttggtcattgaggaaatatgtttgttggctaattgtgtcttgagtagcttcaaggatttttaaagaaatacctactggaaggtgcagctctccctcacccacttctggctgcctctgagagtcactgtatatattgcaccgggtttcagaaactggagaatccattgggaaatgcctttaaaataacctgtgagagaaagagagcatggcatatgcaaaccactttagagtcaagaagttctggatggattggaatctcctctcaacttgctacccaagtgatccactgccatctctgactcctacttggcttccaccactacaaaatagcaattgttaccttctcagactataataaatacgagtgttaaaagtgcctaggaaagtgcctgacgcatgttcaactatccagaaatgctagccattattaggaatacttttattatcattattatattaattatccaggcttgattgctctgagtagagaaatagaggttccatgaaaagcaaggctgagctggactgagaagtgctgctacccatttgaaagcttataccacatgaaagactttattattacgcctttttctgtaatcttgagacacatattttctatctactgttgttttaaaggtcatcttgaattgattcagccccgtatcatctaagcacatcccctttgctaacctgtttattaatattatgatagttgatatttgacagggcactgtttcagtaatgttaattcatattcaatgcaagaaaatataaattcttagaggaaaagaaactttagtaactggagaatttaatagcagttttattttaattctttagtatttgttattaattttctataaatatatccagatgtgggtatagtacatagattctattaacaaattctaataattatttgatatgttgtcttctgaaattttctacctctggacctagttttatcttttcggaaagtatcaatcctttgcctatagtagaaatattttaaatcaattatactgttatacctagagtaaaagtaagtttgaagtaacaaatactctgagaaccaacatgcattttgcttctgtttatttcagcaggtaatttgtttttctagccaggaataaattgaaatccagaaaaattaggtaagctttatgtcttatttagtggattttcttgtttggtctgacctctcttttttgctcatgtttttaggctcagctatgtgaaccatgcagaggacctggcctccaagctcctacaatgttccccaaagaacagactgtcggcacaggctgccttgagccacgagtattttagtgacctgccgccacggctatgggaactcaccgacagtgagtatgacaaatccacaacatccagtccaagcagacacatcattttattttggcatctgtatgtaacgtgtatgcagagattcacatatttgtgtgtccacaaacataagataatgtatgtttgtatgtgcattacaggtgtgtgtgtgtgtgtgtgtgtgtatgtgtggagagagagagagagagagagagaacaggggaaggggggccatgtgtatatatatttagtggaatcctgccattcatttgctagcttaccagacacaggaagaaaatggattccttttttgctatctctgctctgcagtctgcagctgtgcatctttgtatttgattatgtgtgtgtccaaaaaaatgatctgaacagtcataaaggaaaaggaaaatatgatttacatatttagtgctttatgcatacagtactttttaactggctgcagtacacagaggagccgatgattcatttctgtttgattctcagagaccatcttggttgtaacaataaccttaaaaagggctgctatgcagcgagctgaggagcagagttggcaattggctaatgcactgaattgacatgtacagactgaagacatgtaattcattttaactgcaaatgctcttggtatttgtacagacagctcttctctgaatcttttaaaacacattcctgggtgggttttgttttgtttttataaaagtctacatatttatacagccttttaaaattacattttaaatatttgggggaggatttatggctgggaggatctcagatttcttccagagtgtgaaacagaattcttgtgaaattttgtaaaaactattgccgtcagaatatttttgttcaatggtgatatgttctttccaaagaacaattagagatatttcttctatactcttttctgattgccttaaaaatgaacatactgcatatatacattaatatttataatgtgtttattaatccttggtatacatcacttacagtagacatatgattatttcttcattatcttggattttagacttctttcatccatcataatattggattctccttgatggcaataaccctttattttggaactaagttctaagtgcaactcctcttgggtatttctatcctaaatctttttttgatatcccacatttatttctcattacttttttttaaccctaaagtcactatagatatattaatctactactccccttaatgcttagcaaatcctccttaacatttcacgtatttccagcccatgtttactcaacactctgccctttctaaagtctactcactgactattacaacagctatcctcaattttttttaaattaaaaattaaatccctatgggaaaataattttcctatactgaaaacaaaaatgctgtaaataggctcactagtttacggctcatcacactcaaacatatggtttgttttcccatttagtgtaacttgtaacttggtatcactcctccttggtgacatctcaatcccatctgacttgaagattgagtttaagccaggattttgatggtctatgaattctgaattctgtagtagtacttttctgttaatatggacttattacccacttgccacttagtttatcagccagtggttaaatccagtttctatcagtgagtaaatgcctacacattatcactcggcagcagactgccaagggagacagccttgtccccgtcattaacaagcacaaagtatgcagaacaccagaggggaattaaaaccacaaaaaatacctcagggtggtatttttaatatgagaatttaatttgtaattttacagattaagaattttggctgcattaatccctttatcagctcacagcaggctatttgcagaagcataaccgtaaggcgatattcattggcagaaacacgtctttgcataacgttaaacatcaggagcagtgaaaccttttgaaggggggagaataaagatgaaaaatcattatatttttaaaccaagattctactaaatgcctccggtaacaattttgagttacagaaatgctatttctgtgtctagaagataatcattatgaggcataaatccagttgcaagaaaggacaatcccagtattaaatactatagtcatttccatttagaacaacgtggctgtacttgtaaacatgtttacaaaacaaagaattcccagactttggagacttagggaattggtttctttaagtgaaatgactggtttgggtgacttattatctaggttagtattctgcagagtatatttagaagttttttaaatttttataattaaatttcatattagcatagagtcttgtaaaagttcaccatctggcaaaggcagcagtggcagtggcagcagtagcagcagcacctgtaatacccttacgtatttcttttttaaggagatttggaaggagatccacctggaaagaagtgttacagaaccagtaaatggattgtcttagcaaccaagctgtagtttaggaacctcgctgtcttagtttggtcacactgcaataacaaaataccttagactgggtggcttaaacagcagacatttatttctcttggggatgggaggtccaagataaaggtgccagcagattcggttcctggtaaggtctttcttctcagtttgtgaagggcaccttgctgtgtcttcacagggtggagagagcaatctcttcctcttctcacaaagccattaatctcatcatgagggcccctcccttatgagttcatctaaccctaattaccctcctaaggccccatctccaaatgccatcacattaggggttagggcttcaacagatgaatttgaggacggacacaattcaatccatagcactctcattcttaaagatggctcatagcactttctaaagaatttccacaagaggaaaacacttatgcaagcaggaagcaaagtcaggttaaaaggagaagatgggaacaaaaataagttacaagtagatttgagccttcttggcctagtgtaatatgtcagaccccatgagaagggcatcaagtgtggttggagcctgagtaacacagagccctgcagtcatttcatagattcgtacaaaagtgaaattacgggcttatgtcagactctggctttggaagaatacatagtaatgtaatatctttctttagtatactattccttaaaacctcatcaggttacatagtaccaaaatttagaggtaatgtattagtgtggcactgaagcaggaattataaaagcagaaagcaagaataatggtacagttatctggggatctggctgttaaagctggctaattctggtggcaccctgtcattctccctctgtcctgaaaccccaacagctttgtcccacttcttctcaaagatttaattgcagggaagtaaatggagggctgatttagaagaaattcattacttttcccaaatacaccacagggcattctcctgcatatactatcaagttacataaataattgaagctgaactacccttgtcaaagtaaatgaacaaaatacacttcatagcacagagtccttgattttattacactcatttgctaattcacaaaactcaaattcagtgaaagaaggccaacaaatcggtacagtgtgaagagcactgaactgggaatcagaccacctggattgcagcttcagctccactgttaactagccagggaactttggacaagtgccttggtctctctgagcttcccatttctcacttaaggagcaagtgaggtgggcacagtagtctccagggacctttctagctctagagtttgtcgattttcccacatattcctgtatatgttctgtatatcatcctagaacagcataatgctcttaatgtagctctatgctgtctttttaaaaataaaacaggtgcacccatttcagatttaagatttgctaccttcagttcgtagactttcatgctgttttgaatcctttacaaccaggcttttgtgtccacaacgcctggctttcgaagtctctatccattggtcttttcccagcctatcgaagattcaacacaattgacaaccatctcctcctactaatacttctttcgcttggtttccaggacagtattctctcattgctttcctttagtttagaaaactaaagtctcctgttcacactcctttgctgatttctcctcatctgccagacctttcacattagagtgtcctggggctgaatcctcagatctgtctatctgcatggactccctggagcctagatgatctcatcccatctcatgatttaaatatcatctatacactggcagttttcaaatatccatctccagtcctgtcttccctgacttgacttgcatatccaactgacactcaacatttccatttgaccatctagtaggcctctcacacttaatcttaccaaaactgaactcatctttcccctcaaacttgcgccttctctagtcttaccgttgtcaataaatagcagcatcattcttccagttgatggaaggtatccctaatcatctttttttggttctactccacattcagttcttccacagaccgtattgttgctaccttcacagtatatccaggatcacgcacgccactcctcacttcactgctatcacgctgccctcagtcactcaccatctttcacccacatttttacagttgcctcctacctggtttgcctgcttctcttcttgcctccttaaagtcagctctcactgtttcttcttcttatattttgtgcttgctctccctctagacatacgcatggtttgccctcttacctcatttgattctctccaccaatgtcccttctcaggagagacttcactgacctccttccaccctaaaacctccagtttctcttctctgctttatttttcttcataacatttaccactatttaatatattatatctgtttggttgcttattgcctgtctcccccaaatggactctataacaacagggatttcctttcattctgatttatttagtacaggattctgaaattcccagaacagtgtgaggctcaataaatatttttccaatgaatgagagaatggcacaaaggaagggcaaaatatgttgtttcccaatctaagttcattgttctagatcagagaaatgtgggagatagtctgagctgtggttctgagggaaagacagaccatcctatcatatgtttgcaaatgtgtgtgtgcctgcgaccacctggcatttcaaagatcaaaacataccatgatgttcagtgtgctgggcatccaaacttgcatctcagtctccatttttttaaaaaaaaaacatgattataaatatctataactatataaatgaaaacttcatattctgtccacagtgtcttctatttttactgtcccaaatgtgagattgcaaccagaagctggagaaagcatgcgggcctttgggaaaaacaatagttatggcaaaagtctatcaaacagcaagcactgacaagcagcacattctcaagagcacacaggtaagaggacctgctttacctggaaagtaatatttaatggatattgaacggattctttaagtgaaatatttcagactcgttttttcaccaactatcctatgagtctcttgtgtgcattatggcattcatcagacctattgagatagaatgcactcagtcatttccatattttcaggcacctactagattctaactaaaattatacttatgcttttatttatgtagtcataggcaaaccattttagttataagcaagtcatcttaactactcacattcctcatggagattagaaaaaggttcactttgggctgtatctaagccacagacctactttgttttgcccatgcaatttttctaattagttgttctcattttaaaatggggagattacacacaaaatctagatttctggttttccttgaaaaataagcaactctagcaatattgccttcacattcctaccagaagtgtttgcgtgtaactgaatcattgctgcctcctttggaggggatgtagactccccagtttagtttagctcccatctgggccacttcacctatttctgattcctgtctggctcctggtacggaccttatcatgatgaagcttttctctttcactatcaaattctttgtcctctactattgtgcagataggaagcataatctaaacttggcaacctctagccatgtcagcctggcccagtcatcacatcacgtgtgctacgtagtgaccagcctgggatggcaacttctgaaaaggccatctttcttgattgccagatggaaatgcctagtatttttggaaaatttttagtgtgtgtgtgtatatatatatacatacatacatatatatacatatacattcttaatgtaacacaagtctctgaaacaaatagagaacaaatgttactgtggagaaggctttttatgtgctgatttgtagagaaaagtgtgtctttgttctgatattcagtaattaagtgttcaggccagacatggtggcacatacctgtaatcccagcactttgggaggccgaggcaggcagattgcttgagctcaggagttcgagaacagcctggacaacatggtgaaagcgtatctctacaaaaaatacaaaaattacctgggcgtggtggtggcatgtgcctatagtcccagctacttgggaggctgaggtgggaggatggcttgagcctgggaggctgaggttgcagtgagctgagattgcaccactgcactccagcctgagtgacagagccagaccctgtctcaaaaagtaaataaataaaataaaaagtgttcaagtaactcaaaggatatatgcagcattgcagtagttcctcttccttcctccctctcttagtttgaaatatgttaacaggctaaattgatagcatggtaaagagagcaaattttaaactgtacacattgtcttgtgggtaatctgccagtatcttgagctacttctggacttagcttttgaataccctcaacataggggtcaattttggcctatcaggggcatggtggaaagttatgaatgatttggagataaaagatctccagataaagtatgatgtataaatgacagtcagaagatgttactgttaaacttgccactccataggtaagagtcttcattcttcatgttatttctccctgttgaataaaaagcacaactctcggttgcatttgtactcccactctgaatttcaattggtcagacaaagagtggggctaggtttttgacaagctacctcctggtattgagaatggttttaattcatgagggttacagcatatgcttttttaaagtatttaacctgcattatcataatgagggccctggctttataaatcccttcaccaattcagtggaacaaaacaaaaagtggactttatttgtgctgctacctcatacacacatgcacacaagcaagcctgaatttcaattgcaaggctgtgttcctcttcttggctcttttgagatcccctgacctgagcccagccagtcaaagctgctagaacgtgtttcagctcagctcctctttgggaaatcaaatcaagctcacaggacagaagggttgctcagaaagtctcaaaggttgctaattgaaaagagatttttttaaaaggtgctcagaactacagtcatcagtatataaaagcctttacaaaaatgtaaaaatgtattttcttcacatatattttttaaactagatgtcaggttataacacagtagaagcttttcctctagaattatttgatagcaatacaaatattttttctatgacgtttgcctttttcacatcaacttgtaaagctttttttttttttttgagatggagtttcactcttttgcccaggctagagtgaagtggcataatcttggctctctgcaacctctgcccccgcctgggttcaagcaattctcctgcctcagcctcccaagtagctgggattacaggcacataccaccacgcctggctagtttttgtatttttagtagagacggggttttgccatgttggccaggctggtctcgaactcctgacctcagttgatccacccaccttggcctcccaaagtgctaggattacaggcgtgagtcaccgcgcctggcccaataaagctttaatattattgttggtgtagttttcttcccatccaaatgcctcagcatgattcaatataatgctgaggaaacaacccaatttctcagaaaagctacagggaagatggattctaagagttttctgtcagtcagcagaaaaagaaattattttaatgtctcacctttgtggagtttttaaataaatgggaccatcttcgagatcaaataatatagcctatttattggcctattatatcttgtggaatggcctttctctgaccaatactgaatatcatatagacattatagagcaaaatgtctatgtagataaggtatccttagagaaaaatctgtaatttcttagactttgattttgcgttgctgttgaattcattgactgtttagagaaggctttggcatattaaatttcctcaaatgtcccaattctttgtaatgcctagagagattgggaaggagagggaggccaagggggttgggggctgaaggagactaaaactgggccggccggcattttaaccatctctctttggggagttacaaggaggtaaatgtggaaaatgcattatattacttctgtctttgaaatggtagaggactgagtagacaagaatgtttcaagtcctaatttttcttccaaacctcaatgccaaattatttctttccttgcataccaaggtcacttcaattatttagttaataatgccagatttgcataaattggtcttagtggaaaatctaatgagatgcatttggctttgcagcagaaagcaattttggtttcagagtcttgtaaccaaattaaataagaagaaaaccataaatacctaagttaaaaatgggataggtgccactggattatcaaaatactgtgcttcttacattttgttatcttctaaagatattagtaaagatttcatagattcttctaactcattttatcagcactgatgggtaagacccttctaaagtctgagagagccttaaatatacatagaaattttccccaaggaaaagactggaagctgtattgaataccacatccattagtatgacttatttttgcatgcagtgataccaaacacatccctctggtgagcttaattttccacttactctaaactggcatagaaagtgcatggtcactctacttctcctttagctaaatataagggataagaaaggtctctattcttttagatatgttttgtaatttttctgaaatagtatgtgctcattatggaatatctcttttcaatgaatcagttggttcacagaccccattcctaataaatttacaaatgtttgtctagtgcatgaaagaattttatttggttcaattgcaagaagttaactgcatgcatgttttggtgaccctctccttaccttttagcctcttatttctgcaaatccacattatgtaggaattacatgataatgaaaaaaaaatgtgtcggactctctacttggtcattaagcagtaatttcctgtaagtaggctgttaggtaaacagagtagaatgctcaatgaaatttaattaaatgagataaagatttttttagaaacctgcttttagacagaacacaatgcactggtgcttaagactgtggcagcactgtctgaacgttagtagaatggtggttcttactcggtaggccacctagagctgtttgccatctcaaccgccatctcaactctggaaactgctcctaaagaacagccacctattgctctcctccatgctgtgacattatggcggctcactttttctgtctttgcatcaactaacacagctttcatgttcccttcacttcagggcttctgctgacttgtttctgcttattcatggattctgcttattatcatttctctttgtccctctacttctggggcagtctattgctgacctctttttgcctcagattcaaaccctcccagagagtggctctgattgatgtagccatcatcatgaagcagagagcaaagctgttgtgtcagtcacccctgtagaaactgctgactgacggtaggctgccttgaggtcaggctctgagccctgatccagtcagctgggcccagaactggttggccaacctgtttttaaggaagcatttggaagagactgctgggcttagcccttcagaaacttggagaaggttttggaaagcaagcagtatagctggaaagtgccttgcctggcctgtatactactgagtgaaaaatcaggcaagtacagagagaaactccagttctgatggtgtgatatcttcattgtatgatatttttaactattgactaaaggtccttttaaggtgtgttgcattttctcaactatagacacaaacggagataatatccatcagcacttttcaatatataagaaacacaagtgttagatctaggtttctttcagtactaggaagatttctggggtttttcctgcaaaaactgccattttctgcattatcctacaatttttttttcctattaaacatctgcagttttattatttctgttatctcatgtaattgacaacaattgttgaaatgacgcttagaggggaaacaaaccttagtgttctttgcaggtttcatctggaagattccctagttgttaccattacccccacatgactgccaattaaaaaatatatcttatttgggaaattgacagcactttgaacctcaaatgcatgatgcatattatgaatatccaaatgagaagaggccggaatgctattagtttccccacctcacctcaccccacctccaccccaccttaccttagcttcctgtctaccctggggagtctgttctatcctttaaacgctaatgcaagtttgtttcttctctcctccttgtcccttctctgcctctccaccccttcttttctttgggtcaactctgatctgtactgtgcaccactaccaccctaaccgcatgcaagtgtaggcagaggactcgcaggctctcaccacctactgggattgtcacaaagcagaatgaaaataaagttgtatcatgcttccttcagaatgcattcttaaagcatttttgttttgttttgttttttattttgttatttgttttttttaagagacagggtctcgctctgttgctcaggctgaacttcgtgtgttcaagcgatcctcccacctcagcttcccgagtagctaggactacaggtgcgcaccaccacacctggatcatttttaaatttttttgtaaagatggagtctcgctatgttgtctcagctggtctcaaactcctggccttaagcgatcatcctgctttcgcctcacaaagtgttgggattacaggcatgagcaactatgcccagccttcaagcatttttttttatattgacataatttcatgtctacagaaaagatgcaagaatagcacaagaattcctgatacccttcacccactgtccccaaagtgttaacattttactacattagctacatttgctttatcatattaattctctccgccatcacatacaaatttgtgcacacatacattgtttcactaaaccatgtatgttactcaaatgaagctccattatctttaaatatttaactgtgtttttcttaaaaacaaataatttagagtgattttttaaaataaaaataataaatttttgccctttctttccttttttttttctctgattaaggttttaaaaagcaaagtggctgaaagagaggaaactggttgatgcttcacaaattggttcatcagcctttggatccttaaaattgactatatttttgtgaatcagcatttccaggtcaaatgagctttcaaaatggtgaggggcggggggaatagcacttgcatcttctgacttcttaaaacccaaattaatttcttagggactatttagccagcagcataatatgagtgaagctttcttataaatagtgggcccaagctgtgatgtggctagtaaccacaatatttattacaaggaagttagcagtcacatatagaaagtagttagaatcagttcaggtgctgtatttttccttttcatttaatgttgattcttatgaatttgggatacagaaggaattgtctatgccctaagtgcactgtattgtattattaataccagtatagcagctgagtcccactagacagtctttgtggtctgctgatactctaagaagtgtctaagcataaaaggaggctgtttgagttgaagtgggctgatggtctgggatgacatttgaatgcacagaggacaatgtctaaatgacaatgtcgagaaggaaaggcaaaaagaagctgaaaactattcccgctgtcccatggatactcgtcactccttctgcgatattcttcacatgggagctttgtctgggtagaaatggggagtgggatcagggagggctagacactggggcctggggacaagagccagggtttcatgtccttaaacacattaaaattctagacagatagcaaatgtaatgaaaattgcaacctgaatgtgttctgatagacaaagttaaacactttagctaaagtattacaagtataattaacaaaaagtttgcaatactctgaattgcttctgtgaataaagcttttaagagcatcaaattggttgtgcaaatgaatggtttactgagcatcttttggaatttaggatagctgctttctctgctaaccaacgcatgcacacacacacacatacacaaacacacaccattcatacagccaaaaagaataatttttcagcagtccttgagttgtgaagataacatcatagattaatcaaaggttacttttccatttagggaaataatgtacacaatctagaaaaaaaaatacaaaagttagagtcattggtggaaatttatctcattataaaaataaccctgtatgctaagcatggaatcaaatactgaactgttaacctcaatattggggtgaattttttacctttaaattatcaccattgtcttaatgtagtttgcattacgtatagtgcccttggatttttaattgctctggattatcattttcaatgcaattagtaaaatgccctcaattacatataataattactgtaaatggggctattggcctaattactataaatggggaaagatgtgtgattataatgtgcaattaaatcatgtacagtatttattttacattattacatacaatggtataatgataacacataattatattgtatctttccttggtcaacaaatctactccatattaagatacctagagttgtgatacattgccaaattaaccatctccgggatcattcttcctaaaataatagggttattctgtgggccaaggccccactaagtttaaatataattaaataaactgattctgcacaggcaggaaaaatctggaaggaaaaaaattatttcacctctattagttaagaatgcccagattatcctctttttgtcggtgtcaagaatttaatcctccctggcgccataccaacctccaccatacctgtttgtttttatgtgaatatgtaaaaattaacacccctaaatgttggtaacatttaaaatatgcctgagaaaaaaagaggttctttcttcactgtggcaagtattataatcatccctagtttacaaatgcacacttaacgagcttatagcacataattaattctgcaaaggatgctgtttgacagagtgggattatgagaattgcatattgatagtggcaggagaaataaaactattttctctacgtaagatgggatatatcttgtgttctttagaaactggcacatctcagaggtgtagctctcaaaatgatctcaggatgtaaagaaatcagtaattacagagccaggcattcagttgtgtcctaattttcccaccagtttttcagtgtttcagctgcctcagagacttaaagtattctcattaggtagctgcagaggcagccgcttgcctactccctcattctctcactcgcttttcttttttttatttttttttccttccattcctgccttgggagtgactgtgaagatcatttgctggaatgattggcaggttagaggattcgatcagatgagttcctcttagtgcaggtcaaaaaggctagttagcaggagctgtcgaaaaatgccagcagcattcgaaatgggaaatgtcatgacttcgaggcagggggtgccacctggaacagaaagctctcggctcattagcaagttacaggatgcgggcttaactggagggagcagggaaggaaagataatacccaatagggaaaatgattgtgaagtggaattgatttcatgtataatttgtttatcactagaggggacaaatgctgtccttctgacatgagcagaggagtgtggactatgaatgaagcgacttagcataatctccaggttgagctttggatttaaagaaagcaaacttctttattcttaactgtggaaatgatcaggtcatgttacattaattaaagctgacatactctcaaatgttttatctgggcaattgcggcaattcgacagaagcggatagagatgggcaacttcagaaaataagagggattttcccccctctgctagtgtggaagactagcttagttgcatactgaattataacagggttggtgtttatactcagtggttagctaggctgcacatatcaaaccagggttccggattcacgtgcagtctcattgatagaagagaccacatgccctttgggagatttgtgtctaatccatgtgaaaaaatgtatgtacattttagaatatgactgtgtcctattttggtacaatgttaaaattttaacttctttttttttaaaggagaagttctcccatttcattgctgcctacatgtcaattcatctagaatttaatattctactataaagttaatttacagtaaccttatttacaaacaaaactaaactaaaaagttgctgttatagaggaaattaatctgcagtttataaaaagagaacacagtggcaaaacagaaaatagtattgcctcgcatgtattcatactaaactccaaattaaaggcttccagtatttttacaatgtatcaaatgagcttttgtttaaagcctttttttaaacataaattccatccgaaaacgtattttgttttgataagaaacttttatgatatcatttatcttttggcgtggagatcttcatcttgttaagtcacaaatgccacagctgcaagtctttctggctgaacactaaaggatgtttacttagcatccagattctggttaaaatgtatattttcaaaatgtctttgccttgggtttctcttaaatattgagacattttatgaggcagttgttaaatagccaaggcttgttttatcaagcagcctcagactgctgtgtaatgtgaataggaatcttaaaacctcctagtccaaaacactggtgcaaaattcattccattctgtattcagcataaaaagcttagcattaagctactgtatatagctttcaagatatactgcattagttctgtcaaatataaaaatttaaacatcagtgtgaatccactcatcccctcatttgggaattgtattgtgtggtccagaagctggccttgaaaacaaaatttttatagaatgctgtctgaaatgttcacctaacgttaagattttttatctttcacagaaacccaatttgttaataactgacagatttattagattaataaataaacaaaccactttgagggaaaacattgtcaaaaaaatgttataataaaataattgggtatagttgtctacaagtaacaagtaggtttcccagtctgtacctttaagtaagaagcccttaccgtaaactcaagacaggcaagttgaaggctcctggccctgcagactgcaggggtgaattggtggtgtttgtgcatgcctggtctcattgcctacccttttctccagcccctcctttcaattccgcattgcagagtcagctctgcactcactgacttcttagactctccactattttacattcttctcaatccatctcctctccattaactaattgctggtacatattgacattcttatgtttatcatactctttgttgaacgtttccacaactctgtggattgagtaaccatgtgttaaaagtcttactttcagttttgtgggttctcctcagagaaggtccctggatactaaagaaaagaaatgatagttttatcatcgtcttttatgtcagcagatctcaaagtgtggtccatataccatgtggatccccaggggcttcacgcccagggccttcatggggtcaaaactgttttcataataacactaagatattctttgccatttacactgtgttgacatttgcactagtggtgcaaaagcaatggagggtaaaactgctggctccttagcatgaatcaaagcagtgacactctaaactgtattcctgggcactgtgtcttcacaaccacacaattcaattttggagggggcggaaaaagcttcacttaataatattcttgatgaggaagttaaaagtattgattttattaaacctctacttttaggtaaatgtcttcttaatatactctgtgactaaatgggaagtttgcctaagtcatttccactggatacctagttaccatggttgtctcaaggaaaactcttgtacagttgtttgagttgtaagctgaactaactgcttttttccaggcatatggtttttacttgaaagaatgactgacaggaaaaactatggttattcagacttgggtatttggcagacatcttctcagaaaggaaccaaaaatgagttcatcaccaaagcaaaaaaccagtattaatttgttgataaaattagagctttcaatagaaaatttgaatttgagaactctatgggtagcttttatttgccactgtgaactggacagtgataatgagattggtggtaatataaacaaatgtgatttttttgatattatatagtgaaacgtgtcaacctttgaaatacctgcataactcactaaatcaatgttttccaaatgatcaatgcatgttagcaaaataatgcatggataaaatattcactgaaagtttaaaataaaccaatagatattaaggtaacagaatacgaagagttcattgatatagtttcagattccctggtacaattaacccttaagaaactaacacttgttgagttttgttgtactgtaaaagaagaatatatctgaaagggctattaaaatacttttttcttttccaactacttatctgttgtagtcccatatttttgtcatttgcttcaaccaaaacaatgtatcataatagattgaatgtagaaacatatttgtgaacccaactctcttctatccagccactcattgaaaagatttgcacaactatagggcactgccactcctcccactaattctctttggaaaatgtagttatttttatttaaattctgttttcatgttaacatgtaatgagttctcacataaatatttttaattaacagttttaattttgaatatggtaagtatcagcagctacaaaccatagaagcaaaagttcttagggggttccttttaacttttaagagtcttaaggggtcctaagataaaaaagtatgagaaacactgctctatttcacaagtgtcatgcattaactctaacatacaagttatgttggtaacattttccttcttgaagaaattactattcagcacaaatttttttttgctatatgaaatgattctggatctctcgatttaatatctcaatttttctagtgtacaatagataaaaatccctattcttgtgttcacacaggtatcatctgaaaattacaatagagcatcatttactatcctcttgatgactagtagaccaaatcttgaaagacttttactgtatattaatcttaggggctgtgactttccttttttatatgcatcaagtttgacctcacatggagagcctctggccatatgatactaaatcatcaggccattttacatagcttgcttataggactcagaaaggctttcagatagctcctattagacacagcataaattcaactttatgtcagaaaacgggacttgggtcttttcccgccgagctcccatgaagtaactcatggaaatctgggtgcatttggggtttcagaatccagaatatctgctcaacctgagtagcagtcagtcagattagggctgtgttctttagttttttattttttttttgtttttgttttttgaactctattttgaagtacttttagattttttagaagagttgtaaagccagtacagaggattatgtccttaacccaccttctcctaatattaactttattttttatgacctggatgcttttgaagagtactgttcaggtattttgcagaatgtccctcatgatgttttggagaagaataccactaagatgagatgccctttcaccacttcatgtcaagaagtacatgatatccacataaattatcactggagatgttgaccttgatcactacattaacacagataaggttttaaagccaacgtgatatccaggatgtaaagtcagagaagctggagatctgggacaggttctcagtcaaatggaaagaactctaaatggttactgaactgacaacaaggctgtctaatgtcagaatctgaagagagaaattactctcaaggcttcaactttctaaatgaaaatgggtggaaatggagacagagtcaccaacaaagcagggaatgtctgagttaagaaccctgagatgttccagcctttgactcaggatcagtgatagaatttataagggcatctgacagcgtgtggaatatattttgtaaacatgaataaaatgtggctactttacagatgttgggaacaaagcaagtgttagcccttcagtattgaagtcacctgttcatttgtcttccttccccactggaatctaaatatcagaatacaggaactcgtttacggttttatcctcattttaccattatatttcccatctcctcgcatggcacataatctatgcccattaaatatttttgaaatattgattgacttagtgaatatccaaccaactcaccatacaccaatctcttgttcttttaggaagtttttttgttggttggttggttggttggttttttagcaaccactatattggtgctctactagacaatagtaagaagacagttccagcttcaagacactcacaatttagggacacaaatgcagtcttttaaatttcaggatgatgacgggtacagcagaactttgcatgaagctatatgggagagcaaataagggaaatattaattttgctcgaggagatagcagaagtttttccaaaggaagagattttgaacaaaagaaggcattggattttgcatgggcatacaggaggagaaggatgttttcaaaaagaggaaacaaacaccaagagcaaagctgtgtcacaaagtgcagcatctctagggactgatctgatagagctaaggggctgggagatacggagtgagaagacacgcgcagagaaagtcatttgaagcccgattctgagggtcttgaatgacatgctgaagagtttggattttcatgttgttgcccatagagaatatgtatgacttcctggtcacagacagaagaaccaaaacatcttcaagctgagagatcctttaggaatcatttaacaatgctaaaggaagatgtattttttttcttctttgaacttattatgttagatcatgtcttgaaattaagtaaagaaaataaacaagattccattcacatttatgcctaatttgatgttagcaattttaccaacacttactcttctccttctattcatcctccagccatgacattttaaatttcaggatgataaagggtacagcagaactttgcgtgaagccatatgggagggcaaatgagggaaaaattaattttgctggaggaggttgcaaaagtgactgcaactctgttgtgactctgttacagacatagtttcttgattatacatttatcagcatattacaacatgtttcttaaaagtaatatgtaaattattttaagttaaagaatatgccttttctattcacatatcttttgtaaaatgaataacaatccccttaatttaaattttgtgaatatataatatttcatatattaagatacattggtatcatttgggagaaatgcaaaaaatggaaaagcgagtttctagggataaaaatttaagacaattttcaaagttaaaagaaatgtttaagaattcagtatcttcatggtcttgtatactcagcagtcaattggtgtgcaaaagtgtttttatgaataaattcatactcctgtctatgtactttaagtccctgtaagggttaactgtagtttcaggcccagttttgcctaaactcaaatacactgtgaagtatttgacaatattaaagtctgtctaaccaaattccttaaaccaccttaatggttagtaactaaaattttcagggataattatgataacaatgaaaaaaatgttgaaacaactaatgtaaaacagattaaacaaattattaagaacagagtagaccatttaaatattttaaaaataaataagtaaattaaagtttaccaaagcagatgaaatatgatacagtcttgaaaattgaagttattaagccaagtaacatggagaaatacatgggataaagtgaaagtagaatattttgcttgtacatgtaaaatttatacataagaaatatgagtgaaaggaagtatattgaactgctgtgtccttactttaacagagaagatggttttaccgattttattgtataattaagaaagttagttaatttacatttttatagccatattaggctctcactatattccaacctcagagtccccttggatgggtccaagttctttgacgctatctcattaccagattctcctctgtagatctatgttgaagagtcagatactacgcaagctaagctcattttacaaccacagggcattccatgagttaacgtttaaagtactttctgttacccctaagaaatgctgataaattaatactagaaatagcagtatccagatgattaagagatagcatagaaacataatttagccaaaagcaaaaagaggagctaaaggagtcctgtcggcataagaatttgggactccggattctccacctgctgctaatctcaatgggcttttcaaaaggtgagggctttttgtggggggagggcattgagtctttttaatgaaacaatatgtactttcctatgccaagactaattctacaacattgctttgtgggttgagaggatggagatgttgcaaacagccatgactattttccagtttgatccacttgactatagctcaacagcttgtagctaaagtctttgaggtaaataatttttttatcacttcacctcatcccctaaatatctcctgatcatggcattgttgacctacctgcaagaacatgctacagtcctcagaggtccactgcccgcttgcccagacctgaactatttgcaaaaggtcagaagttaagattcttgaccttatatatttcttatctgcagctaaggggtagaaagactgggaaggcaaaatcattatcttttgtttgtactctttgtagtgcagagtgcaaataaattttgagaagaaaatttctattaagaaaatgaatttaggccgggcatggtagttcacacctgtaatcccagcaatttgggaggccaagacaggtggatcagttgaggtcaggagtttgagaccagagtagccaacatggtgaaaccctgtttttactaaaaatatatacattagctgggcagtagtggcatgtgcctgtaatcccagtgactcgggaggctgaggcaggagaattgcttgagcctaggaggcagaggttacagtgagccgagatcacaccactgcactatatagtctgggcaacagagtgagaccctgtctcaaaaaaaaataataataatttatagaattttttgttgtgtgtatatacaaacatatcttgagaccctgaaccagcttattaaattggccgttttatgtagtattcaaatatgtatgtatttacatatttgtatacatatatatttctgtcaaaaaaaagcagtgtgtttcattttaaattttctttcacttgtaactttccatgcagtgcttcattattcagtaagctctgccttttgaattgtttattttcccgtacttttcaatttccaccttcacttcatctctttacttgatatgttaccagggaggaacaaaaaaagaaaactgggggacagagggttgggggtgaaaaggaggcagagggaggaagactgctgagggaaaaaaaaagatttaaatgagaactagaatgaatgcctcacttgttggcttttagcacaattaccataccttaggaaatatgcagggaatagttaattacaagtaaatgagcccccttttagaggcagtggcaggaccaggcatctgactgtcagagctgtgaaagatattgaattggaaggctggtctcagtgtcaggaatagatggtctgcaagggtgagcccgacagagaaaagatagccgggtaagagtagcctcagacaagggagccatgtatagcatttgcatacttttcctgcaaagagggtttaatccaaagagggagatttcagtattgtcagtcaggctttgttcagggtgaggagcagaaggaaatcagctgaaggggcctttctcaaagccttggtctcagccttgaggttgtcctagcaaagttacgttcttgagggttgtttgcacactattgtctgtttgaagatcttctaaacccaaagggctcaaagcatccccctttgccagcacaaaagaagggaatttgtgtggtaaaagtgacttgtgttgcaaactgaacccaagcaccctttgttcttacacaaaatactctgaagttccaaggatgtcttttagagccggactcagtgagtcataccatcaaagtgctcacaggctagaaaaccaggtaaaaccaacctacacttgtgtctttctttgccagctcagaagagacctttgtgtacttcctaaagaagatggctgaaaaaaaatgaggcagataaaaactaatttttattggcatggatcatttttgccccatttccttatagcattttctgatacaaagtgtttatgtctaaaatggaggcaaattattctggcagttcaagttgtcttagcacccgaccagccttgtcttttatctggcaatgtgagtttctgactttgatctgtgtccagttttcaaaactatgccttcttttctaaaatatgatgttctatgtggtataccatggtctactctccaccgtaagtttttctaataatctacacatttacaaagaggagtgtttaatcatccagatatttatgggtcagaagtcagggcttgtttcaacttcactagttgatttgagcgttactgcccataatctctacagtttaggaaagtatgtactaaaaacatagactctgaatttaaaaaacagcaatgtacttgtttataagggtaacatgggtatctgtgagtgccttttaaatttataatcttccacatgaagcttaatgctttaaaaatgtgatatcttaacacattttatatatataaacatacagactaaacatgccttgtaatggatcctgtaggatatacaataaaacttgacattggagttttgaaaaatatgtacgtatttacatagagcaactaattcagcttgaggttttctgaattaaggatattcctttatcactgttttagttgttttttattcttttgctggatttttgtctcattttgaaactttcttaaaaagaccctatacaaatgcaaaataaaaggtaatgaaaaatctgtttaagggtctaaaagacaagaaaatgtccatctggatttcaaaataaaggcaaaacttgcagcatgtaaaaagaaagataaagcacactttgaaattcgcatgagccatcttctaagagaaaagttatgccctcttcattgataattaggaaatcttttatcaggataatcatattttgggattcccactgatgttataatgctagtgggtgtggatcacaggtgaagttggaagctaagacattgacaatgcccaaattagagctttctaaatttataactgtggataaaattgtgcttgctgctttcctaaatatgttattttttgttatggttgaaatgcttgtctctgatctaagtaaactctgctttgctggaagtggtgcatttctttctccagctttgcattttcccctgtgagaagcatgtctgaattggggggacctgaatatacctctttgttgctgagcttgtcaagcacagtgctgtgttctctttcccaccaggaaggtcaggccgctgggggccaatctgttttctgaaatgaaccctactgtctgtccctggtgtctgacagattgaaacagttatctgcattactgtgctttcaatgctatttaaatgccttgctttctgggaaaaaaaagtaatatgtaggctccattgaaaaaataaaaaatttttaaaggaccgtgcttgggatgttaatatttatctaaaaggcagatttaattaactttctaagaacatatttacagattcaggaagttaactacatgcactgtgcacacacacacgcacacacacactcacaccaagataagccctcacttatgagctctacttctaaagacttgtggggggtgtgtgtgtgtgtgtgtgtgtatgtgtgtgtgtgtgtgtttaattggagtaataaaattatgaagtatggaactgtttcaattgtggagttttagagtaagagtcttttgttcacttagatttcagtttcatgtattttgatgagaggtatgtataaagcctgaagaaatttgtactgtgctgagcctcacttcaatactctccagataattgagctaattaaatctttaccaacattaacacaactctggcattccttggacagtggataattattgcatgaacatggcaagcttaaactaaacagatgaaaatagagttctgtggaatgggtattgagtttattctttattcatcttttgataaggtttaattaaaactgcctctctccattgtggtgagaataatgtgcttgttttcttagtgaaaagcaaattattcacttcagccatggttcaataatcaaagcctttgcaaagttttgggttatagtgtagctgtggggatataattgctgcaattctgtatgaaggctttatcttttttattactttctcttatttatttttgtagaaagaaatttataaaagcccattttgtgatttcgtgtggaagtacatatgtttgaagccttgttataggcttgctgtggctagagtttttaaaaggtgtatttcttagagcctcttgctaaaataaaaaggtgaaaagggacacacacctaaatagatggcatttgagatggattttttaagttagtgaagaaagtttaataaaacctttaaatcctgtggttgccactgtattgacatagtgcattgacagtctcaagggtgaaaaagcaatagacctagggaattctttctgcaaatatatatttgcattctctttcactttctttaaatctaccagaaatatttttattattgttcttttaagtggggtagaatttttttatgttggtgataattttgtagcatgaatagattttatatatattaatgacagctgattgttaaatgtattgtcatgactatcctgtgatttctatttctttctttccctctttttttcctcatttttataaaatgggagattgtaaggatatataagatattttatggaaccaaggacaaaaataaaactgggccctgggcgtaaattggaaacagggactccagcagagataagatctctttctttgtccatctttttgttgcctcgattctggctttccctgcttctctagtccatgtgatggaagccaggttgacttgtcctgtgatttgcaataacaagcagacatcattcgaggtcagtgttcccaactccttgcgaagagaatctgtccttcttagacaagtgaatcagccctacatccaaattcgagtgcctccacttaccacttcttactgcatgttttcttcatcagtgctccctcaagagggaggaaatgcagacgggagcaagtatttcttaatctatagaattattttaagtattaagttactgaatgcagtgtttttttaactccttattggatagtgatatcaatctagtagactggagaaagtacttcgcaagtggagtagactaaacgggaaaggaaaatgagatgatcacatgtagtaaaaataataagtatcatttcatgaaatttttatttcaactgtatgtgtgcatgtgcatttatatctatactgagtcacttaataaaatgcattttttctagtgagttgtggccaaaacaaatttcaaagcagtcactgctcctcagatccccttgaaggtatctcttgggaggcagtggaaagggagaggaacactgggcagggcttcaaccccatcactctccacatcaaagtagctccactttaatctgttttacactttatgtttccacctaagatatttttcaacaaaggatgcagtggccaaaagtttgaatgaatgatttcccatgttccttggtatttttagagctaagtacagtagcctccaggaccatagcaaacattattttggttttctttactagggagagatcaggaaacaattcagaacttttcttttcttttctttttttctttcctttctttctttctttctttctttctttcttttcttttctttcttgctcttcctttcttcctttttttctctttattttccctctttctctgtcacctttcatttttttccgttcatttctttctttcaagacgaagtacagtttccctacttaatcccattgaaaaaaactctgagacttagcacacaaccaggacaacactgaatcagattgaactttaaacagccttacaattttaaacagagaaaagcagtgaatacctctccctgcaatttttcctgttttgttctttaggacgggatgaaaggcaaaagtgagcaatggtgacacgagtgagaaggatttgggcagcctcctcacatgctcaaataaggtccttttaaaaccgaggatcatggagagagacaatctctttaatagaaataaatagcaagagaacaaagactaaataagaaaacaaactgacttccctaaaagtgcattttacatgacttcctttggaaagttgaaataaatttaagaggtgctttttctggccttgacattgtatgaggggatctgtgtggcacagactgtcctggagccagaaccttatgtcgaactcttttgtttaatcctgagttctgttgtgtctgtttgagaaaagatgtgaagtggtcatgggcttcctttactttgaccttatgttagtgagtcctttgttaatcattcattgcactagcatcagttttgttggtggtagacttgattcagtacaggcagctctaactcgggaagcaatatagaatagggattaatatctttggttaataccagcaacctgggctttcagactgtgctatgctacttaccagctctgtggcctgggctgagacttaacctttcttagcctcagtttttccatctataaatcaggagtaggaatggttcctttcttgtcagcttgttgtgaagatctaaataggaggataaagtatttagcacaatacttgcttgctccgtaacaagtactcagtgactgttatgaattccaaatttcatgaagtctgtataaataaaagacagacgtattcgagatcttttatgatagccatttttttggtcttttttttccatttcttttacctaaaatgaaaaaaaaaatctagaccatcttacagtgtagtgtattgcttggtaaaagttgtacataaccatgacagaaggaagagcaaaccagggcttggtttggcatgaggacatgaagaaaagggatttgtggaaattgggaaaagagatgcaagagatttttgtacatcagcaaaaagcacaaaagttgcactgagtgtgtcacgtgcaggggatggcaagaatttccacttgagtgaagcaaaggaagcaagaaagtggaagcagtctttgaggaagtgtaagtttcatgaccctcagtagggggccattccagaaaatcgtcagtgtgacgtagtcatgtagttagagtggtgggagaaggacagagaagaattaaaattgtctccactttctcagatgaactaattggccagatggcaccttcactggcgacttcaaagaactcagaaggggcaagcattaggtgaggataattaggccaagtctggtggtataaagtagaggtgtcctttcgtttaggttgatatagcaacagagagagaaagagagatagaaattaaaagcagaactgaagatttgggagcctctggcataataggacttgatgggataaacaaagattcaaaagctgggtcattgttactgagctgtgaatagaggtcagcacagacaacagagaaagtaaggtcagaaaaaaaaagagagaaataagttacaggtgcatctcggctaccagcttctccatgatgccgagccagggcattccaacctacagttatagtgtctttctcttacttttccaaaacacttgtggaggttgtaacctggaagtctttaacagatactgcccgtatacctaggatttgcctaaaacagtgggttttgttgttgttgttgttgttgttgttgctgttgttcttttttttgagatggagtctcactctgtcacccaggctggagtgcagtggcgtgatctccgctcactgcaagctccgcctcctgggttcacgccattcttctacctcagcctcccaagtagctgggactacaggcgtccaccgtcacgcccggctaaatttttgtatttttagtagagacggggtttcaccatgttagcaggacggtctcaatctcctgacctcgtgatctgcccacctgggcctcccatagtgctggggtttacaggcatgaaccaccatgcccggccaacagtgcttttaaatatttaagataatagtcaacttttaaaactatgtagattttacatgaaaataatttttttctgcatctcatttttttattgttgttgttagaaaaaggaagattagaccactttgggcattctctaacagcagtgatcagtagggctgagtagtggctgccttctttagcaaaggctgtgacctgaagtttgccacagtccctgccactccttcttgtccccctgccactcagactgagaagcaattgctatttaccttcaccttctgtgttgtttaactttcagtggaggaaaagaaaagtgaaatatttcttgtagccatgtctctgttgtccgtgtcaaatgtaaaaatagcccagaggagccttttgttgtaagaagaattgacaagagcctatttccttgtataaataatctaggccacttcactcaagttgccttcttggcccttattgagctgctgtctgagaactcataataattgtatggcatttaatcaggtttattattatatgtgtttagcttccatttccaagggaatcataaagcttcatcaggtaaagttggtttattccatagcatataacataatgttgtacacaaagtgaaatatgtgcatatagtttcaggggaaccaggaacaaaaggaaaagactgtaacaagtttctaaagaagaaagatctccttgaaaataagtgacccaactgattgagaatgagatgacaaattagcaaacatttactaaatgccaacagatctcagatggattttgtaagagatccaaagatgtacaagacatggtccctattgtcaagcagtttacagtgcagtagatgacataagatacggatgattcacccaaggtaaaatgtgaaaattactgttatataaatataaataaagtgcaatgaaaatagagcagggacagacctcataaagttcagggaatgcttcatggaaaagatagcatctgagctaaaacttgaagactaggtgggatatttatagtcagggatgggcttccaggaaggggcacctaaaaccacagaacagctgaaaagtccaggatatgtttgaagctggacaagaaatgtaatcgcctcaaaaacagagtaggtgagtgggtacctgtgtcctgcttaaaggtaggaaagagaatgtagtaaagaccgttcactatagcgtcagaacaagtacaagctactttttttcttaaccttttctctttgcctcttatttctagagatggctgtcatgccataaagcacaattgtaaggttaataataataatagtggatgggtacagtggttcatgcctgtaatcaatcccagctctttgggaggccgaggagggaggatcacttgagcccaggagtttgagtccagcctaggcaacatagcgagaccctgactctacaaaaaataaaacattagccaggcgtggtagtgctcacctgtagtcccagctacttgggaggctgaggtgggaggatcacttgatcccaggaatgcagtgagtcaagatcatgctactgtgttccagcctgtgttacagagtgagaccctgtctctaaaataataataatagtaatagtgagaacatctcacttaatgagtgcttactgcatgctagacatcatgttgagcactttacatgagtaatttcatttaatcctcataacaacccactaaggtaggtgttcttatccccgttttgcagaggagactgagacctgagctgttccttcatgtcctcaatgtcttacagctatgaagtggtagagctaaatttgtaagctagaaagaggtcatgttgttgcacttatcaactggtctttttattctatcttctgacaagcctgcattattttagatgtttcagtcataatctaagcctgtgcagctatttagttgctaatgtctagagaagctttggctacctctaaggataaaattagaggttcaagaactacagtgcccccaaaacccttaccagatcaagttaattaatctgtaacttgaacaccctaaaggccccatttaaatacaatttcactgttactgagaagctccagaaccttcattaaaactgaatgcagtaagaaataaaaagtataaatctgtctttagaatcatgttggtttttcaaatagatatcacagttattaataaaatgataatgttctctataaatttaatgaaggcacagttggtctgaaaacatttgcaatttctacataagcatttgtttttaaaaaatatatgcttgagattctattattatgggccatatttggatggtattggcatttcacaaatatttctttcaggatcaaaaatgcagtaggtgcagtagaattcaactgcagctttagactgaccatttttaatagattcagacagctttcccttatttatgttgacacaagggagaagcgacgcagataacagaaatcattgagtttgaggatgcagtgtttggaccacgctgtatcatcagagtaatttttgatagtctcatagtaaaagtagtttggtgccttaaaataccaacaattttggccaggatttctaaagtgcctggagcaagtgtccaaaaaggggtaatccactggtagatattggcgggcttggaaaaattgttaaaaacaatgtgaagaatcaaaggtaaaacatgcaagagagagatgattaaaaagaaaaacataagcaacttctagcattttgttgctactatgagacttttgggttatatccttagaattagataggtattagggacataagggcagagaaaagagaaataagggagactgttccttcctaaggatttgaacactcagatggatcgcactactttcctttcattttcacctttttattcttacttaactatttgctgaagcttatgtgagttaagccatgagtgtttcaggtatcaactactcttaaaaacaaaaagaattggtagtcaggattcctaagaaaaacactaactggatacgacagagggagggatgacctattctcttcagtgttttaagatttcctattgatattgataaccaatgtatgtgaagacctgttccgattgagcaatctcactgcgatccatatagtgccttatttctttagacatacttttttttagagggctgaaatttaaattaataaatcagccagggctgcatgccaacatgacttgaaagttaactggaatttattgatctgcagcctacaagctgttctatgccacactgcacataagaaagccagtctttaaaagtcgcaaaaaaattttaattacctcaaaaaagacattttacatttctagacagtaaccgttgtttgagtgggcccttctcccctccaccccttctccctcaaattgggtcattagtgactagtgttgacaacaatgatagctaatgcaacgttcacaatccatgctcaattttctgtgttaatggaggaaatggaagaaatggcttgccaggctggtcactcttcagctcctgtccctaaggaaattcagtgagcaggcataactgtcttgatgataatttcaaaagatgaataggcaacaagaagctgctcatcttccttattaacttgttatgtatctagcctctctgaatttcccaaactccttaagtctatttaaatttgtcactagatgctttcccttgaagagctacctgttgggtaaatctaagtctttcctatcctgtgtcctaaacaagccctttaaacttcaaagggattaacctggcttgctttatttatttatttatttatttatttatttatttattttttatgtcaaggcatcacagattaaatatccttttatttgactcaaactgaacaataacatttaaaacacacaatgggaagctgtgcagttatctctcaaaatagacaatgatggtttaatgaagaggttgataaagcatatgtagaaaaatcagaatgtcaaaataagtaccaaggagaacatatactttgaaaagggggctaaaacatgtagctatacaatctggggttcttattgattgatggattgattgattgattgagacagagtcttgctctgttgcccaggctggagtgcaatagcgcaatattggctcactgcaacctccaactcccaggttcaagtgattctcccgcctcagcctcctgagtatttgggattacaggtgcccaccaccatgcctggctaatttttgtatttttagtagagtcagggttttgccatgccggccctgctggtcttgaactcatgacctcaggtgatctgcttgcctcagcctcccacagtgctaggttcacaggcgtgagccaccgtgcccagcgctgaggttctaattggtagtcgtgccaacagtaattggagaaacatgttcctaattgttgatggggagaggattacagttaagcatacatattttaatacgtattcaatatctgaatttgaagagtaaaaatgcattgcttttaccacttagaaagagttaaaatcagatccagttatttgacacagcaaagacatacaaatgtacatggcaatagcaagttatattgttcaggcagtgagtatgatgataccccacttttgtcctttgccattctacaaatttttccagtcattccaatctcaacttccatttttccatgctgaacaacccgcattttctaccttcttccatctgcctccttttttctttgattatacacatacctatcaatgaaattatttccctccacttttaaacacaatatttagaatattctatttctacaattttatgggacttttctaatcatgtatcttgcaggatgtcgtaatcaaactcacacaaattgggtgggtgtagacaagtcagtttggtaaaagaataaggagcatcatttgcttcatcagcatcgtctgatgatcacctgtgtcatcactttcagggttccaacagccccacctccactagcacctctctctgtctctctctctctctctctctcacacacacacacacacacacacacacacacacacacacacacacttcttcccatggttttaggtattttatcacttggaagaggcagatgtgtcctgcaagatttgcctttttttttcttttttgagtgtactctctctcttactccgagataattttcaatattagaaagaaagtccaactaatgctggctgctagttacttttaacacttctctgatggaaaatgttggtttgactcattatttcccctctttaatcaaagttttctttcccggagaaaacattctccccagccccatgttaactctatttttctaaactgtctttgatgaagaaccttgtcaagggctttctgaaagtttataaattatatcctctgcttatttactgtctcagataactcagaatgattggcgagacatgccttctctacatgtaaaccatgttgcctttctcctaacagattatgtttgcatatatgacaattatattgcactttattgtagatactgtctacttgctatatttgaagtggagctgtgagtcccaggattcaaaccaaactctttcccccctcccccccattaaagcctggatgggtacatgaaaaattcaggataatgaccaactctgaaattgttcaaccctttggtatgataatacttgataacttttatttttgtctttgtttctaattatgtttgactttaaaattagcacgtttaacattaaagtcatcatcagggaatcagtcaagtagtaaaaagagaccttgggttaaatgcttatatgtctatccacacacatacttacatgtatacacacatatgcatatataatcaatagctatctctggcttctgagtatgtttgaataaaattaagctgtatagtctgaaataaaaatggatttttaaagggaatttgcaggccaggtgtggtgattcacgcctgtaatctcagcactttgagaggataaggcaggaggatcacaccttgagcccagcagttccacaccagcttgggcaagttagagagaccccatctctacaaaaaaattttaaaaattagccaggtccagtgtggtggcatgtacctgtggtcccagctgaggtggggaaatcacttgggctgtggaggtcaaggctgtagtgaactatgatcatgccactgcattccagcctgggcaatcaagcgagaccctgtctccaaaaaaaaggaatttgcaaatagataatgatgtgcatataactacattttacccacataggaatcttccatttccatttcctctgataagatatgacggtagcttcctgggtgggtatgaagtttgtgaggtaatagttagcattggtgccttagggtaaaaagtggagtgcccctctgagtacagcctgacctagatgtttaggctacaatgtcaggtgagccatagtgtccactcttaaggacattgcattctttggggagagatagacaacaatcagtgagtctggtcagaggaacgaggaccatggtcaggcacacccaggagtccctgggaaatcctgagaggggtgtataaataggccgctggtgggatgtcttcctttgcagtattatttttttttcatttccttcatattagtacaagccaacaaatgtttgttcagttcttgctatttaccaggcactatgggagatatacctactgcctgtaaggggctgcagaccaacagcatcagttattgaaattttatataaaaacatgagacaccatatgtgaaaacctgtaatcagggagactgtgccctggagtggagacctaatgattttagagtacttcggatggaccagtagtcctggcttactgttaataataacatttatttaacaccttgacttttgctataaaacaattttgccctgttgagaaaggaatcattgcaatatacaagcaaaaggtccatatcaagatactgagtacatagcccttgaagaagggaagtagtaacagatatgagatgttatttaggtgggaagaaacattgaaaatggctttatttcaatatttcaaaacatttcttccctcttctgaaaccattttccgaacgtgccattcactttgggagcttcataaaaaaaaaaaaggcaccactttcagcacgttacagcctatttcttcatgctctttcctttttgactttccttctcttccctttgtgccaccttacttgagtaccccatcctcccatgcaggcacacatggaattccaagtgtggaagcaaattgctgatggactgcaaatgatattctaatagtttttagcagtttaagctctctctctgttaacatgtagctaatgcataaaatgttaatactccttaaaaagaacatatgttacaatcttagtgccttgtcagacagactctaatctgttagcaattttaggctgacaaaagcttgttcttggccccatatctgtctctacagttctctccactatatatcctgtgcaagttcaaagcatgatgatgacattagatagcacacatgttggtttcattagctagctctaaactgttttatgtgaatgcactaatttcactgtacagaattaactaggccatatgggtgtgttctggttgccctgatacattcattttcttccactctgttttccccctctctttactgaccctgtgcatccaaatctgtagtgatgggggaaaattgattgactcagaaagtaggggattgcgatgtagtgatttcacgctcagttgttggctaacaaggcaccatagtttttatttagtgagccctggtagcaggagatgaagaattgtgtagggcccagctgccacggttacagagcaagcagcttaaagggcttcagggttccaagtgtgaggggaattgtctcttctcagcaggtaagggatagatctaggcagagtctgttgtgttcaagatgctgactggcctggccaattcataaatccaaaaaattacaacatcttctggtcaggaggaagtggaagggacattcaatggtgcatttaacccttttaatgccaggatataatacctcttgcctgctggctgtttacgggggacatttcgtgtttaaaatatgtctttaaaatgtaattttcatttccaagtctccttttaaattaaaatagattaaccaattaattatctatttagtgaaagctagttagtcaatccatttacatttgctgctctcatatatttacatgtatttcaaacagttgtgattttttttttccagattggtctaaaaggactagaaagccctaaggtttatgttctcattgtgtatgtgtgtgtttctacatgtgttcacacacacccaaacatatataggatcacactaaatttatacaagtttttaaacacttaaactttatttagtatataatcatttttagtaagaatttggcctttactccatctatgaaaaatagttgttaagtcaacaatggttctgaagagaaacacaaaggataggatttgtcctattaggaaaactattttcaagcatgttagaattactgttaatattctgagtccaagtgagcccaggaaggacctctagttgatgaagttagctttcttctagtttctatatatatttaaggataatacatttttatctctttaaagaacattaaaatttaaattttgattcagatctgtcaggccttttagcctgaaagatagatctgaatcaaaatgaattaggtattactataataaatacaagattcctatttcttatttgcctcattaatgcataaagtatttttattgtgtttgtgtgaagaactctgctgaaggacacagatgtcattattaatattttctatttaatgcctgcagtgtcccgaggattgtatatcccatgaagcagacataatttattcttaaaactggagttcccttggtgggaatactccctgtgtttctgctttagtattcagcctcttgctcttacccttctcattcccacaccccagtctttaggctgtctcataatttgggactgagaactcaaaagtcccagtttcaaagtgagtctgatttgctaacaggtacaagtccagtgggagcatcctcatcacagaatccactcatttcaaatcatatccctgatacagaatagacctattaaaagtggcttgttgctattcaaatccagacaactatgaatttaatcatgctctcattcatgcaaaacataatttcacctgttaaaagcctgagcaaatgtagttagcctataaagttgggggctggacctgagtttctctaactccagagttatgatggggtttcatttaaaaccataccttttttatttcctgacttttgtttctctggttgatttcttaacaatgctattttaaataatatttgccatgcttttacaacaatctaaatagaagctggtttggaatgacatccctcttggcggtccacatttggttctaaaaggtcacttgtgttcattgtatcatggatgcagaaaagaaaaaatgcttcccttttctctgcatcttctgcctttgatccatactcatgcctagatgggtgacagaattcagtggtagctaaatgcctacatttcatggtcactaagatggagaaaggagtctcagttttgcccacctatgatgtaatgttatagcccatcaagcccaaaacagaaaagtgaggtagtctaaagcaatggaaattaaggccaacatgagatggaacagtccttgcagtatgcagactcagttggagttatacccatgcattacataaaaccgaacttgtgtgtttgggattatggtgttcttaaatgctaccaatgggcttggttggctttgtaaaccagtcatactttcctcatgtggttacaacttctccaaagcctcacggaaaaattatagctccccacatagaccgcttattcatagtgttgtgtcttgtgaatcgtggtatgatcttttggtctccatagaaacatagcaacttaagagtaatttagaatagagtggggaagcataccaactagaattaccacttgggaatcacaatcagtcaaaattcttttttgtctccttcacttatttcattactaaatcatataatatcagaaattactatgatgggtaagaatttcattatattacatttttgggtttacttctatgcatctcttagctatctggcaaagctaagtggatatagaacatattctttagctttaatatttatctaattcatttcattcattgaattatttctggtgcttatgttgtgttgcattcataagtcatgtgaaagttgcttccagaattttcttcaaacaacctgtacttattttacataaagattcatctatttcctgtaatctgtcatttgttcaataaatctttattgagtactatgtgctatgtgctggggctgtaaagcttagaaataattagatattatcacagtgcttagggaactgacaaatgagcaagagagacatgcatgtaaagttgatataggtaggaagtgctgtagcccaagtgtgaaaaaatatgatgtaggagacagagaagagcaactcaggttagcatgtcagcattaaaactctagcacataaatgtgggaagcactagtaacaccattttcctgatttgcctatggtaagaatgatcttatataataactatatgccccacaggttgagtaccattttccatgtatgtcaagaacagaaagaagccccaaatagtttatagtataaataagtcaaagctatgctctgaagaattcaagggagagattgatacatctgtttcagtgaggggttagagatggagtggagctgtggccagctgtagggctggtgggaatggatcagggcagcatagctaggagactggcatggcaggggtcaaagattctcctggaaagatgcagacatgcattgaaaaactaacaagaagccctagactcaggaacttgaattctaggcagagaaactttcaacttgatgcagcaaacaataagtatttataataacagatgctggtgaggttatggaaaagaaggaatgcttgtacagtgttggtgtgagtgtaaattagttccaccactgtagacgacagtgtggtgattcctcaaggagctaaaagcagaactgtcatttgacccagcaatcccattatgctcaaaggaatataaatcattctcttacaaagacacatgcacacatatgttcattgcagcattactcacattagcaaagacatggaatcaacctaaatgcccaccaatgatagactaaataaagaaaatatggcacatatacaccatggaatactgtgcagccataaaaaagaatgagatcatgtcctttgcagggacatggatggagctggaggccattttctctggcaaactaatgcaggaacggaaaatcaaatactggatgttcttacttacaagtcagaagtaagtgatgagaacacatggacacatagagggaaacaacacatactggggcttatcagaggatggaagatgggatgagggagaggatcaggaaaaataactaatgggtactaggcatactacctgggtaacgaaataatctgtccaacaaactcccatgacacgagcttacctatgtaacaaacctgcatatgtacccctgaacttaaaagtttttaaaaaaagaaaattaagttgacaaaaaaacaaaagtatttatagttgtgtctttgagcagggaaattacactatggaagtagtgggatttgaataacgtttactatgggagggagttctgactgcaatgtgtaaatatgttcattgaaaaattttgcaaaagcatgaaaataaatctcttaaagtcaccaaacctcagaaacaattttgattttaacatttttccatcttaacattttaatatatttccaggttttaggggttttattatttgtctttgctttttttttttaaacagaattggggttatactttacttaacttttataatctccttttttttctgcttagtaaatcttgaatatttccccatgtcatcaaatcctcttctgcttggtgtattttccttaatatgaatgtgccacagttgtgtttggccaaccattgaacattaaagttgtttccaagtcctaactacatgattcatgttgccatgaagatctctgtatataaatctttccctacattgctaattatatccttaagatacactttcagaaattttaagtcaaaataaatttcaagccaacagatatggataattaaggttgctggtacatattgccacctttaaaacacttttagaaaaattaagtggatatagtatgcagcacatcttggaagagaaattctgtgagaagcaattccatctcagatggctgggttcaaatcctggcttctcttactgtgtcacctcggtcaaataacttaatctttgtgccttggtttcttcctgtgtaatgagataattcatttgaagcaattagagcactgcttggcacattctagctgacgttattgagttgttgttagtattattatggcagtaatttagctttgaaatgatgagagcctgggtcaaattaatgagaagaaagatacagagagaaatctttgacaaatcagtcatatttggtgactaattggctatataggccaaagaagggagataagtgaaaaaatgagccaaacgttttaagcctagggaagtggatgtttcagtgatgaaagtggcctctggcttagggcatactgaagtggacacagtgggagatggacacaggctagtgactatagatttcagggtaaagaacgaggaagggcatgttgatttggtaatgatcagaagtgaactattgacatgaaaatgggtagactcccaggaaaagtgaggattgagaggacagggcttaggatcctagactgctggaggaaagtagagagaaggaacagcaggaaggaagaccagctagccaaggatctgagaagatgccattgcagaggtgaacagagaatcatagttgtgggaaccatacaaggataaatgtcacaaagaagagggtagtcagcaatgccaaatagcaaaacgtccaaaggtgatgggaagtaaagaaaattactaattctagttaataaatgaaaggtaaaagagtttgcattttctttgtgtatttcatgatggttcttttgttcatttttttcctagcttctcaaaactttctttgtgaattttagtcactatgttttattggttgttttcaaacacaacttagaattctttttattccattagccacattttaagaaaacttgtgaagcagttagttctccaactcacagtgtaacagatctttgtttcttattcactatcatctttgacacagttgcctaagcatttggttcatgtaaccattaaaaacacatgaacaaaaatactagaaaataaacaagattgcaatgttttatacaataataacttgcaaagtctcccctttgaaactgaggccatttttgtgtcattgaagtatagtagaatgacccattaacaagatttctgttgggtttatatattaaaacagatgaaatcattttaaacaaaatgttaaaagcatttacttcctagctcaggctaagcttgatccaaaaattatttaacatttgtccaaaatttaaaaacaaaataaaactaagttttgacccctaattcacttgctgggtaaaacctggaaagacattttgagatataaaaactctatcactaatttaaaatcatttttaatttcattccactttgtaccagttgatttcccataatcagttcgctgttattacattttaaggcctagcttgttggcactcatttatcaccttctaactttctaagtaactttgtctggaataggccgccagacctctcattaactagttgcccactactggtgtttcccatcacctttaaagtacaatttgttgtttgttttttaatttaatttgaaatataatttccctatagacctggtctacctgactttgaattaaatcattccaaggttgatttttccccaaaatatgtggttggataatttttaaatctcttcattaaatttggcttaaactgttctttgtcctgttttctattacttcttggttgcccagcacagcaatgagccccgatggattctttagaacggctgtttgacaacgatttaaggagggagtgaggagatccttttcttttttttttcttctcgctctctcttgcctacagctgctctcaatatggctcaccatgactgaaaggaaatgaataaagatgagttatcggaactgaaaatcagccgcagagcagaagcaattcgtactccccaacccatccccaaatccagtggggaaaaggaagtcattgccatcgtttatttattcatatatttttaatggtgggaggattattttttaaatcttgtacctataagtggtggccatttggagcatttatgaaaagccatatggtttcaaatgagattcccatcacattctctgcatttgaaaccattttatgctgagcctcttggcagggtccacacttggagcatgagcagccccataaaacactgtagacaaaactgaagaacatgcaaatagcacttaaggaaatgttgggggtttgaaatgccatttttggatgggccttcacttggatgatacaactatattttattttaagcagctatcatttccatattttgtgcattacatgtctctaggaattaaattccatccttgtgacttaggtatcttaagtgctcagagagatttcaaacagggaaacgtggaaaaagagttgggaatttggctctgaattaggatgcaaaataaagttcatcagagaggttgctgaatcacacgtttcatattttctctttctctatgagaagaaagaatgtgtgtatgaaaagcaatttcttgctaaaattacgtcatgtctccttagattttggaacatgagcacctaaactcgggccgcaatcagcttatccatgaagagcaagaggctcactgtggcttgatcctcaaaggccccatagtgcttctagtcatacttcagattcatgtagacctgggttcaaatcccagcacatcacttcttgctaactgtgtgtccatggacaagtgactgaatctctccaaggctcattttcttcatttacaagtatgaatgatactgctaatcttacaaagctgatgctgtgagttaaatgagagaggacagatgtcaaatgcctcctattacctgagaggcattgggtcattgtagcatggccattaggagttccagttccggagttaactgtcctggtttgaaagcttctctgacaggtattaactttgtggccttgggaaagaagcccccatttcccatctagagagtgacggcaatcatactcatatcccacagatgtatgatgagaagtgactgtaatgatacatgtaaagctcttagactagctcctgcatggcacatggaaagttctccacactctcatttgctgaccttgcaggatggttgggcaaatgggcattagtatctgtaattcctagcatataatgaataagcagtatgtggtagctgctgcccctgtcatccagtgccgagtcccactttacaatgagtattcttggtcaaataccctggtctatcatggccacaggagcttctggtctggcacgtgccatctgggatgccactgtatttctcaaagccatgatgagtttcataactcccaagaaacttttttctcaatatccatttgccaaacattttttatataatatattatattatatacattaattatatacattaaatatatataaatatttatatataaacagtatatatacattatatacattatacataaatatacattaaatatattatacattaaatatacataaaatatatataatatattatatgtttggcaaatatatattttgtatatataagctcccattctgcagcctaggctggagtgcagtggtgcaatcttgactcactgcagtctcgacctcccgcgctcaagcattctgcccacctcagcctgccgagtagctagaactacaggcacatgctatcatgcccagctaatttttctttttattttttatacgcacagggttttgccgtgtttctcaagctagtctcaaactccgcagctcaagcgatctgcctgccttgacctcccaaagtgctgagattacaggccaaacatagaaatttttgacatccattaggttgttgcacttccagactcattacaatggagatgtagaatttgtcacaatttgcattttaatggaatatgaaatattctctagttttggagaagtttttctgtgaagtaatgtgtgctttccaagataagtatattataatgaaaattgccatagaaaggaagactgtgagaggttgttctaaggcaggaatgtgagtaagtggtccctctaccccgtcagaggtaaggaattgatggtcaaagggttgacatctttgtccagcttagatacagtcaggtcacaggtgacatgtaatgccctggctgtctagaggcaaccccccaaaaagttaggttcttgaactttagggcttgaaaagaaagtgggaattatgttgtatttcaataatgtgcttttaccagaaggaaaaacaacttttaatatctgtgaacactttatttaatagccaacaaatgtgatatgttgctgatagaaaaaatgtctatttcaatgttgtgcttcatggtaatagaacaaagtagagttgatattgtagtaaccaggctccaaaagtgtcattctaatgaaaaacagcactgtttgggcaaatattttctggcatctttatatttcttttaactggaaacagagaacatgctggcttggtatcatgactgtgggatactgtgttttctaacaaaaaacaaattgtggaaacaattttgccaagaaaaatgaaggtgattaaaaggtatggaacccagtacttctggctgctcacatctaacaacttcatggccatagattggcctgttaactaagagactcagcatggtcatgctgttgcctgctcttattttctaagataacacttaatcatcctctgtctgcctactgcctcagtggtgaaaataagcattctgtagatatgaataacttagcatcatgagaattataaacacttggacatttggaaatgatatctgaaatctaaaatagatctaattatcaattacccatagccaattattcaaggtccatattatctaaagtgttggcccaagcttgctgtctggaccgatgggagcagaggatgtgcccagcagcaaggcgaagtggagctggccaatgggctccagaccacagtaatctcaatgagccggggaaggaaacaacaatggacagaaagcagctgtctgagttgtgcatgacaaccaagagtccgccagaagttaggcgatgggaccaaaactgaggttaccagcccaggacaggaggttcccaatgcgacttggtggtgggttctggggtatggccatggtggtgtttatgggacacctgtaccctcagtcatggatggtgagggagctgtagtggcacggcaatagagctgctgagttctggtgagctcggttttcctcttgttttcagcttcttaacaatatactaccttttcaatgcatgagtgtgatgggaagtcatttttactggttaacagctaggatttgaatttgtctcaagaagcatactgcttttgtctgaagaaatactgattagagattatacttaggaatgtgatccactcagattgggaaaatgagatgatacaaagatttcctttagaaaatccgaattactttgttcaggagggagaaaatgaagatgaaagaaaatgaaaaataatagggagaaatgaatcatctgagtgtcaaaagaccctgtgccctcggctctgccttccccatcatcagcaaattgcactggaagcatctaatgtgagctacaatttattgtgcatggcccattccagcccaggcccctgagagcataagtaccacctccaccctggaatttatagataccttggggactgtggacttccctgggctgtggaattggcagggtccctaccagttttacccagacttaaagagcaggaaagtccccaatcaccatctggataatatatgtataaagattatgttatgatggggggggatataaattcatatacatagcctgcagtctataaatacttgtactgaaatgttctgttcaacagattattgaaacctatagccaaaatttggtgtgtagttatctattgattttacttgtccacttttacaggtaatcaaatatttatactatatatatttttaaagattttctttctctgtttcaaactccttttactatattccatgcttgctatttcctttttatttactttattataatatatttaacaagcctagttatgtacatggatgttatgggtttttcagaatataaggggtcactacaaaataatacaattactcttacaggcccatacatttaaatatcctcatttctttattctataattgcattgtaagcattatatatttatacaattgtttatcatgaggctggaggcagctcacaaatttatatacaatacaaaatataaaataaattattgactctctccagagtcactgatctctgggagctcagagtttaattgggaagagaaatgtggagacccacatacaccttggaaaggcgtatcagcagagaagcaatgtgaaagagatatgggcaattggtgtcaaaattctgaacagagggacactgcctctgacttggaagactaatggtggaagtgcatttgatctgggtctggacgggttgataggattatggatattgtggtgtagaggtagggagtagacggagaggattcaggaaggagcctcccaaggcgcagaatcagtggtgggacagccaggacatgctatgatggcaacacgggccagagagtgggtttcttagagtgggatgtaaagccaaaaaactgaatttacttcttttggaaagcaagacattttctgtataattcacagtatatcctgagaaaaatctgagtggtgaggttactaaaatgcaaggtttattgtttagagcggtgtgtttttctacactaccagagcagagtgagaaataatgtaatattttgattacaaataacagcacaagttgttttcatgataggctaattttaaaaatggctgcggagtgaaggttaaaaaatcatgcttttacagtgaagtcatcaatctcttcattattttagttacattccctttttaacaaatcctttcctttactgtttcaaaacatttgaggcagacaacttctaataataaatgaattcacatacacctaaaatgacttaaaatctaagaaatgattgcaaaataaatagttaaactgaatattaaaacaacaaagctataagatactgctaaatccttcttgacattcggcacatagctagaacataataaataaaatattagtcttagacttcccctcatttgtgaatcaataatttctaataaagttcatgaaatggcatgtcaacatgaaatttaagtacatttttaatataacactgaagtaataaaacctacacggaagtcgagaaagtagattagctattctgccctctccaagcttgacacttaggcaagagtaacttttctcttgatatcttaaatgtttgttattttttaaaaactaagaaagagaggcacataaaagtgtacagtcactgccttctctcacaggccagtgggattagcatggacagacttttggaaaaccctcagtgggggactttgtaacacatggaaacattagattacataaggattctgacaattttcccttttatgtattaaatatttatttttcagatattcttagtaatcatttaagccttgtatggaaaggaagtaatttttgtgtttctctgctatgtttaaatttctttcactctcccagaaggcttcatggcacaggtggaaagaatgtttttgggaatggggaaggtgggagctaggagacccactgggaagctcacgcctggagagcggtcagttctgtgaaggtgccagtggaggaacaaatgggaggaagtcacgttgaactgggcaggaaaccgggaaggttaggggagggagaggagccaggccccagggccagctgttggcctatagagcatctgtagtgacaaagagcaaaggccgcaaggtcagactaccagagtcaagtcccaggcttagtacttactgactctgtaacttcgggaagtcacttaccctctctacacttctggttcctcatttaccatatgaagaaaataatagtcatatctacctcatagtatcgttgtgaggattacattaaatagattgaattaatacatataaagtatgtagagtggagacagacacaaggcacatggtaagcgatccataaactttaaccataattattagagttataggtgctcttagggaaggggcaggtagttggagagggcagcctcagcttggatgtgtggtgtcgctagtgccatcccaactcctttctctgggaaatgttggggcccctaagtgcacagtaataccagttgtgcaggcagcacacttatatagttgttcctcagttaccatccctgtcttcaaaacaccaaatctatctgtatgttcctaaaactagcacttgtatataattgttcacaccactcccaatagtgatgatgggagtttctccctgacccacaaggtattagattgtattaaatgtgttgtacaagcttgtagtaggtgaaagcagcaaagaagatcttcttgctggatcatagttatattatcccctccagccccagaaattgctcttcatgtctattctgtgctattcatgtctattcttcatgtcttgctggtccaggcagttgggaataaatggatgcaaggaagtgactaggtcctttagaatccagcgcaagatttgacaaagctgctgacggtgttgcaatgtaagcgttcctaacaacaggtcagagcttttaaattgaggagtttggactcaaggggaaaatatcactgcagttactctgaattccttttttaatatttttaattgacaaattacaattgtatagatgtatggggtataaggtgatgatttgatacatgcatacaatgtggaatgattaaatcaagctaattgacatatccatcacctcacttacttaccgttttttgcattggaaatttgaaatttactcttactttgaaatacataatacagtattattgactgtagtcaccctacttgtgcagtagatctcaaaacttatttctcttgtccagttgaaactttataccctttgaccaacaacttcctttcctccctcaccctaccccactcccagctgctggtaatattcagaattattaaggaataagatgatccatatgaaaaaaattctggaaaaattgagtttgtaacattagttttacaaattaattgttattataaccatttaggctaagaagataggtaggcaattgattaaggctttagggtccaaggcatgggctcaagttttgcaataacacctactagttgtgtggtcatattggattcatattgcctaagacatagtggcctcattttgaaattatgagttggatttaaaacatccacctcgtaaggaaactataaggatagatgcttgacagggcacgtagcatacaatattacttacatagcagaacgttggcaacacactaaatgtccaataataagtgaatggttgaataaattacggtatagctatatgatgttcattagttaacaaaccattctaccactgatgaacaagtgattacaatcagctgagatccaaaactatgaggaagtcttaattttgttgagtggaaataataattacaataattaatatttatatagtgcctatatgccaggccctattaaagtcctgtacgtgttactcattaaatccttacaacaacccgaagagagagctactatcgtcagccccatttaccacatgaggctaccatggcaaagtaaagattaagaaacatgtccagctagtaagtgatcaggccagagtcagggtaaaggaattgggggatttgtgtgtagttaggaagtaaggaggatgaaagatggctcctccaggtctcatcaagctttgtgatttcctagacaaatgcaggaagatttggctatgttgcagatgaataaaacacaccattattacattgttggcataatagcagctggcccgaaatacaaatggaaactgtcatactcagagtggaaagcccttccagtgtccagactggcagcagatgattctgcactcccaatatccagttgtagactgttttctgcctgcctgctctacactgcctgcctttattgaacacaaactgtgacgtactgaagaaatccaagataaatttgtaaaacatcatgtcagtccctttctagtcccagtatcccctggtgatccaaggttggggtctaaaaaatagaacagaaaaaagaagaggaaacagacactaacttgccacagatacacatagagtgaaggagatatttttgtttaaaagactgacagctgagaaacagttatttgatccctgctgcttgagggacagtagggaaagaaaggtatttttgtgatcgctcttcagcgttccctatgcggcctggttcatacagtcacaacaaaaacccacgctctaatagtacattgcaaccaaccacagatatgttgcaagcattatgcacagtagtaactaacattcagtttccttttgattacttccaggcctgtgacatttagattgttgcacatttcttccaacctcagagcattcagagtcaacagcgtacatctaataatcatgtgctgacatagaaactgtaaggagtttgtgccatttatctgtctttcatcacactaagggtaacagagcaaatgagcaccgtgttaggagtccaaatacatgagttttgggctaaaccttgtcactaactagctgtggccttgagcatgccatttaatctccgtggggcctctggttcccttttgtggaatgaggagagagttttgggtctccaggactcctttcaactccagtgttctgtactaagtcatcagtgagttctggctagtaatagtttcaaaaggtaatagtgctcatcacattccaccgagtaaaatcatagagcagaaacaccaagaaagtggacatcccagctgcttttaacgtttactcatcaacagggcttggctcaaatagttctgaaagtaatccatgcataacatttctgaaaggggaagtaagaatgtcatcttgcatttgaacattttaaatgtcaaaccctctgcattgttagtatttataaagttatctctatggcattatcactatcaaagtaatcaatcatagatttattgagaaatataaacatcaatgttttttatctcacctaagtattttctgtgctaaattttattctgttgcagcatacttgacaattagtgatttgtaggcttggttagcacatgcatactttttaagcaaactaatgtaatgtgagagaacagttttcagtatttccctctattggtatttgtgggtgcccttcaaactactacaccaagctacacaaaccaactatcacaaatggactgtttgccaaatgcctgcttccctagtaaggaggcaacgtgttactgacacccttatgtgtagaaggtcttatgtagagagacttatgaaatgcatatctggattcctatattttttcactgaagtctaacaaattcatgtagtcaaatcttaggaaaggaagtgtgtttggtagtttgagcctgctgtctttacaggctcagtgtgtcttctgtgaaagaccaaatatcatcccagtggacctgacctagttgaacataaatacaccattgaggagctactggcttcagaattaataaaatgtataaataaataggatggccttgtgaagaggctaaacttgaagtgcctattaattaattttttaaaaagaaaaacagcagcttatagctactctactgatacattaatctatgaaatgaaattgtatcatagaaagcattcagattatttatattattcgtattttataagatttttaaatgtgtttaacctagaagggatcataatgcagagccttatgcttttcataagatactgatagagtgtagaggcatccgagtaatttggcattttcgctttttattcataaggcccctgagtatgtgtgaatgtgtttgtaaatatatctcaatttcagtttttgtcattcagagaatatacaacagttcttctgactagtcccaacaacacaacccaatgtgtgtctgaattgatcactattttaaaatctagagagctgggcagtctctgtgctcttgggcctgcaggtgaagctcattaaagaatcaatcaccagtgagggcaaccgcccaggccctcacttcatttgataatattatccagaaaagaggaatatttttcagttctttctcacctaggcagaattttgagaagtaaccatgaaagatgagactgagagttataattgggcctttagtatagacaaattgtactgtgtcgttttagtttttattttaaatccccctaaaaggtcactggatacaaagacaatctctgagtttattgaagggaaagccacaaagctgttatatacagctctatctatgcctatttgtatttcacagtcttttgtcaccgaacaacacacagacaaaatggaattcaatctcagaatttctttactgtcttctaaagattttcttcatggacttgtttccaaccaacgttgaaaaatagttctaattttttaaaaaaggagaaacaaagggctctccacatttgccttattatatgacgtcttttctgcactcacagtagcaaatgttagaagtacatttcaagttgcaattcacctggataaatgtcaacatgaggccataaggtagcttttcagcttcctctcctggaaagtgctttggacatggcagccattgctacattcacactgaaacagctaactgcccagctgattgttcttatataatgtagatagggtcatggctccaacgtgagccagtctcagtgcgcatgttggagttatttcctgggtgactaattagctctcaacctggtatcttcattttggatcccaaatgatccaagtggacaccatgatgttgcccccaaataatagatggcttcaggccctctgatgcaaagagaggccgtacagccgactgcctacatgtgaatgctaggtttgccattttgttgctgtgcaaatcacttaacctcttaggaaataatattttcatcttaaaaaaatgggaaaagaatagtgtctaccacatagggtaaaaaatgaaattgttgtgtagaaggtagttggctgttcacattttacaagattagaaaatgtatttaacccaaagtgagattataatgcagagccttatattttggaagagggtgctataacctaaaaactgataattggggccgggcatgttggcttatgcctgtaatcccagcactttgggaggccaaggtggctggatcacgaggtcaggagatcgagaccaccctggccaacatggtaaaaccccgtctctactaaaaatacaaaaattagctgggcgtggtggcgcacgtctgtaatcccagctactcgggatactgaggcaggagaattgcttgaacccgggaggcggaggtcgcagtgagccgagaccatgccactgcattccagcctggcgacagtgtgagactctgtctcaaaaaaaaaaaaaaaagataattgggccactttacatatggttatgtgaattaaataaattaacttttgtaatgtagttagaacagggcctggcacataggaaacattttgttagtattagttatcattaacataaattcaggtatatatttattacagtcaagaaacctcttacagagttataattgagaaattaaaatataacacaaatttttaaagctgtttaaagtttcaccttacttgccaggcatgatgctattcaccttttatctattatctttttaaagattatatgatgcattggggaacatgaatttttctctcttaaaaagaaattaaacaataggtaataaaggagcagatgttttctattttacatgtagaccaaatatccactaacacaagttacattttatttcttaattaagtatcacactttataccatcatgcttcatacctctcaacattttaaaagtcttttctcatttaggaattcattttttattaacgggttttgagatgtagataagacaagggagattattattttcaattcacaaatgaggacattaaagttttgtgaaactgaagggaagtgaccatccagagtcataaaacaagttcatggtccaggatcacagccatgatccggccccctccccctccactgtgctgggccgtggactcatctgcttcatacacatctgctgaacagttatttccaagcactgaatagaaaccatcagcctcgcatgttttccatagctgttgattgtgctcctactcttcgttcatcttgtggataataaatccatccatttaaagacaagaagaattcagtgttcagctatggtctgctacacacatgtccactttccttacattttctttgaacagaacacagtaaaatctattgtacagctcaccggcgtgataccgctttgatagacaccgagtgacctaatatacacactccagtgtactctaatctgtggtctcccagctcccactcggcaggaattctgagatgttgatggaaccccatgatttaacagagcagctgggctgccctttcacccctcacactggttctgacagctgcctgccatgtgtagagaaaacctcacaggctgaaaccctgtcacagagtaaaggtccttgaataaacatacaagcatgatcatgctactactctaaaattaaattgtttttttaaactgaatttgcagtagggacattttacagctgaagatctaaagcaccccaaagcgggccaagtaccctctccctttaaaaataaaacaaaataatacacacagtaagcctggtcttgttcacacttatttgagttaccagtttttcctcaagtggattaagccaatttaccaatgaccaggtttttctactctgaaacagtaacaagcctgccagaaatgatgtgcagcattttcctggcttagttcagaaactcgatttgtgtttaagctgtcaatttaatccacactgcctttttacttttatcaggatattcttcaggtagaaaagaatggagggaggctttaggcatgactaccgtcctaagtataaagttggttaaaaaaacaaaaatccctactcggcccaaatagcattgtgctttataattcattcttttcacatacagtaccctgcgttatcatggctaatgttttcctgctgagctgccatcatcttttgtcaagctgtcagggttttaaattgaggtaccttccacatttggatagaggtcattatcctgttgcctggttgcattgcctctgctgagcaggttaactgcttgaggtcttttatctagataaatgttttgccagcacttttgctctgtgatgacacgagctgttccttagaggtcaaatagtgatgctatgataagttgttccccgtgtgttcacagatatggaaaggactggagtccaaacttcattaatagtcctaaaaataataataaatgctcattttagcatatttctccacaagatactggattttggggctcttttaacattccctacatgctaattttatatactgggaaaaataatgccttttaactattttattgtttcagtatcatgaatgactccaccaagtgtgtccgaatctactgcttagttctgatgatggcagaaataaatcaatgtgggtgtgtgtaataataatgtatattgttatttgcatgggttaccattattaaaataatatttagagtgaagaccatgatatttgacaccttggtactcctgtccacatagaaaaattatttttaaagtggagagatagaaataaatcatttcccctcagtgaaaattgatttgttaattaaaaataattttgattagcttgtattcaattatttacaatgaagaataccaaataaaaaggaaaataattttaaatgattttgtcataaccaattaacttttacaaaaaactcgtttgtaaattctgttttcaatctttttttttttctttttttttttttttgagacacagtctcactctgccacccaggctggagttcagtggcatgatctcagctcactgcaacctccacctcccgggttcaagtgattcttctgcctcagcctcctaagtagctgggactacaggtgtgcaccaccatacccagctaatttttgtattttttagtagagacagggtttcaccatgtcagccaggctggtctcaaactcctgacctcagatgatttggtgatccacccacctcagtctcccatcaatccaatttttaaaaactggcttttccgggctgggtgcagtggctcacacctgtaatcccagcactgtgggaggccgaggcaggcagatcacaaggtcagaagattgagaccatcctcgctaacacagtgaaaccccatctctactaaaaatacaaaaaaattagctgggcgtggtggcgggcgcctgtaatcccggctactcaggaggctgaggcaggagaatggcttgaacccgggaggtggagcttgcagtgagccgagatcgcgccactgcactccagcctgggtgacagggcaacactgcatctaaaaaaaattaaaaaataaaaataaactgacttttccatttgaagcagacttcatctccatatttgctatgactagtgttgttatatgaactaaaagatgcttttattagtatgtagaataatgttttttaatattggagaaaataccacttgaaactatggtctcttaaaatgtaagcacataaaaacacatggaaataactttcttgacactacataatttgaggccaaacttctctgctcagatttaatctttgactaactcattttctaatggatggtttatttagtgttgtcttttgttttttgtttttttgagatggagtctcactctgtcgccgaggctggagtgcagtggcatgatctcagctcactgcaacctccacctcctggattcaagcgattcttctgcctcagcctcccaagtagctgggaccacagggatgcaccaccacacccagctaatttttgtatttttagcagagacctggtttcaccatgttggttaggctggtctcgaactcctgacctcaaatgatccacccacctcgacctctcaaagtactgggatgtgagccactgcacccggcccatatttagtgctgtcttttaaaaatgtgtactgttattttctacagttgattagatttttaaattgttttatgatagaggatcagttgtgtgcagtccacaaattttatcataaaacaaaatttaaatcctgcctagaggtagcatcttattattgtgcttgggtttatgaggttaaatgcagtgataaatttattcacttacccagtaagatctgttaagaggtatagagacaaacatgaatgagacagagtcccaccttcactggaagattctgaattctctttcatatccattatttattatttgcgtagttgcccaagctagaaagctcagtatcttccatgacttgccgcatcttttaaccagacattaagtgagccaccaggacctgttcatttgcctcctaaatattgtcttaaaatccattttctctcctccaccccccattgtctggtcgccttagctgaggccctctttatccttcatctgcttcctaaatggacttcctccctctggttattcctactccttaccactgcccattttcctcactgctagaagatatttatttccaaaactccaaatctaagcagtcacttcctgattagaaatgttccagtgggtcccataggctagatggtgaagtaaataattcagagggctgcatgatctgtccctgattgctctttccacctaatccctaaaacccactctgtgttccccacacacagttgcttggggtacagaacatgcctcactctcctgttccaccagactgagctccctactgtggaaatgccgtccttccttattctcttagacttatttctctaagaagcctttttttcacttctccaggaagaggtaattgttcttcctctttgaccttgtaccttactctttcactcacatcagattttatttttattaattatatgtctcccccatgaaattatgaattcctgttaggtatgtttcacatcccattcctgtagtttttgaacgaggatgaaggtacccctcatgcccaaactttcttaattttcccatgttgttctaaaattcatctgcttgagaatacctgctgctccttcttttctaatggcctttcttctcctttaccaaagaaaatgtcatctgtccccatcttactgggtagaattgtcttgagctgtgcaaacttccatataacaaacaaaaggttacattcacttactggtgtcagaaaagcctccatgtaatcaaaccaggttcattctagcagttagtacttattctgttcttccagggatgcatcaactaagttggggagaagagaagtcatcctcattcacctcattaagaggtacattcccaattaaagtccagttttggggtgcgatggcacactcctgtcatcccagcttctagggaggttggagcaatgggatcacttgagcccaggaattcaagaccagcctgggcaaaagagtaagactgcatctcttaaaaaaaaaaaggtggggaggagccaagatggccgaataggaacagctccggtctatagctcccagcctaagcaacgcagaagactggtgatttctgcatttccatctgaggtaccgggttcatctcactagggagtgccagacagtgggcgcaggtcagtgggtgcatgcaccgtgcgcgagccgaagcagggcgaggcattgcctcacttgggaagcacaaggggtcagggagttccctttctgagtcaaagaaaggggtgacggacggcacctggaaaatcgggtcactcccaccccaataccgcgcttttccgatgggcttaaaaaacggctcaccacgagattatatcccgcacctggctcggagggtcctacgcccacggagtctcgctgattgctagcacagcagtctgagatcaaactgcaaggcggcagcgaggctgggggaggggcacccgccattgcacaggcttgattaggtaaacaaagcagccaggaagctccaactgggtggagcccaccacagctcaaggaggcctgcctgcctctgtaggctccacctctgggggcagggcacagacaaacaaaaagatagcagtaacctccgcagacttaaatgtccctgtatgacagctttgaagagagcagtggttctcccagcatgcagctggagatctgagaacgggcagactgcctcctcaagtgggtccctgacccctgacccctgagcagcctaactgggaggcaccccccagcaggggcacactgacacctcacacggcagggtattccaacagacctgcagctgagggtcctctctgttagaaggaaaactaacaaacagaaaggacatccacaccaaaaacccatctgtacatcaccatcatcaaagatcaaaagtagataaaaccacaaagatggggaaaaaacagaacagaaaaactgaaaactctaaaacgcagagcgcctctcctcctccaaaggaacacagttcctcaccagcaacggaacaaagctggatggagaatgactttgacgagctgagagaagaaggcttcagacggtcaaattactctgagctacaggaggacattcaaaccaaaggcaaagaagttgaaaactttgaaaaaaatttagaagaatgtataactagaataaccaatagagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagtgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggaaggccaacattcagattcaggaaatacagagaacgccacaaagatactccttgagaagagcaactccaagacacataattgccagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcgtcataagtgaaggagaaataaaatagtttacagacaagcaaatgctgagagatttttgtcaccaccaggcctgccttacaagagctcctgaaggaagcactaaacatggaaaggaacaaccggtatcagctgctgcaaaatcatgccaaaatgtaaagaccatcgagactaggaagaaactgcatcaactaacgagcaaaataaccagctaacatcatcatgacaggatcaaattcacacataacaatattaactttaaatgtaaatggactaaatgctccaattgaaagacacagactggcaaattgaataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtttctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaatgagacagaaagtcaacaaggatacccaggaattgaactcagctctgcaccaagcggacctaatagacatctacagaactctccaccccaaatcaacagaatacacattcttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaactgctcaactacatggaaactgaacaacctgctcctgaatgactactgggtacataatgaaatgaaggcataaataaagatgttctttgaacgcaacgagagcaaagacacaacataccagaatctctgggacgcatttaaagtagtgtgtagagggaaatttatagcactaaatgcccacaagagaaagcaggaaagatccaaaattgacaccctaacatcacaattaaaagaactagaaaagcaagagcaaacacattcaaaagctagcagaagcaagaaataactaaaatcagagcagaactgaaggaaatagagaccaaaaaaacccttcaaaaaattaatgaatccaggagctggttttttgaaaggatcaacaaaattgatagactgctagcaagactaataaagaaaaaaagagagaagaatcaaatagacacaataaaaaatgataaagggcatatcaccaccgatcccacagaaatacaaactaccatcagagaatactacaaacacctctatgcaaataaactagaaaatctagaagaaatggataaattcctcgacacatacactctcccaagactaaaccaggaaaaagttgaatctctgaatagaccaataacaggagctgaaattgtggcaataatcaatagcttaccaaccaaaaagggtccaggaccagatggattcacagccgaattctaccagaggtacaaggaggaactggtaccattccttctgaaactattctaatcaatagaaaaggagggaatcctccctaactcattttatgaggccagcatcattctgataccaaagccaggcagagacacaaccaaaaaagagaattttagaccaatatccttgatgaacattgatgcaaaaatcctcaataaaatactggcaaactgaatccagcagcacatcaaaaagcttatccaccatgatcaagtgggcttcatccctgggatgcaaggctggttcaatatatgcaaatcaataaatgtaatccagtatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggataccctctctcaccactcctattcaacatagtgttggaagttctggccagggcaatcaggcaggagaaggaaataaagggtattcaattaggaaaagaggaagtcagattgtccctgtttgcagacgacatgattgtatatctagaaaaccccattgtctcagcccgaaatctccttaagctgataagcaacttcagcaaagtctcaggatacaaaatcaacgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttatagattcaatgccatccccatcaagctaccaatgcctttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacaccgcatatctacaactatctgatctttgacaaacctgagaaaaacaagcaatggggaaaggattccctattcaataaatggtgctgggaaaactggctagccatatgtagaaagctgaaactggatcccttccttacaccttatacaaaaatgaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgagagaaaattttcacaacctactcatatgacaaagggctaatatccagaatctacaacaaactcaaacaaatttacaggaaaaaaacaaccccatcaaaaggtgggcgaaggacatgaacagacacttctcaaaagaagacatttatgcagccaaaaaacacatgaaaaaatgctcatcatcactggccatcagagaaatgcaaatcaaaaccactattagataccatctcacaccagttagaatggcaatcattaaaaagtcaggaaacaacaggtgctggagaggatgtggagaaataggaacacttttacactgttgatgggactgtaaactagttcaaccattgtggaagtcagtgtggcgattcctcagggatctagaactagaaataccatttgacccagccatcccattactgggtatataccaaaggactataaatcatgctgctataaagacacatgcacacatctgtttattgcggcattattcacaatagcaaagacttggaaccaacccaaatgtccaacaatgatagactggattaagaaaatgtggcacatatacaccatggaacaatgatagactggattaagaaaatgtggcacatatacaccatggaatactatgcagccataaaaaatgatgagttcatgtcctttgtagggacatggatgaaactggaaattatcattctcagtaaactatcacaagaacaaaaaaccaaaccccgcatattctcactcataggtgggaattgaacaatgagatcacatggacacaggaaggggaatatcacactctggggactgttgtggggtggggggagggaggagggatagcatcgggagatatacctaatgctagatgacgagttagtgggtgcagcgcaccagcatggcacatgtatacatatgtaactaacctgcacgatgtgcacatgtaccctaaaacttaaagtataattaaaaaaaaaaaatgcagcccggcgcagtgactcacgcctgtaatcccagcattatgggaggccgaggtgggcggatcacgaggtcaagagatggagaacatcctggctaacacggtgaaaccccgtctctactaaaaatacaaaaaaattagccgggcgtggtggcgggcgcctgtagtcccagctacttgggaggccaaggcaggagaatggcatgaacccaggaggcagaggttgcagtgagtggagattgcaccactgcactccagcctgggcgacagagcgagactccgtctcaaaaaaaaaaaagtttacttttatttttaataattattttcgaatttgtactattttgttaatttgatcattcatgtaccaatataattttaataatgattcaatccagaagaaaatcttaaatgtttttaatcttattaggaatttttaaaaaattagattcaaacttatgtacatatttatgctatagagtattatagagtaataaatcaagacattccagaaaaagaacatattacattagaataaaattctataagggaagtgcactggaagtactaaaggagaaaaaaggatcctttgtaatggattcagtcttcagattccccttgtcagctgaggtgcagaagcacaaccacatgattaacgcaatcagagatccccaccttgagtaagcatgatcattaatgcttatcatgaaagatgctttgctagggatacaaaatgcatcacaaattcacatcccttctgccttcaaggagtttacccttcctagttttggagaaaagtttaaataataatacaatttgtgctgggtctattaaatagtcattaaggtaatatttaatgatcatgcttaaatatgctctatgcctatcattaactcaaaaaagcaggttgcaaaacagctatgtatagtacagccccatctctgtaacgcaagtatacacatacatgcatagaaagaagactgaaaaatatcagcagaatgttgacgttagttctctcctgattgagtaggattacgggcgagcagaattgtttttttgctcatttgtgacttctacaataaagatcaggaaaaagctgttgttgttatttttaattaaaataaaacagcctatgtgtgtcagataagtaatggagtagatgagggtctctccacgaggtcagggagaagaacccatgccaggggtgttttggtcagaaatgccttaaaagccaaagtggaacttgactgggatttagaggaggagaaaggaagagatgaatattcaaggaggccaaaggggcagacatagtgcttttacatttttttattatggaaaattttaaacatatgcaaaagtagacagaatgaactgccatgtacagagcttcaacaattaccaactttcagttcttttttcctctgatctacatgcactctccccttcctacccaaattacttcacaacaaatccaagacaacattgtttcctcttaaatatttcagaatgtagttctataaataccatccgttttaaacctaatcacaacaccatggtcacactctcctggccaaaaccaatttcagcacttccttaatactattaaatattcagctaatgtttacatttctctgattgttctgtcaacaatgtttttaaatttatttgagtctgaatttcttccctccctccgtctccctttttctctccctttccctctattcacctttctttcttcataaaattttgtggaagaagccaaatgacttgtcctttagagtttcccacagtcagttttgctgattgcattcctgtggtgtcctttaacatgttcctctctctcccatattttctacaaattggtatgtagatcaagaattttgatcagatttaggtttaattttttttaaggcaaaaatattttgtgatggtgatgtatatttctgtagctgttagtgatcatttcctagatccactaatccactgaggattacaaaatgattatattctgtctaattctatcagttctttatagtttattagctggaacatttctaaacagaaaatcttccccttattatgttattttgttgccctggggaatcttttttatagaaaagacaagatgaaggcttggttctttctcttttcaaaataatgaatagtttcctaatatcctccaaaggtgatggatgtgttttgatttattgcagttatttttttgaccaatgggagactcttcaagttttcttctgaccccttttgaccagaccctaagaatttctaatagcttcctttctttctggcatgacaagatgttccagactcatctaatgtttttcctgctccagacatggaatcagtcttttctatcattgtctacaaattgtgaggtcacaatttgagtactaagggtatacattgctactaggttgatcattgttcctatacctttttaatagattatgatatgtatgtttctttttaagatgaaacacattataaatttatattcatagttataattcaaattcaagattatggagttttcacttaccctttctgatcttaaaatgatacctctttctacacactggaaattatggctaatggattactcatctgctttatcccacactgcacacacactagcctcagaatggcaatatgattaatgaaaatgggttcagattttttcttccttttttctctttttgcagttctttgtttttactagggtattccaatgagaaatatactgtataatctaattattgtatagtaccatagtcaaattgctatgttttcaaatcacttgctgtaattattctcatataccaccaattagatagataggtttttttttctttttaggattgccttttacatttttttgtttaataatattgtaaaatgtatagtttcaaagtcagattgataaaataaggtttattcaaagaagtctacctccacctctgtctctccttctccttatgcaattttttttattttatagcttaatggaaagtaaaacataaaatttaaaaaaataggatatatatatagaaaagagggacagggatagaaggtagactttataatataagcaagtacgtatctatatttatgaactcccctctcttaggtaaatggtgatgtgcttctctttataccactatatgcacctaccacctgccatgcttcctttaaggacagctggagagaacaaaaggaaaaaatatgaatggaaagcactttttcttaaaggaaaagcctacacaaatataagagattcatattagaaaacctaattttccaacgtgagattatttggagactcagtttttaattaacattttaaccagatcctattccttataaatgttgaggaataaatttttcaccagagagggaaagcctgtgctcattacactagctgaagcagagctttccaaggcatatccatttatatgcaacaagtaaacaccagctctgagagtcgcgttgcaaacttctaatgtttagttcacttctaagggatttaatcaaccttcaggatatatgattcaaagctcctaaaaaaagtaattaagaaaaatcctttctatggcaaggaaaaagcagattgtttccattaattttatgagtaattttgtttttgttggctgaaaactaaacccaggctggggtggtgcacagtgggaggaaggacttactaaaacagcacagagtttgtgtgtgtcacagacatactttactacacagtcatataagcacatgtgtgcacatagaccagccactgcagcttagtgttttcaaagctggtctcttctccccttacaagtcagtttctcctctcaccttttctacccttacttattcatggtcccattctgcacccagtcactctagctctcctttcatctgcatttcctatcagcttccaagactggcaggtctttgcttttaacagtctcttgatttcccgcccttttctttattctctcatctcatgccaatatatttctgtaagagtttctccaggctcaaccagtcaaacaacaaacacttactgaatgcttgctatgactacaggctctccttcattcgcttcccttctacattgaatggtgacacataacatgtcattcccttctctgagatctgaactgacaccttagttctttccacctcaagtctaagctcctctgttttaatttcaatacctgttacaatctgattccatcctactaaaatctacccccaaagtctcagtttctctattcacaccagattctgtctccatgccttatctattcattgtctctatacaaatttattgaacacctggcctatgccaagcacagtgctaagtgcctaaaaataagaaatggttcttggcccagtgtgttggctcacaccagtaatcacagcactttgggaggccaaggcaggaggatcacttgaggccaggagttcaagactagcctgagcaacatagtgagtaagacctgtctctactaaaaaatttttaaaccaggcgcttaaaattacattttttaatagacataatcccagctacttggaagattgaggcaggagaatcacttgaacccaggtggcagaggttgcagtgagccgagattgcaccactgcactccagcctgggtgacagagtgaggctccgtcttaaaaaaaaaaaaaaaaaaaaattagctgattgcgccaccgccgcacttccagcctgggtgacagagtgagatcctctcaaaaaaaaaaaagaactccttaagaagcttccacagtcttaaggtagaaatatgtaagaaaacaacataatgtggtatgatcaaggttttatttataaaggttttacaatgtgctgggtaagttcggagaaagagtgcttgttgattccacctgaggaggactaaggaggcaggctgcctgtttcctttaaagtccaggaaaattgtccaaaggggaccaaggcccaaatgaagggaaagctgagagtcaaaagctagtatatcttcttaatcaaagacaggaagaaagagagtctgagtgggagcatgtgaggacaagagggagcttctagagagtcgctgagaacaatattagaatggggatggctcctctttattaaatggtaggtgtttggtgtaaagttgctgaattggtgggatgaaggcagtagtgggaattcatacactgaagctgaggactactgtagcataagcacggaatcaaggttgaaaatggttctgatggagcaggaaagttggggtcagattgagaagggctttgattgccagccctgtatgcagttgggggcaggggcctcagaaggaagattggccaggcagtagggttggggtcggtcatgggtgaggtgaactccagattgattctcctagccacaaatcctagagaagaagggcatcaacctaggggaatgggacacctttttctaatttgcataaaggcgtgcatacattgcgagtggtagccccagctgtcatctgtattttaggaaaaggattctggcaacaagtgtttgttcatgtattcaattactgtttattgagtatctcgtatgtcccagacataattctagacccgggggactcagtggtgaataagacacacacatttcaaccctgagttcagagagagtaaacaatgatatagaaataaaagaactatttagaaaactgttgcccttcccttggcctttctctatccaattctactaatcctacaaaacccagctcagttctaaccatcatgccctgcttggtcgatagcccctatgcatctccttttccaaaacttctatttttaaaactttgtttaaaactatacttttttccggattacagaagtaacacatgttcagtatataaatgcaaaaacaatagaactacacaatataaagaggacatacctcataatctcacttaccatatagaactactttccattagtacatattcctataatgatttatctatatacccaccagtatattattgtcattgccgtcattattacattcataagcatcattataaaatgggcaagttactcccaaaactatgggaggctttttacctagagagagcatagaattattttatttttacaactttgttgagatattaccacatcctaaaatctaccctttaaatatactttaaataaatatacttaaatatttaaataaattaaaatattttaatttaaatactttaagtttaaagcagttcgggggtttttagtgtattcacagagttgtgcaaacatcgccacaatctaattccaaaacattttcatctactctaaagagaagctgcatatccattggctgtcactttctattcccacttcccccaaacccccacagcctcaggcaactactcatctactttctgtttatgtggatttaccaattttggacacttcatataaatggaatcatgcatatgtggccttttgtgactggcttcttttagttagtgtaatggtttcaaggttcatccatcttgtggcatgtgtcagcactgtctgccttcctgtcttccttctcccctcccctcccctctcctctcctcccctcccctctcctctcctctcctcccctcccctctcctctcctcccctcccctctcctctcctcccctcccctctcctctcctcccctcccctctcctctcctcccctcccctctcctctcctcccctcccctctcctctcctcccctcccctctcctctcctcccctcccctccccttcgattcccttccctaataatattccattttatggatataccacattttatttatctattctctagttgatagacctctggtcatttccaatttggggctgttatgaataatgctgctatgaacattaaagtggctgcatagttttacatccccaccagcaacatacaaggatcccaacttctccccattatcattgatcttagataggccaattggctcctaatggttcacttattgtttatgtacaaattacaaaagctttgtcttccaagtttatggtaaagtttgaaaagctacttttgagtgaacccttctctttggagaaaaatatttattcaggttaattttcttcaccagcaggacacagtacactccagtctttctctttcagcgatcacatggatccacaatgtagggttttttgtttggttttgtttttttgtttcattttttctttaaattctgagacaaggaaaaagcctgaacttaacatcaagtactgggctgttgccgaccctataaaatctgtgacaattaaaatattctctgcatgttagtcagttataccttttaagaggagaatatggacatgaaatgttatattggtaacagagctacaataaatctgcaggaagaaataccaccaaaatcaggttaaaggagacctattagctcaattaaagcacaagaacaggattaaataaagcagtggttgagaatagttaaattattaaaaacagtacgtaattatgtgcatatcatcacatttcttttaaaatattgctttaattcatttaaacatgataattactctttgtgcttgtaataaggtattgttttattttaaaatatggttaagtactgatgaatactcatctcgtagttctttgtcatgtgccacaatccaaacattgctctcttttcgtattgcagtcaagacccatgggaatcagtagacagctgctacaatgtcagctttaaaccaaaattttagtgagggcatatatcatggggactatgtgggaatttcttaagacagatggtcagcaacttcttccaaacatttctgaacagagtgttcttttcaccattaatcccataattatcttcctttttattatgaagtatcacttttatttgttaagaattgtagtaattttcagatcaggaagagtaaaggaaccaatatttatgaagtgatccctgaatgctaagatttgctgaagtggcatcgttgtctagggtaaatacccaaggtctgtagtctagtgccaagaagattaaggacacagacacacacgaggagtgagtttaggagtggaggtttaataggcaaaagaaagagaaaggagaacagctctcccccttgccagagagagatgggctcctaaaagggaaaaactgaccatactacaccatattttataggcaggcttgaggaggcggtgactgatatatgtagggtccacagattggttcgaccaagtgtgacatctacatagtgcatggggaagactggtcaccccaccataatcttattatgcaaatggagtctttgcctggcctgcgccatactgtcttctccttacagtacgcacggtttagcaaagagaagggaagacggagctgccattttgaacatgcctagtcccaggtagccttttcctattggcacaactgccggcattcatccgtgcaagcttccagcttgcttgtctatggctgcagcttgattttacaggctgttctttattagaaaagaaaattatttgggggctgcttttcattaaaaggaaaaccttaccaaggacttctgtaccatcgctatctgccgaagtaatttcttcttctgcatggttactgtgtgattcatttttttttaaaaaaaaagaactttgatttcttgtgatttccagtaattaaatgaagatttttaggagtatcatttaaacattcctcagatatgttaactcataccctttataactgatcatgaacattgtaatgaaatgcaagtgtttataacctctcagtggaattgaggaaagaagtaatagaatctggtgcttatctcctcccaaactaagcaattgaaagcaatatccaggcaaaacagagccctcaatatcagtggaattccagagttggactgagttgtcaactttttcccctggattctgagtctaccagttaagagctagaaactcagggccaaagtgtagtatatgtgtagatggatggatggatggatggatacatacatacataactatttttaaaatgtcactactgtgttatgtttagagtaagaatttcagaatctctaaagttttaaataattgccaagcccaaatcgtctgtcttggtgctcattatagaatatggttatagagaaactagtcattggattaagaaagtaattccattgccttattaccaatgttatacctcaaaataaggtgtgactgtagagcaacagtgtatcactaccttgtgtaattgttgatgagtttagaaataagaaactcaaacatagtttcttttctgtaaagaagaggataaaataaaatctttttagatttgaagtgttcctctttagtaacaaccaagtgcccaaaagcgtgttgttgttttattttatttcttcagacatgtgtcttatgtgtttgtaattaacaagattaagcaacatttgacattcatgattattttcaacttagcatattatctttttcctcttcgtcattttacttcatcattaatgctttgaataaatatcattacaaaaaaatcaacaaaataatttaatttggatgtagtgtgaagcatggagcttattttacttcttctttcctttatgaataattttatcttaaacataagaatatcaaagcattaaataatgctcatcaactaagccaagtgcccagtaagtctagcttttcattacgagtaccaaatattactatctcacaagtccacaattaaggggtcagcagttcttcatcacatttagtgtgtgtgttcattatacaaataataaatgcattcatattgtaaagtatgcagataatatataagaatatctagtaaaagttaaagttctcaccctgcagaaaatcttgatctcttcactattgatagtttatgtgtatcttttcagatcatttttgatatgcatgacaattaccacttaaaatttcaaagaatgttattacttgaattttactcagattctaattatatgaaattcagttcacccaatctgaaagtgatattcatatgagaatcccaatttttttttcaccagatatttggaaactttcctattgctagaagaaataaacacaaaagtagaatgctgtaaagagtgtcgatgtatccagtactactattgatttttcaacatgaaagcatgaattttcttgtatggcttgtggtatttttctcactaccttatcaaaaatgttctactgtgtttcaaaaacaaacctgtccttctgcctacatagcgtaagagttaactgccatcacaataccatagaaagagtatgggttttggagtaataaaacctgagtgttagtttcaacttcaccctttaatagctgtgagtcgttaggtaaattatgtgtattctcatcactttcctcatttcctcatcactgaataaggaatagcaaaactagccatctccttaggattgttttcaagaacagatacattgcagtttttgtccaaggacttatgatccaaaatagacatgacagacattgtatcattcaggattgactaggttttgtgcttgctggatataacagacctttatttcttacaccatatgtccaaatgtagacatggagggggttctgctcattgttcactcagagacacaggctgaggcctcatcttcacaaggtgcttcctcagtcaccttggaaaggggaggaaatgaaccaagataaatagtggcccttaaagcagccacatggatgcacacatttcattggtcaggacaggtcaaatggctcagggaagctgggaaagacattccattgaggtagagagctgaaaattagtgaataaaactaatgaccaccacagaagtgttagcaaatgttagaaataatataaagtaggaaaggatgaaaagtcattctttgttattttgtttcttgtttttgtctgttttgtttttgaagtcggagtttcactctatcacccaggctggggtgcagtggcatgatctcagctcactgcaatctctgtgtctcaggttcaagcgattgtcatgcctcagcttcctgagtagctgttactacaggcatgcaccaccatgcctggctaatttttgtatttttagtagagacagggtttcgccatgccggacaggctggtctcaaactcctgacctaaagtgatccacccacctcggcctcccaaagtgctaggaatacaggcgtgagccaccccacccagcctattcttttctttgatcccagagagatcaaaagagacttccaagggaagataacaagtctggggacacaaatgggagacttgggtggtatcaggcatggagaggaacatagcttgaaaacttcagtaagaagagaaagtgagggagggatggcatcaaagtgaatgatttgggtctcatacgtgtctgaccagagatcaaccccacactttcagatttgaggagggtcgcaaacttcagcctaagtttactgatcctcagtggcccctgtacatcatcagatggggatatctgtcccacaaaatgacctcaaggccacacgaccccacttttctgctcagttcttgatatggcttctagtgtctggtctcactgtagcattgtggtgttacttttggactttctacagctcctggtgcttctttatcatgaaagatcacttaccaaaccagagttagcaacaccacagcttcatacaccactgaaacaatcacacaaagttttctgtcccctcagaacctctaaagagcactctattttcttggtgcttgaaaataaagggagtgagtctcttttattatttacaaggaagacatgtcaaatgaaaaaagtttaaatttcattatgccaagtccagtgtttttgttaaacttccttagcttaattgtagaaaggttacaagtctacaagatgcttaggattccatatatatatattcacacatatatattcatatataatatatatgaaaataagttatgtacatatgtatatatacataacttattttcagagtagttcttcaaacataccacaaactgtgttcagatgggggggtgggatgtgtttatgtttgcgtgtatgtgagtacactgagggaaggaagaataaggaaaggggaaatgtgaagcttcaagaaggggaaatgaggaatggtcttcttgcatttgatcaggtggagaactgtggtcagaaaatgtatgtatgctttgattttaaactcttaatgccttcttcatttgatgctcaagggaagcaatggtacaaaattaagtggtataaaattaaaattgtgtggatcagagaactggagcaattctgtgcaaattaccttgaacacccaagccagcaagcagatcagcggtaggagcaaaaacaggcgtggttactatggcaaccttattctgattgaggaattgtgattcatacctgaccccacattttcctttcccttcttaattgggtcctgaagatttatagtgctaccaaaccctctcacagagcgataccacataaccaaagatagctatctcctagcaaggaaggcacaagtaacttgggatgaacaaggttcagggtaggtaaggcttagccagggagataaaagtgagcaagaatcatcagaatgccaagcctccaggccatgtcctgctataccacagccctgaaatgacagaaccaaagtaagaccatagaagatgggtcagtctgtgaacagcagatagaaaaccatgagttgctcttctaatgatcagaaaaacactcatggataagggaaacaaatctttgtccagaaagtaggagtgggaagtacatctccagcttgcatttctgagtttcagctttctcaactctaggacagactaaaaatatataccttgaaatgttgctgtaaggcccagaaacacaataaattatcttcaactactcagattagttgtctgcaatcccttctgagagggaacttatgggtggccacactaagaataattgcaagttcttggctgatgtttttaccttaaaagggaaaatcaaagttcagggtcattggcaaagccgtgagaagctctcacaataatttttattttcacgtactaaataaagtgattttcagtggtatttaatatcagtagtaagaatgggtactatagaattaatttccatttatctttaatcctgtattaatattaatacatcactgatgacattaatagagaagaaaaagaatggaaagtgagggattgtatttaggaaagaaaatcttctacttagctccccaaactctcgggatcatctaaatagggacccacactgccaacgtatgcttctcctgttggctgtcacattcatcagatagcctgatccgggtttctcctctcttgaaggaaatatgatgcatagactgagtgagttattttgtttattttggttttgtttgcttgattatatttttctcatatggggcagtgtaggaaatcatgtaagccttattaccccacaacaaggtgtctctagatcatgccccttgttcaaaaggaatttccttcaagcatttaactttcttggaaggtatttcctctgcaatatgttctaaaattatggctagatggtggaaatgctgctttatgcttcagcattctgacatcgtaatcctgaggttcttgacctggaatctatgggtctattaatggaaatcagaaggcctatgaaccatttgaaattgtatgaaaaaaatctgcatgtagttaaatatatgcagttttctggagcaacttctcttggcattcatctggttcttaagtttggcagtgactcagaaggttaagaattatcacaatctgagttctttgtgtctgttctcttcttggcactagtgtttatcagtggattgtccactgagggtttggtgagagtaggaaaggggcaacattaaagacatttttactgtcttggaaaaatatgcaattataacatttagagtccatacaactgtgtatggcatagcagattaaaggaagtgaatggaagttggtttcaaattacatatttatcaagtcaatttggaggcatttttaagcacataaaagtaaatctacatatgtttgaatttcaactacaaagaatttatggtcaagagagattatggttatatatataactacatatactttatacagtatatacagtactatataaatagtatatagtattttgtgtatatgtgtatatggtactgatcaagatagccctccagtgaccatgattgtatactatattttgtcagattcgttactcacagttttatgtggaggttcttcaaacataaagctcttcttgccattaattgttttctaagcctctaaatatttatttacttgattatgcacaccattattctgagcaatttcccctactctgtctggttcagatatgtcttatttgaatcgccaatctctagtatggagacagtcctatccataccacatcccagagagctaaagaaggagtggctttgttctcctgtgcattttaccagacatacatcagtccctacaaatcaacctggtagaatttcttttaataaggaagtactgagagagacaagatttagctatatcatgtaaatccaagcatgagtattttatatcgtgtttggacccaagtactcaataattgattatgaaaattatataaattctagcactaaaactcaagaggttagtaattaaaaaacaaaagagcttttttgttttagcatttcaggctcatgctcatcatgcgtgacatctcacacagaacaactgaatctagtaattacaaaaagaataaaactaaaacagcttattggagctgattgggctgatttttttttcaatttgtatactttacacaatatatgttctattaaattattctaaaataggctgtgggggtttttccccccaggataacatgaaacaactaaatcaccagatttttttttaattccaaatgacaccagtgttgcaaagtcagaccttttgaaaaggacttaacagagggccacgagacatgataggtgcttagggtgcgattttaataccaacagactggaaaacaaacagcataacccagacaagatgtgacattgttctttagcatccatgtgaagaggaagtaagatctttctgggatgtgcttcccagtcacaggtgtggaagagaaatatgttgcattcttgatttactgcactgtgtgggagattctggtttggggtaaggaaagggagcatttcattgcttcttacagtaaaacttcagctcacttaactcagctggtgcttttgtttcagtctgccacaaatgaacagtaaaaaaacatgaagcatcccttaatcctgtgagcctggggtgtgctggctcctctcactgcattctccagctctgttgccaatggaagtgagagattgaccccaggcctgcaaccactgttctttgctctgccactaaaccactgagctgttgacactttaattgttttataccaggaggaaaccaattgtgttgatgtgaatgtcttattcatcaaacattacagccttcacatttttaatgagctgacactcctagtccaatacatgcaaccacagtgaatcaagacaagagtatagtgacaaagttttctaaattattgcagttgctctttaaaagatttgatagtatttcggaactcccaatgctacaattagaaagtctgtctgagttgtgtattaatcgaacatgttcgagttataaaggatggcagtgtagtaaaggtaggagttaataatgtatattttttccttttccttttacatgcatagacaaaaatagagacatgagtgaacaaactatttataaagtacctaaggcggcatctttctgatgtatgaaaatgtccaaattatccccatgggctgtgttttgaaaactgcaatacttgggaagaagcttagtttctatgtcatcatttgtccagaacattgaatatttctcatgggtggaataaaacatttcaatactaaatgttacaaacctggtattttgtgagcagttgcagcagtcatttgaagaaccagctgcattatctgatttgatggcatcctaaagaagacaattatttacccacagactttacagtggcagctcaagacttcatgtatatgaaaactgtatgactgcccttgggttggaacctgggactctccacccaaagcctccaacacctcctctctgcatatagaagaaagcccagacccctaagcaggacatttcaggccgtttactccaccaccctcacctacctttcagcttttcctgtgtctctgtctgcatctgtatcctaacaggcaaacatgtgtctgtcccattggccagtctgtgtttcccagagtccttgcctgtgcaagaatgcccttctttctccctttctagacattaaattgttacgtacttttcagttattcctcactgcagtggcacctctaggatagcacttgtattttccatgttgacttatagttagctgttgtcctagccacctccccttcccaatcttgagctccttaaagacagcagtggcatgttggtaaatatttaacagttggctctccagaaagagagtagaatagtcctgattggtcacgtttgtctatatcctgtcgtgtagatactcccatgatgggtgatttcaagagtggctgtgtttaacaactggcaaaattcctgaaaagtttcacattcacatctcttgaggcaggtcaagccagttccagaacaccactggaatccatttttaatagtccatgtagtactctcctctttcaccctaaacactcttctttgcttaaaaatagatgttcagcaaatgtttcctgaattgatttaggcaaatcaattgatgctgttgctccttcaccactgatcttatagcaggggttatttctggcagtgattcaggcaacacttgtacttcttctcatttcagagtggtggccttagccatctcctccatgccacactgcacaggcatgggtgaatttaagtagatggattttttctgaattgtggtggggaacaagttgatggtcttaagttcaacaacctcattagagcagaatgtgattgactgtgacttcaacaaaaaacagagaagaaagcctaaatcacagagtcaagactgtgtctcttccaaggagataagtggaaaaaagtggaagatccctggacagtctggagaggtgagaagagagaaggctgctggctcagttcccattttattttcaccttttaccattctcagtgtctcagatttgtaaaacttttgtgactcacactttcagataggagtgtcactatacttttcattttagttcgtgtaataaagtgccaaaccttgttacctctgtttttataataaacttggaagtcactactgtgcatattaatcctgttgttcctttggtgaccagcttgttccattttgcactgcccccaccacccacattttagaaccaaaagtcccaaatcctaggccgggagtggtggctcactcctgtaatcccagcactttgggaggccaaggtgggtggatcacttgaggccaggggttcaagaccagcctggccaacatggtgaaaccctgtctctactgaaaacacaaaaattagctgggcatggtggcgtgtgcctgtagtcccagctactctggaggctggggcaggagaatcacgtgaacccaggaggcagaggttgcagtgagccgagatcacaccactgaactctggccttggcaacagagtgagagactctgtctcaaaaaaaaaaaaaaaaaagtcccaaatcctggaaacctcctcagttcagagacagctggtcaccctagttcctgtaaaggttgtgggttctatcatgactgctctggtatttaaatctgcaatgtacctcctattgcagatatttcagaagacactgaatcatgactaaaaggattagaacttcttaaaaatttgagttcacaaaatctattatcttccaaacagaacctttcttcaaaggtcctatctttcaggcacttttattaagtggaagaatacatgggaaagtactttggataggagaaaattccacatgagcacaaaatgctggtatttatttctcataatggtacacattccgttaattatgtctttgacagctcatcttggattctatagaaatatagcaacatgctatggtgggataactagtatcaaaatactttaaccaattataattttgcatggagtgcgtgttggagggctttacatgtagtacacagagcttcgcttccacggatgaattcagtgatttgtccttggtcgatcagttgttcgttggcactgttgtgaagcagcttcgtgttgtgaagcaggtacatgggagggagttggcagggggcttagcgagctgtctagcacccgccacccttagcttggagttgttggaccctcatcactgtctgcagacatttcctggtggaaacgatgtgctatagtggtatgcacaatgtgtcacttcatgtcactgtcaggatgtgtcctcacaagaatagatatttctgctgtaatatgacatctgtgttcccacctgtgttcagcagaatactacagtaaaagttgcagggcttttgtggtgggggggaaataaggtaaagggtagtccacttcaaatatattgaacttgataagcgcagcactcagaaaagcagtaaaaattaaaatgctagcagagtttacaggtgaaataaacttgatgtaagggttgaggctgcccaattttggatgcaagggcaaaatgctcaaggatccaggaagattgtacaataaacagttaattccaagacagaacatgtaaccaaaccaaacgaaaagaaagcatgtgggatgcagtactacaggcctcttgggcttgcatgcactgtatttatgtatcttgctcatggctgctgttacttggtgactcaaaataacattggaaagaaatctcccatgaaccaacatgacttctggttcatgctgacatcattctgtattaagcaaaattatatgtgatctgatttatgctacagaaatgaatattttgttttgcatgtttccgctaaataagatggttcacaaaacaggttcaaagtcgtaggtgactgtatgtttggaattcgaaaccctaagcatgaaaaactgctgcaatacattggataataataccagacaagttttaatttggaaaaaagaaatccacccaaagtagagtcacatctcctctaaaatcttttaattaaaatcagacatgaacccttgtgtttctctattaaatacttggtttttagttgttttatgagatttgtgtatatgcattttaagttgagaaaaaatgcacactctggggagtgactttgtatttggtttgtttaaatatagtttagtaggactgtaatatataaggagggttaagggtcagaatcctatttaattaacttataaacacttgggagtcagtcacttgtaaaggtatgctgagcaaataaggcttcaaataacatgaaatctttgaaaagaatatgccacctttggtgaaggcttttctattaaccttgtcattaaaactgtttcaatgaactacttcaaacctcccagtttttatttatctttatgatatgtttaatcttttttaaaaatgatatatgtatacaatattatatgtttttttattaaaaaaaaagattaaacatgccttggtgtatctaagaagacctaaatcagtacttttccctatgtttgttttcccattggctgagacaggaagaaatcccagaattgccatcctttttgtccatgtgtatctaaaatatgaccagtgttttccatttgcataaatctgatttaataaacagtcacaccattaaaatagaacattcttttcaatcaaggctaattacacatcatataatgcctggtctttaatgaggatttcaataaatgtttgttgataatggtgattattaaaatgatatgttaagtcagtcttctcatgtgagaaatgctttgttttgaaatgttagacttacagctttgcctaaaattttttaattaaaatcaccactttggcatgaagcttaaaatgtgcaaagttgctgcaattagtgcattgtgcatccatatggatgttaccaaacagctttcaacttaaaggatttgggctattttgaatgatgggccttctgttaagcttaaaacaaagcctgactatctctgcattcattttaattaatattctcttgctggtctcaaagatgtgttctcttctagggggaagaagcatgattatcataaatcagaaataagttacagaagtaggtttgactaattttctacttccttctgtttcataccatttcctccaactcctacccccttctcaaggagcctcaatgcagtgtcagagaaactggaaaacactgatttcagatattctaaaagaaaacctgtatttctagccaaattataacacattaaattcactcaaagaataaggaaattaagctgtcccagattttctgaattcagtatgaagtttaaaacttaccactttgaatccagcatccatataaaatctacagtataaaatttgactatgtgttatatatacaaatatgtgtgtgtatacatgtatttgatatttttactttagagagatttgtgtttgcctaggtgcttagggtttaacaaccttatgtgtgaacttaattctctataataggaaatgcttcttgaagatgaattaggtaaaacaatttgtttgtttttcttggtattttaagcaaaaccaaactcaaagtggcaccgtcttgtaagtttgtttttttctttttccgggacattgttcatgtgaaaccttcttgacatggtacttggggaagggaatctctctggactttgttctcgacaaaatcagaataaattctttaaacagttacgcgctttagttaaggccctggttttctgactgtgttcaaacatctcccctacaaccactctccatataccttcagaaggatatctactccagtggtcactgggatcctctgactgtctgggtgcccaagtaaggcccattttgaatgctagtttaaaaggcatacagctaaaatgattttttttattttcattaaactcttaagaataggctaaatgtgaaaaattacaaagcagaattgtaatttaccagaacatgtgggtagaataattcatccaacatgtgactggacaggcacaaaatcagtaagtccagtatagaacaccaccatggtcctgtttttctctttcattctagcattatggaaactcattatacatccactaaatttggcacaaagttatcctaattttttcattattacctggattatttatttttatttcctttttgaaagcatgtaattaattgcgtgcctatctttaaatgcctccttatgtatcaatattttgaattctacatttgagaaggaggttggaagtagttttattctaaagctaatacataaagctaaatttgatcaaattataattatttttttcttgaagagaaactaaacgtattatagctttatactgtctttactgttatgaggtagctttctttctgtcaaatgttagtatttttttcttctctgttaggcatatttacaaagaagtctcctaaatagaaatgagcggattacctcacagcttcacatacatcctggagaatatcctgttcacaatttaggcgatgaaaggaaaacctacagttgttttaatttggaaccaaaataatcacttctctccagtgaggcttagagggggaaaaaatgtgccagagttgtcttgtagaaaaaagagtactttgaggaagggcaatgcagcaggaaaaaaaaaaaacaacaaaacacagtcaaacaaacggagaaccttagagtgcataaataggccagtgaaacacagaccacctgatcacatcgaagcacactgagtgggggtcctcagcgatgttgtccctccggcatgtaaactgcatgcatgtgtgtagtggtgtgtgtgtgtatgtacacacagagatttaacaggagcacagagggaattagaaagagcctggctcgtttttaatttgggtctgtttgcttgcatttagcacttaagggcttctacattcagtttgctcaaaagagtgatgaagcactccttgcttatgcctcaaatcagaaatgcatgaagtgcagctgcagagataatacattttccccaaaggctttggctgagcaaattaggtgtcaatggggtgcctgcgcaggcagtactctctctaattagtctcttgagcctagttggtggcgggtatgagatgatctaatcaattggtctgtgtctgatggttcgtgtaaaaatcctaccaggcagactctctcccacaggtcacccacctgcacagcgggactgctcattttcatttttcatctcctccatcacatgatgctgacagttggttttaagaaaattgaatccaaaaaatatctagttcatagggcacatgggtcagaacaaagttgcattatgggtacgggcgatccaattaattaatatttatagccaagaagctctatgtagatatttctgaataaggattttatcaatcaaatccaatttcttgtttaaaacattcatttctagagagaaagaacattgtaaaagctgaaagcaagataaaaatggcatccactaatcttatgatttatatacctatgagtggctatgcacatagttgagcttataattcatgtacactgttcatttgtgttgtgcatgcaacatgttttaataataaaggtaagggaaagaattacattgatattatatttcacttccctgtgattgtagtataccctctctccttccacctaaatccccattcatcaaatgcatgattgcatttagattttcttaaaaattttccagcaaatctgacctaccttatatgcacttattgaaaattgaagctgatgctgctcaaggagggagaagggacatcccgtgctgctggctaacagcaccaggcagggtagctggcacaatttgggccattcggagtcatctcacagagatgggaaagagtctgcctctcattggcgcctctcttctgttctcattattggcttcttccattaaatgtctaagcccaaacctaatcactgtgttcactgtttattatccaattactattattacatattatcctttattatgcaattctgtttatgccctaggttaggtacatgtgattctcctagagattacactcaaagaatcaggacaaggcaagaacaaacatcatcgatgtctaaaaaacatcttaacccaacaggatagtgaatatgccattgactgtggtgacaacatagtttattgttacgtgaaattagatgtactggaaatcaaatcattcctttcaaatataatgtcatggagttaaaaaaaaaaatgtaagttttgcctacaggaaggtgttaatcctaccaaccatcctcaggctggtggtgtatctgtgaatggcctgcagtgtgtgcagtactgtgccatttcacaggcatcacatttgccttcagtgaatgtgccatagggaactctacatatgagaacatatttcaccaccaagtcttctgattctacaatttcccctttattcattcaacaactgtatattgagtgcctgagccgggcctgggctgtgctctggggacacagcagtctacaaaatcaagcttaatcaagaacatactgatgccacctgtcccctgacttgctccttcacaggaagtgtcttcacacctctggagggactaaatgaagtctctggttcaggaagtcattgtgggtaccaggtctccattctgttgattaaaatggtaaaagaggagagagccaggaaagactacatcatttggatatagttgtaggaacttcatgcctgggcaagcagatatcaggacagacctaaagctcccatttagctggagtgggcaggcttccaggaagagctggaatctcaactgctgtttaaagtacatggaagaaaaaggacagttttgtcatctgcttaataaaaatgtgaaggctgatagtggggttgaggattggctgaggatgcctgtggacaaatgtgcttgaagtactatgaggatgagtgctttctcttcttgatgtcatggtcctcaaaaagatgccagtgcctagatcagaatgcatagttacatggagcagcatgtagagcacgttcttcgtttccctgaaagaacaagggtaggctggggacaaaggagtttgttcccatgtaattatttttgctagggtggtgacttctttaagaagaggtttgataaaggtatatctgcacaatcaagcaaggatgaggagtggtcaagtgagccttatggagaactgcccacaagcagcaaggatttgagataataactgttgggatgtagaggtagcaaagggcctatgtgtggtatccatttacccccaggcctctcctggaaacttaaggcttttgtttttgaggacagagaactctcaagaatagaaggttacccctacctcataccatatacaaaacttcactcaaaatggaccaaagatctaaatgcaagggctaaaactataagactcttagaagaaaatataggggtaaatcttcataaccttagatttcacaatggatttttagatataacaccaaaaatataagcaacaaaagaaaaaaaaagataaattgcactttgccaaaattaaaaacttttgtacatcaaaggacacagttaacagagtgaaaaggcaacctatggaattggagaaaaatcatactataagggattaaccagaatgtgtaaagaactcctacaactcaacaacgaaaagacaacccaatttaaaaatgatcaaaggacttgaatagacatttctccaaagaagatattcatatggccaacagccacatgaaagagtccccaacagcttgggcatggtggctcatgcctgtaatcccagcactttgggaggccaaggcaggcagatggcttgagcccaggagttcaagaccagcctggacaacatggtgaacccctgtctctacaaatataaaaaattagccaggcatggtgatgtgtgcctgtagtcccagctacttgggaggctgtggtgggaggatcagctgagcccaggaaggtcaaggctgcagtgagctaggattacatcactgcactccagcttgggtggcagagcaagacccagtcaaaaaaaaaaaaaagatgcccaacatcatcgatcattagggaaatgcaagtgcaaatcagttcatacccactaggatggctataattttttttaaacaaacaaatgttttggcaaaattggaacccttgtgcattgctggtggaaatgtgaaatggtacagccatgatggaaaacagtttggcagttcctcaaaaagttaaacatataatttccatatgacctagctattccacttctagatatatacccaaaagaatggaaaacagtgtttaaacaaatacttatacatgaatattcagagcagcactattcactattagccaaaagatgaaacaacacaaatataaatcaaccaatgaatggataaacaaactgtggtatattcatacaatagaatattattcaaccctaaaaaataatgaagtactgattcatgctacaacatggatgaacttcaaaaacatcatgctaagtgaaaaaagctagacaaaatgggtagcatattatatgattccatttgtatatctagaacaggtaaatccatagagacagaaacattagtattaatagttgtcaggggctgggacaaggagagaatgggagtgactgcttaaaggatataggatctcctttgggggtgatgaagatgttttggaactaaatagagatgatagttgcacagcattgtgaatgcactaaatgccactaaattatattcttttaaatgattaattttttatataaattttgcttcaatttttaaaaagaatggaaagttaacttgccagaaactcaccatagtaagtgggggaaatgagcagatggtggagagaatgctctttttatttttattttttttatttttttgagagggagtcttgctctattgcccaggctggggtgccgtggcacaatctcggctcactgcaacctctgcctcctgggttcatgccattctcctgcctcagcctcctaagcagctgggactacaggcacacaccaccacgcctggctagtatttgtattttcagtagagacggggtttcaccatattggccaggatggtctccatctcctgacctcgtgatctgcccgtctcggcctcccaaagtgctgggattacaggcatgagccaccgtgcccggccactattttaatggttcctgagcataggagtggaatttctgctatctggacaaggtattgctgggttgctgctatgcaggggtgatgtccttgatgccacagcctgtgtgtgcagcagcaggacaggtgcactgtgaagtctcaaaaaaaggacaaaacctttgggatcaggcaccatccagggttccccctgcatctgggaagatgactctatggccctgtagctggagacatgaaggcctcaccaggccttagtgaccagcagcttctaaacttagctaaggaactggttctgggattcagtgcagctaatgaaccgatccctcagctatgtgccttgaacctgggagtgtttccacccatcctggcaaggcattcttttcccatcctggagactcaatgaaaatgcttaagggccaaaaggaagtacggaaagggacagagtgaagcttccttctttttgcttgaaccattcacccacaagttgttattgttttaagcaggcattattggaaacacgcagtcctatacaggatgttgggaagaggctgccaattcaggtcacactggccaattttcattctgctggaactgaaataatgataataggcaaccaaggaattatatacagctgaatttttttaaaagcgtgtttgtgatccgtttttctatttcatgttcataaaaatgaacataatgatacgtccttttaatggtctgtatgatgctacaggcacttaattaagaccagtattgctactaatgatttagggaaggaaatttgctgaatttctttttctctaaatatccaagaggaagatagaccaattcagttggtggagttaaatgattttaagagaggaaagtgtagtcagaacatttgtttatcatattagaaggatttttttttggttaaggaggctattctgcttcatatttatgtgtttggagtggctgtggggaacatcagtggactcactttggactgaccaattttgatgtttcatgtaatttagaagaaatgaatggtgtagattttttatataacaattttctattttcctccttccaggattaagttgtcatcattctgggaagaaaaaaaaaacattaatgaagaggccaataatatgaagggaatcatggatcagttttctttcgctccctgtggtggatttcacttacaagaaaattgaagctggcaagaccctgttttctctgcaatttatttaaaaccttgcacgcatttggataccttgtgatttccaagaactacgtgaagattaagctttgcttactgatacatggcatgtattcttttcagtcttttgtgtttgattttgtttgatttccctctgcagcacagcgtctctgtaaaggtttttatgctttcaccagccatgtcttaaatacattaagacaacacatttggtgttcacacttcttcagtaatgtctgaacttgaaagccacagagtggcataaaacaatgtgtgttttctttgagagcagtgcacattttgcaaccactaggaaggaaattttctgctaaagcaaacccctgttctctgacttgacaacttggccccggactgtggggccccacctgttgcttaccttttgaggtaattttgcaaatgtggtttttttacttggaaataactgcacatttatatataggatattggactctgcttagcattttcaagccacatagcatgactgttttttgaataggttggaattgaaaaaacaattatcaaacgttaagaacaaagacagggataaattgcttacatttcaacctctggagattgaggtaactttttgtgtctgggtcttgtcaacatctaatttttttccatccattctgttacactttgtattttctaactggagaaaagagtgaggaacagaatgttttaaatctggtgcaaaagaactatatctgctggatgagccttgaaagcagtcttggcctgttagggcttacaaagtaaattacaaagtgatccagttcaaagtttgcttagttacaacaaagcacctttaaaaaaaatacattttaaaaaaacattccaagccaattggaagacatcattgggttcttactttaagacatctcctggaataactgttcaaatgcaggttttagaaacaatgcaggaatcttgctttaaagatgaaaaagggaatgggccagcttcccttactcaaggagttgagggaccttggaggatgaaggcgagtatgtgacactggagaaaagtggaccaggcatgtcttttgctttgatctggagggagggctgcctgatgcaggccggctcccagtggggcaggcctcgctgcagaatgcccagtagtactgcggccaaggggacagttaggagacttcatctaaagcatgaaacctagctcctctacacacaaattcctatggaaatacctttgtgtacagtgtcttacattttcctattagtcagaaagaaggagagaatgagtgagtgcttgaaatgtgtcatactgttttaggatcaagactaggaattaggagccaggttgacaaggactttttctgagagttgggtgagggtaaagcttttctataatcaagctcaatacaccaaggaaactggatccagaattcctaaactttaaaatggtactgtctgcggagtggagtatggatggttatgtcaaagtcatagttcatcctatccagatgtagcattcatggtaaacttttaagtgctaagcaaggaattatttactgattggttttaaagagagcagaaaacacccaagtgtagaatgtctactgtttgctacctagaaatcttttccattcctctttcatacattccaacccactggaagtctttagaggtattttgatttaaagtatacttaaattaggatttcttaaagaaaacatagggagaaaactttacatgcaattaaaaatggactttcctgtgatttgtttttaatcattcatttggagaagaggcatgacctttgtatttcactaagtttaaagcaagagcaactgatgattaaatgttgctttttaataaggtttttaacttgaaaatttgaaaatatttaatgttgaaagacttcaattagggctattagagttatatctccctgtcgtaggcagcttcttcggagaagtgaaatataacattactcagtggacggagaaatctgttttgttacagagacatgcctctcagaaggtcaggaggttttgagtacctatccttgccacccatacaggaaatccaaagtttggtgtctctctctctctgtctctttctttctctttctccccccaaacccctctcactccctccctccctctctccttcccctatttgcaatcatattctccctctgcttcttttctcttctgccctccttgtgggcagtcatgaaaatcaattcagactgtgttgattagcagatttattattctattgagaaagcactggaatgttttgtgagattatttttatatgaaggaatagcctgaactcaaacagatggtaagaatagtacaaacaccttagcacatcactgcacacacagtattctgaaaggagatttgacacttaattcccattttcttaaaataacagttttgttgacttaaaaatatgagatacataggatgtgaaaaaaaatgtttgcagtactcagcaaaaaatagggtacataaagcagggtggctgtccatccactgattctggggtgagaagcgatttctacctcgcaagagtgactagaaagtttctaggagcacctccaggcttgcaaagaaagtgaggcctcttggtatcctttcctcagtgtgtatatgacagccagtataatcaataccctaggttatgcgtctatatgatactcatctgtgaatattattggttttgtaatctttgttatataagaggatgtttaggctgtatatactggggtagattattgcctgccccttatacataggaatatgctgcataattgcgcataacttccatctcccttactggcttgtaggcagaggaaactgtatatgttactgccttgtacttttctcatacaccaaaaacacaccaaaaaaatcaataaaataagcaatcttctattctcattccttttcccacagcagcatattttagaggcacatacaaaacctacattctctagttgggagtggatttttaaagttttccttttatcttttatttttttttgtatgatgcactgagatgtgtactttctaacaggggattggtacctaagaaatgtggtagcattattcagaaaactattatactttcaaatgacacatagtaaggagaatggaataatacatgttgcatatttgttaccagttgtaatttgtctgtattatgaaagatgtaatggtttgtcagctgtcactgttgttttcttgtaacatgatatggaataaagtatagcagaatctccgt

SEQ ID NO: 335 - DNA, 24173 bp, Homo sapiens
agaacattcatactgaggccagagtgccatcgaaggtaattatagagacagtaaaatccttttactctgggaaaaataaaatgctgggtgtctcacaaaatttcagaacctgatttcaaacggatcataacaaagaggagatcaaatttagcatggtggactgctcgacaggatatatttgtaagtatgagattctataaaatagttgataaatacaagactattggcttgctataaatcactagcagatgctgatttcaatggtagaacttctgggagtgttaacagaggtttttctaagaaaaaaagacaaactaacaaacacatattcttttgcctggctttctatatttaaaacaaaacttagagtcactccttatataaataaatcttctaagttgggcaacagaggaaatgctacagttttaaagtatattatttcattttatgtttttgtgtatattttcattttaaatgtttttcattttatatgtttagataaaaacatattataaaatcagacatagctgaattatttgtttcaaaaatcatgcattaccaaattattagttccatcctttgttaactgtactgaagccaggtgtggattattataaggtttatctgaaacattgttaatcttgattttgtagaatttttttattcttttatgttatgcttaagcacaactatgcacaaatttcttgaattttttaaaggacaagaaatttgtgtgctgtggtcaacaaaagctcactaaaatataaattgctccaaattttactaaattttatgtaacatgctatatcataaaataaagaaacatatttaaatgcagatatatgtaaacagacagaattgctttaagaaaatttatttattttcataatactttaagatttcatttaaataatggaggaaacaaatctaattctggcatactactaatacaactcaatccattaccaatgcatttataatcactctgagaattagattctatcggtgaaatgtatttctttcaaataattatcaggagaaaacagtggaggcaaaatcatcgtggagacctaaacttgttctaaacactctatgtttcgattgtaaaagtacacactagttttaccaagagggtattgaaaaacaaaaaaggaaagcaaattaatacacaatattaagataaatatagattatttaaataaaaagtaatggaaaattacaaattaaaacagtaaagaaatttttataataagccatgatattaacacaattttagataaagagttaataaataaaaatgggaataaccataatccagcatttccgaggtggaaaaagtatttacttaaaacttaagagcatttacagtaatctttgccaaatatgcattctccaggaagcacacaataatctttttgtttttgtttggttttgttattattttatttttaggtcaatggaatgtttccacatattataccaccaacatgagaaaaaaatgatcattgtttatttgaagcttggtgagtttatccacaatttaaatcagttctacgtcatgccaatttagatcactgtttcactgggaattctctttttgccaaagtagatttgtagttctataaaatatttaaagttattttttatttttatccatattgactacttgaactctaattttaagggtacaactaaagatgcccttggttggatttaactaacaaaataaatttatcaataggatgttttaatcaaatccttatcctaaagaactttacttttgtaaaaaattagaacattccctttatggaattaccaaggatatttcttagaagttctcaattgtaaatgtgagaggatttcattctgccactctatattggtgctattaaactgtcgattgagatgtattatttaatgataaatattgttgaatgtaggattgtagatacttctttttaaaccaatggttattttgcaaattctttgtcctcagactgtgaattatattttcttattttatcagatgatattctaacgctgccttttctcttctcattttagaggtatgagaattttaatttctacttctgagcatctgccttccatcttccaaaattactttggaatattttgtcattatttttccccttggttaatctcctttttccttcagtttaagccgtacatgttcctttactataatattattagtgtttgggttggaagagataataaactcaggtggtcaatctgaccttttgtacctgaagctgggttaagtattttttaatttatctctttgtttcaatgtagagagtgttataaggatgggggtggggggttctgtgatattccaacaaaatagtggtacatggtacgtgtgaatccagtagtaatcaatagagagaaacacaaacatgtggatggactttcagtcccagaaatcttagaatacaggcgggaaggcaccaggctccaggcacaggagcagaactctagtcactggaacagcgtccagtctccagttccatttcctaaaggacaggaataccagagaacttcttatagtctatttattctatgcataacaactcttagggtctatttattctatgcataacacatgtcatacacaattctgtcactaaatattttctgcaatttaatcattgatgcttttatgacattatattctatttgtattccataatttaataaatctgtaaatgtttgacttagaatgctaaccaacatataaacaactacttatatgtaatcatcaaataacattcgaatgtaacaatttaggaaacttaaagtctagtaggagtagataaatcagaaatataaataacattatatctatatatattgcttctttttcaatgtcacctaactaataagttgcttggaccaaagaaccctcactgaatcagtcatgtagctgagcacagggctactattagtgtacacagagtctttgctggaattattaaaaagtagccttttcaccacatggatgaagccccacttggcttcacacctggcaaggggagtgtggttggatctcagccttgtctctccttttggaccaggcatctccatagagagaacaacctgaataattgcatttaaagggaagctgtggctgggctgtcctcttgtcccttttttctgtaacactcaaccatgcctgagctcttctggcagccccaaccatctgggtgatacacacacccagatgtctgtaaatctctgttgtagacccaactaattctaaagctgggactcagtgattaatataatgtgtgaacaatcgaaatatagaaacatgggaacaacaaaaatgaagagaaggaggatttgcagattatatgttgacatgttgaagaatgaataaagttaatggggaaaacttgtgagatctgagatgaaatttaaaaagaggaagaaatgcggtctaacagaatatatgtttcctggtacatacaaaagaacttaggaactatttcatttttctaatctttacagttccattttagagaaaaggaaaaggaaatgagaatctgaggtttaattaatatgcgcaaggtcacacagctaataagagcctgacctcgagcatatgtctgtctggcttcaggccccagaactatttgaatatactctgtcaacttgcaggagctgtgggaagcccctaaattctagtgcatccagaaattactttaccttcactatacttcagaccttagtgagtgttgcatactaagaccattctgcttttgccaatttcattaaatttataaaagaaaatatgataacccattaatagacacacatttgagttacagaaatcaccacaataaaaggtctgaaaatgtgtacacatagctccaatagatcaagtgagaagacagtgggacagaaaaactattgctaaaaatagagggtaggggagaagtcaagtctcagtacaagatagggaagactaataatattcacagagaagacatgtgaaggaagtaaattttttcctatcctcctacttagaagataagctgcgagtcattgtgtaactacattttataggtgatcacagagatgaggaatcttgaaactcgaactaagtagcttgaaatttgaactaatgcagttcaaggtccaattacacacaggaccagctattgacagtcaatgtaacagttttttagtctcaattaatttcagtgttcattttcagtcagatttttctttctagaaaaaggtttttattttcatcacactgctgtttaaagacctcagtggattacttctactaacaaaataaagtctaacatcttcagtctggtatttaaggtcatctagaacctaactatgcacacaaacatatccctttaataaactctcccttttgcttaagtattgtgaatctctatttgcaatcggaagagtcctaataagtgaattaatctattccccttccattttcttccttcctatagatataaataactttattgcttcttggtcctcctcacttatagtagagacttacatagaaaatgaagttgatcagaccacatttctcatatgttcttatctccaaacctgcaaatgaacttgaatctatacctatattttcactagttacaagagaatagtaactatttcctgtattttcacttctccaatgtcttaactcctacattctgaattctagcccctccttcttcttcaggaacctgaaattctattggttttccttctttcttctgtgttttcaaactctgtctatgtaccttttgccaactttagagtatgtcactcacattgtaacttgactttattgtaacgatgcctcctagagagacatgcaggccagaatcatcaaatgacaagaatctgtctctctgtcattattacgtctttctatcaacagctttcaaggaagaaagagaaaaagagagagaaagagagaaagaaggaaagatggaaggaaggaaagaaagaaagaggaaagaaagagagagaaagaaagaaaagaaagaaaaaaaagaaaaaaggaaagaaagaaagaaagagagaaagaaagaaagaaagaaagaaaagaaagaaaagaaagaaagaaagaaagaaagaaagaaagaaagaaagaaagaaagaaagaaaagaaagaaaggagggagggaggaaggaaggagagaaagaaagagagagagaggggaaaagggagggaggaagggaaagaggaaagcagggaggaaggaggagagggaaggagggcaaacagaaattacaagcaggctttcatttgtcctgggcctcattttctcttgctttcctccttgtttctgtcctccctgctccactgaaaccactctcagcaatgtcattaatgagcatcttgtgaacacatctgacattttttgatcctttgctctcttaatcacttcccagcttttaacactccattggccactctttcctttttgataaactcattccttggtttctgtgatactgtgttattctgatgcaagctccttttacacagcctttctcttaaatatttgtgttcagaaactcatattgggctgtctgctttttacagttcacaccgtcttcctggacgatctcgtcattttttttgttagagggggctcctcttatgtgttttatgaaaatagcccacctttatcctgaagccaaatctctcacctcaacttgttctcttctgtctcaccttacatatccaatgggtcaacaagttctaatagttcttcctccaaaacgtctacaatctctctccttccctccatctccactgccaccttcctaatcatccctcacctgaactcctgcagtcacaccctaactgggctccctgatgacactctggccacactgccattcattctactcacaaacccatttcaaatcttaacatgtctattctgaattttaaatcctgcaatgatttcccagcttcttactgtgaaatccatggcctgtgtggctcaacgtgctcggcctctgcctagcattacaaattctcccaccactttcttgctgcagtgaacatttttaaacatgattattggttcaatcttaactctctaagcctctcagctcactgtctcattctgtctgccacactctaaattcatgtggaacataattcctttttttttttttttttgagataaggtctttctttgtcacccagactggagtgcaatggtgtgatcacggcacactgcagcctcaaccccctgggctcaagtgatcctcccacctcagcctcctgagtatctgggactacaagtgcacaccactatgcccagctaattttttttttctttttgttggagagacagggtctctctatgctgcccaggttggtctcaaactcctgggctcaagagagcctcctgcctcagtcttgcaaagtgttgggattataggcctgagccacagtgctgagcctaaattccttttatttcctcaatgggacataactcattgcctcttaatctttgctcaagttgcccctccttcactcagcacactcgtggatatcctgctggttccagctcagatgttacttaactgggctgccttcactaacccctcaagtctagttaggttctcctcctaggtgtattcacaacccctgtacttcctgtatccaagtccccatcacatttcgggattttttgtttttgttttttgtttttgagatagggtctcactctgttgccccagctacagcacagtggtgcaattacagcttgctacagcctccatctcctgggctcaagtgattgtcccactacagcatcccaagtagttgggactacaggcatgagtcaacatgaccagctaattttttttattttttgtagagacagaatcttaccgtgttgcccaggctagtctagaactcctgggctcaagcaatcctccccgcttcagcctcccaaattgctgagattacaggtatcagccactgtgcccagcccatcacatgtattttaattgcttgtcagtgaggacagaagaggacagacaagatgtatattgatcacaggcagccagaacttggcacataacaagtattcaaaagacttttgaatgaatcgtaaagactgatataaaaattcactgtttatccttaataattcattatatatgtatgtatatatgtttaacaaaccatttccagctttaaaatgtggatttaatgactcttaacaaatttgttagttgtttttttaaagtcctgagttaaaaaccttctatgatatgtattgttatgtaaaggtgcctgagatgaataaactctaactgaattttaaagtcaaagttactgtgcccagagtagataaaaccagataagcagcacccttaaaattcactcagaaggtgctttattttttatttggctatttacactattttacttgtccagttaaaataaggctcttttttaatacattgagagagctttctaaacacaagaattgtggctgggcacagtggctcatgcctacagtcccagcagttcggaaagctgaggttggcaggttgtttgggcccaggagtttgagaccaacctgggcaatgtggtgaaaccccttctctaccaaaaatacacaaaaattagccagtcatggtggcgcatgcctgtagtcccagctactccagaggttgaggtgggagggtcacctaagactggggatgtcaaggctgcagtgagccatgatcatgccactgcactccaggctgggtgacagggtgagaccctgtctcaaaaaaataaaaataaaaataagaattgtcccaaaagggaagccttgggagttggtaaattcgttatcggtaagttctaaatgaaaagatctttttcagagatttggtattttttgaacctcattgtttaataaataggccagttgagtaaagtcatttacaaatctaagcacgtatatttttataaaatatttatgagagatgagtcattttattctcctctctcctcccaactcccccagtgactgtattccattaacttcaagagcccatctttttttttatgatttataatattgtatgttccttagaaactgactgtaacatacaattattttaaatgattaaattatacaaatatatactgtatttccttagaaaaatgagcaggcggaattgttggatttgtaagatgtgcagagatgaatctaagaggcccccttcaaagtaagtagcatttaagtttctatggtaattgtaaagcatatttatcagatgataaataggtacatatttattaaactgctattgtaacatattttgttcagaaagtaaaatttgcatttacacgtgagtcatttcatcagaagagcagtcatatgttactaagattcttgttttcattattcatggtttacacttgagaattcagcaagttaaatgctttagaatctattatgaatagtctctgttctttttaaaaaacaaagaatattgtttgtgttaaaatgagattcttcaatccaaaatattttcttggttccaaccctccacatacgaagtgccagaaagcttcatccctagataaagaaggtgagactggaggaggaatcaaatgttaaccaagctcccaagtctcttcctccacacttttctataactcaaaatgttgccatttggatgagaacagtgaaaagaataatgcctgagaaaagtaacagaccattgcattggatttcctcacctgaaagaattcccaaaagttgagaacccctgttagattaaccatgagtgcctaacatagtccatgtccagccctcagttctggccacacctttttgtatggtcagagcccctggcatgaatgctctttcactaaaataccaaaatgtccaaaaaggcttacaagctactgtgtggcaaggagaaggatgctgcaatggtggtcagaggagatagtaagacccaaagctcagcattttaaatgacagtgaatgctactgcactgcacaggtgcatccaaggacaaaggtataatctgctaattaagggacagctctcctttcttcgaatgattcccatagaggatcactgtcagagctcgcctttcttctatctgccttatagactcaccatgagaaaaggggaagaccagaaaaattaaaaatcacattcatggaaagctgccagataacagttatttaataggtacttggcattcatgacctaatttaattttcattataacattgtgcgatagacgttattatccctattatatagacaataaaattggggtttgaagattttaagtaagaccaaggacaattaagtacagcactgggattagaacctaggactgtcagagactccaaacattcttcattcttttgtctgcaacatcatggtatcttaaaatgctttcatatccgtttggtatccactgcccatccgcccagaagaatggaggggacacaagggagaacttgtatcaggaaaaaaggtatttcaaataatcctaataaaggcacctggatagccatgggccagcattaaacttgtgagaacctccaaaaaaaattataagcaaaaatggggttcaattaaaaacaaattgtatttcccatttttacccccaaccgtaattactccaatcatctctccccataaatctcatgagtcttagagacaaaagaactctcttaccaacaatcatcgacacttaattttaagctaacccaacacattgatgactcttcactcgtgttgtagattttattcttccctatataatgggaatgattagaacggacaggcattcaataaaccttgcctagctctttccatttcaccagattgaaaaggttattttaggttactttttctaaagttttaacaagagaaaagaacaatgactcagatactatttcatggaaatgttttttgaaagcaatcttaacacagtacactgttaagcctcagtactgatgcaagcagtccatccaaaactggcaggatccgtctgaatttttagaaaacaaaagatatctgaccttttaaggactcccaatatttttccatgttctcggatattttttaatctctttaactaatcctccttcattgtgttaagaacctgctaatgctgatggctgttcctgcagcactaatttttaggctgctaattttaggtatagccaatggacagtgcttgcgtgtctatagccatcttcaattatctagttgttgaaagcagaacaattaagaatgcaccataaactgaatggcaataaacacattgcctatttctgttttatttccaacctttattctaagttcatgggtacatgcgcaggatgtgcaggtttgttacataggtaaatgtctgccatgatggtttgctgcacagatcatcctatcacctaggtagtaagcccagcatccaatagctattattcctgatgctctccctcctcccacgcccccaccctacaacaggccccagtgtgtgttgttctccccaatgtgtccatatgttctcatcattcagttcccacttataagtgagaacaggcagtatttgattttctgttcctgcattagtttgctgaggatatgggcttccagctccattcatgtccctgcaaaggacatgatattgtttctttttatggctgcatagtattccatggtgtataaagttacttgtatttgagaatacagtcatttgccaattcacctcatgaagctcaccaaaatgaacagagttctggaatctttcacaactattttctaaatggtaaatggctttgtttataccgtttaggtaaaatgtaacttgacataatacaccttaataaaaattaaaactgatacaaaaaaattctagcaagtaggagactgagaaaatactagctttagggttactaactgtattacatgagtgcatgcaaataggttttgtggattaactctaagattctaatagataaataggtaaacacttggctggtggcagcggcaaacagtgcataacccttttaaaagcaatttggcagtctgtaccaaaaaccttaaaaatctgcctcttttaaccaactttgattctactgctagtgccctggaattactctaatcatgtggccatggcaagccttaaacacagctgggctacatttgagtttttatggtgaaaaatgagagaaaatcaatatgctgtttgacaataattatgtaaactatggaatgccccccttgtagcatatttcaccatcaccataaacaatatgactatcaatgattatacatttgtaattataaattataacactacaaatgattaatacaattatgatgacataaaatgcataaagtataaacacacatagtgtgattacttcttgattaaaaacacacaaatacaaacataacaaaaagactttaaaaaactacatcaaaatactaatagtggtaatttattaatagggagattataggactatggttctgaataatatttattaaattatattttcaagtctacactatttgcacaatttttataatttaaaaaatttaaatagtaaaaataaaatgtaaaatatcacaggaaaataactttccaaccaaagccacacacaaatggaatgtaaatatattttggtgtcattttcaagataatataattttacttagttcaacaaaaaccttgagaatatttagcccaatcagtgctttttgtttcttttcaaagccttactttggaggaagtattacagtgggcccagtcttttgaaaatttaatggctacaaaatgtgagtattgcgtatctgtcatctttgaataactagcgagttccattcttagaggtaaaggtgggggtgccagatgatgaatgtatgctattcttctcacagccttctaactggcaactgacacagttaaaaaaagaaaacctgaaaatagtttgttatgtcaaccactattattttctctggtgttaattaaaacaagattagtcactgtgaatattcttcacaagtatatgcacaaaatcccttggaaaatatgcttaagtagtaacgcataccatagccttctaaagttagtattaaacaaaaacacttaactcgctgttcttgctgccttcaaaagtaagaataaatttgagtcttgctgttctaaaactcctccccaaagtttgtttcaactttttcagtgtctgatttaagtgggactatacatgggtctgaatatagttgtaggtaagtatcgacattaacatggtacaaataagagataccagcaatggatgtgacagagacaaagtcatgggctcagtgcaggaaaaataaaggaggacgtgcattcaaaagaatagtcaattgcgtttggggtcagaaaagctggtccgttgtagaaaatgataaaaccagaagacaggtacagaaaaaaaatgtagggtgtagacacagaaaattctcttgttgaatttggtagttttttttaaatggagttggttcccctcaatgcttgttaatttttgcctatagaaccatctttttatttaagatcccattttagcctctctgtgaatgttttatctgtttagagctatggactatgaaggagagttggctgtgctacttacatgctttaactagtggggtgtaccagtggctattctgggcaaggtaccccctgttcctcatgggggttgtcatagtcctgaggcactacctgctctttctgactcaagaccctctttagtatggactcagttgtcactgcccagcccagagggtaatggcagtaggtgtagacacttggctactcctgctgaaacacgttaatcaaccattctggcgcttacttctgcttcatccctagggctggatctacctctacaggcttgggtcaccacctgagctctcatattttgtagcatgcctttccaatgggcatttggggccatagtttctttctttgatgcaatcgccactggctttcacttttcaggtattcctcatagtttataatccaatttgccagcatgaatgtgaattttaaacaaatatatcttctgggtcagtgttagaacattgaaatgtgatgaagagacaaaagtgcatattcagttaactatattgtaaatttttgtcccaatcctctgtaatacacattttgccaccttgctagattgatctctttcttggagtttcatactcttcatctacaaaatgggaatagtatcacttatcctttcaggtttattgtgcaggtgagatacaaaacatctagctcaatgcctaatatagattaagcacacaataattggtagtttcttttaatagtaataaagtacatgtctttgaatatcattcttttttctctgctgcctaccaacaagtccaaaatcttggtatttagtactctctacaccctaacccaaaacattttctaaaatttgtctctagctatgacctgtcacataacatgccctccaccaatgtgggtcacttcattttctacttgtacatctatgattcttctcctccaggcttttgttcaaagtccttttcatctctagttactctgctcatgtttgaaagtcaaattcaagtgccactttctccagaaaactgcttagtaatttctcctttatcttctattttgttagtattaacatttattctgcttttaattgtagccagtttgtgtattgggttttttatatagtggctttctccctagattataaattccttaagagcacagcttgcctctcatttacctttcaaacccctgagagactgaaaatgtgctttgtacccaatgagcatgcaataaatgttccatgaataaacacaagaaaaatattagtgagaaaagttcaaaacaccaagctatattatgtaagtttctgtgccagtcctggaagccttattaaaaaaatgaataggcttaattatttggcaaggatttcaagtggtcatctgccttgctagaatcagcaatttagaattctagtgtcatgagaataagcaaaggctctagcaaagatgagaataggaaaacatcatactgctctttataaaagccagcaaaaatagggtaagagcctttccagaaatcatattactatgaagttcacataaaaattcaacaatcacataataagtaataaaacgaatcattctatggatgatccaaccagtaagacaaaactaaaaatacaaatattaaatgtgccagagaataaaaatgtgtttacattaaccaaggacattagtcaaatgcatgctgtagctgagatatgcagatgcatattttacatagattaaaacattatttctaaggacagtagctcagacacacacatgaaaaagaaatatatcagcctgggtctcaatagatgaaccgaaattggtttagagacgttttagggagccattaagtcatagtcatcaaaatacaattaaattcaacatctcagtgggaaaaggggatccaagaaaaccatcagtttgagaacagaagtatggcaaaatccaaaagttaattagaaattaagaatgttagcaacttagataccttttagataatgctatttaatgctacattatttgcaaataattttttacatatgaaagattttttttatatatttaaatatcaaagattttcttgttatttatatgaaacataatgtaaccaaatagaactaaagtagagagactagctagaaggctgctacaataattcagataaaattggaactcagtagggaagacaaggctgggggtaatttgcatatagatgctaacaaaagtcacagggctgtgagaccactgagagggagagttcagatagaggaaaacacacccagagatgaaacttaggtgtgtgctacttccaagtccaggtaaccagagaggtcagcaaagtggatggaaaaggagcacaaagtgaggtaagaatgacgaaaatagtgcattcttgtggaagccaaagaagagagtgtttcaggaaggaagctgtgaattgtcaaagactgctgagaagtcagctgaggtgaggaaggaacagtgaccactagacatggcaatatggaagtcaacagtgcctcaacaagagcagtttcatgggtatggtggagataggtaaaaccagaggaagcaatacacagcataaggaatcactgacataagttttgctgtggagttctgcagagaaaaaagcagagactggaagcgggaatgaggtcaataccgaaagtttgagtcaatagttgttactagttatatttgggaaatacagcaatatatttgtaggatgatggcaacaattcatggggaagaaactgatgacacagaagagagtggagatacttataagaaaaatagaggaatgcaaagtaggaatgcaaagtaggaagaagcaaaagtaggagggaaccagaaaaaaaattgtttggccatcccaaaaaggaacagggacacttgcccctcaggagagaagttataaaggaggaatacagatggaagtactctggttatttctggagagaagacggtgaatatccgtctgattaatctgtgctctcagtgaagtttgaggcaaggtcgccagtagattgcttaggagaggatgttttagtatgttttaacataacaacggaggaggtataaaatagtttctgcagatttagagaaccatgatactatggaaggctcattggttgactgggcagtgttgagtgtctgtttaaaatctgaagttatgatttcaaatgcgagaccacagttgtatatttttctctggcttgttcaggttgccccagcacacacgcagagcagatattaagccattccggataagcaagtgctctgaatcacagagtttgcttcaatcttttgatcaaaatcatctttgaatgtactattttccaccctttctaaattaccacaatcccatgcagaccaccttagaaatgccagttaaacagtgtgggattgacatactgctgaaggcaatgaaggccgctccatatcatgaaccatctgtgtgggctggtgcatcttcctcagcatcatggcacagagcaggcagtagaagttactgatggttattgttgctcccttttgtacatcctgatcccagagtcattctctcagcttttttcatctgtgcaagctcctttgctgcacagtgtgattggcagtttcctacactatcacttattctaatctctgctaactactgctgttgccatggctcccttcatcaacccttatattacctgcactgccttcctctaccctttccacttagcactttttgtcttttttaacttctcatgcacttcttcaccttgcaaagggggaaaaaaacctcgcctagaatagacatcactgtccaattagtacattttttttttggtattgctttcagaaaaccaaaaagcaatagcatttcagatataaacctgtcgtctttagtgcttcctagatgttcaataactaaggtctgcttcttcacttttcaagagccacagagagtcattttaaaacagaaacatgagggatccaaaagcccaaattgacatgtgtttattcagtgcctgctatatagcaagcagtgttgaggcacggggtacatgaagatgaataagctgcagtcctgattctccaagggttctcaggtgaatgggaggataatggaaggaaaccacagcaaagaggggtggcctttatcacttgggcaatgggaaatgttgagggggataaataatagatttttgctttaaagatttttctctaataaaagtacagaggaaattgaaagcaggatcagatagatgaatcaaggcttcttcagattcagtggtttacaaatatacctcaaaattcataaacaaaaataatacgtaaaagagaacagaaggtaacgcaataaaggtaacagagatagtgtcttcagtatataaagagatctgaaaaatttaagaaaacactagcaatgcaaagaaaaaacagacaaaagatttggaattcacgggaaaaaaagaaatggtcagtaaaaatgcaaaactgtttaagcattatattttaaaaatacatatttaaacaactacaagttactgacttcaccccattagattggagagcgtggagtaagtcagcactgacactgccattgggaatgaaaaataatgaaatccttctgaaagcaattttacaatatgtatcaagagtctccaaaaatattacatcttcaatctaaaaattctattttaaatcaattattttccctaagaaaatagaggtgaaaaagtttataagccaaaatattcaatgtaggataacttataaccaagaaaaggggaaacaacctaaaacaataataatagagtggctaaatatgttatggcctaccccatcaacagactattatatgatcattaaaaatgaaaaagagaaagtgttccctatgtgctattaactatgaaagaataagaatgatacaaaattgctttcatattataatgcccataggatcattccagtgtgtatctgtgtttgtgtagatgaatgaattctagttaggtaggcaattattcatgaacaaaggattaaaagaataaaaggaaatataccaaattgttaacagtagttattaatttactagaagttttctgcattaaaaacgacccacagaattgaacaacgagaacagttggacacaggaaggggaacatcacacactggggcctgtcatggggtggggggagcggggagggatagcattaggagatatacctaatgtaaatgacgagttaatgggtgcagcacaccaacatggcgcatgtatacatatgtaacaaacctgcacattgtgcacatgtaccctagaacttaaagtataataaaaaatatacattatatatatatttttgctattaaaattaagtatttctcaataatttttattaaagtttaattaaaaaatgaaattattgatccacagaggactgattccatagatatggaactcaaggattcagagggctgactgtatgccattatggaatattttcctctgaagacaacaatatatttacacattttattttcagccataaataacaaatattaaataggaaatttaaaaaatacattaaaataaaggaccataaatttgaaaaaaagacccacaactctttaagctgtgtttataatattagtaatattaatattaataacaaaggtagaagaaaaatcagaaattattaacagcatagaagccacaacagagaattttaataaaactgaagcttcactgtaaaactccacacatactatggtagaattatgaagtacattatccccagtggtacagattgaaaataaaatggattttaaattggtttagaggcatttctaatggtactgcaacgtagtgcacccttgggatttcctgcctggtgtaagccttgcagtcttacagaaaaaataattctggaatagatgggccactgttctgactcagccatgagaaagcccacatttcccttctgcatcaagaacactggcatgtgtcaccttgtgtgtcatagaaatactaattttagtgactagttttaaaagaacaggctagagattcccaaaggcaccactctcactttttaagggaaaagtatacactatgtatgacataagccatttcttccatcctcccaatttaaatgagcaattctgatgtttatcatcttattcactctgttcaagcagaatcgcagtcttctgagcataatgttcaggaatgagtatcatttaaaacttcagaacagcctacattgcctgatttagaaaaggcttttccaccttgtaattcacttgtggtatgaatcaatcgaaattctaaagagagcaattcagttctgactttaataattactaagattcctggaacacttttacacaaatgcattttcagccgctagcttgagtaacttgcagcatattcagacaaaagttagcctgatgcagacagaattctgtaaagtatgccaatcacatgagtccgctcattctgcacgctagaattatatctgaaatatatagcgaaatccagttcagctttcgctagtcatcacatggtaacaagtgacataaaatcctagtgatttacattaataaaggttcacttctttttcatgatacacaacagctagggtcagctccagctctattccatgtcttcattccagccttcgggctaaaggagcagctcttttctagaatatgctcttcttgtggtggctgtgggacataggaaatagaaccacatgatagttcttaaaccctctgcttgaacgtgtccatagcacttttgcatgtatttcattgactaacacaagttcaatggccaatgctgacataaacaggacatggaagtataatccccctacacaaaggtcaggaaataactgaggaacaatacgacaatctgccacatcaagtatctgaaatataccatatttttaatagtatatatagaatactgtatatctatgcagtatatatagaataccatatatccatgcagtatatatagaataatacaactggatctataatatgtgtatttatgtgtggagagatagatagatggaaacagatcgtgaagacagaaaaaaagatagatgatagacagacagatagatagacaaatagataaggcaatgtatatatggcttcattagcaaaggactttggtatgacaagaattgtagaaccatttggccagcccaaaaaagaaacagggatacttcttccaatccatcaggaagaaagttaaagaagccagatacagatacagttggttctaaaatgataacctataaacattttactacataattaagctaaacataaacacaaattcagaatactagcttagaatctaatattagtttccagatcattttcctacccctacctactcatccactcaacccatccaagtagcctgtgtgacagactctcattccatgagccatagatttttatctgctatctcattttctttctgttccatagctaagtacaaaccatataaatattggcttccaactttacttgttaagccagaaacagcttaacattctgtttttttttttttatttgttcatttgtttgtttgttttttggtttgccaccattcagctgtctctttaggaactggagtaccaattcctgcatctgtgttctctgttccaacctttctgtgcctatggtgagacaagacacaacttagagtcacgtcggtgtgaaaatcaacttcttgtttaaaatctaagttaaaatatatccccctcacattggataggaatatctaatctatatcattttctatgttacatttatataatgcctctatctcaactgtcctcttaactcatctcatgttatgtccttgttgaaccgtatcccatgcagtgtcctgaaggctgcatttgctcacgtgataataatagtccatgtttcaattttgagtattcctaggatgcaatatttacattcggtttccccaactccaatgcctccttagaagagatctacttctatttgagttcttttgcttgaagacaaaatacttcgttatctttgttcctatatcactgctaacaaagccaagctatcaaggagcctggctttctagtgctggaaaacttgatctgatctcttagatgaagatccaggaaaatatgatcttactcatcatttccattccatctggctaccattatttctcataatagtaaatgatattgaccaagatagtgttaatcaaaatcctacgcttttggaggtgatagatatgtttatggcattgattgtggtgatggtttcttgggtgtatacttatctccaaattcatcaagttgtattaaattatgtacatctttttgtaaacaaaatatcctaacagtctctaggtggttattactcagtgtgcctacacaaacatttcttttaacatcaattgaaagttacattgttgttttatcatatagcaatccaattccttggatatgcgaagagaatttctagtctagtctagtcaaaaaaaaattaatatcttgaaccttgagaatacttggtcctcccaaagattccaattaatatgttagatttgtgagagctcacctaatcctctttttcaaatattactacctacaaagtaatgtctcaattggaaaagctcctccttggcttatccttatctaagcactccagaaaggcagtttaagatcagagttgaagataagaatctccggcatcaagtgttatgtgatggttacgctgcacataatccctgtcctgtactagattctgagatagtttccagcatcgcgtctgatttttcattccttgtctggtcccttatttctggcttgaaccataaaccatgaatatgaagttgaattcttcatctatctgtgttctgctctgattagacattgagaaacactccagggtgtacaaactaattagagtatcactcttacatggcttggatatttttctcctgaccttgacctacaagtttacattcaaaaccctgctcttaccctacagtttggcatgaggtcttagatttttcgtgtcagcttcatgattagagcccccgtcctcctgagcagcttaagtccttttcctgggctctgtgatgtctcctgtcctatctgtcctagactcatccacactggtgggcattttgctctgagtgactcagaataaatggatgacatcatcagtgatcagcattgtcaaagcacgcttcagatgttcgctctaagtgtgtgatagacatgaaaattgatatatagagatagatataaaatatttacttgttaaataatttgtgagtttttaatcaggcttttttttaactgtattgcttagatttttttggtgattttgacccatgaaaataaactgatttctcctctacttttagatggtccagtagtctatgcagcatatttaaaaatggagcacagtgacgagaatattcaattctggatggcatgtgaaacctataagaaaattgcctcacggtggagcagaatttctagggcaaagaagctttataagatttacatccagccacagtcccctagagaggtaactacctgacaatgacaggaatggaaatcagttcatccctgcaagggcattaatatctgtcaagcatccataagtgccaggcactttacatccagtatctcctaaaatgctataaattcagtattgctaaccttattttacagataagaaacctgagactctgagaacttgtccagtgtcacacagccattaagtggtaaagttaagattcaaaattaaatctatctggctccaaagcttctccccattaaattatcttgatttctaggaaacttaaaaagaaaaaaaggagtctgtggcgaaagcattggccttcccagcaggaactataaatatcatgaagagacatttgagaatcctgtgttgttgggcaatgagaaataaaaagtctgttaagggaataaagacagaggacagtatatgagatttctatcgtacagggcaagcctacattgtggacatattctagaactcttgtctggaaaatacttggtttattgaaatagccacttctcccctctatttatccacttctcttcattttcttcccatttcagagcatattcagttaaatcaacatttgtgactattaagggagataaatttttaaaaagcaccaatttctcttttctttaaaaagacatttgtcttacaaacttcctgatttgtagactgctactaagaaaccactgcatcttcctgagtaagccatggttttggaaacttccctggccttgagcctcatatttttcttttttgttcctcttggatgtggagttggatatttacttttaaaagagcaaaatgtttattttttatatatcttcttagatgcctataaaactacaaagaaaattaccctattccactgaaaaggagagcagagaataaattaaacctttctactatatgtgcctttttttcaactatgctaacttaatgctgtacatgtaatttcacttttcagattaacattgacagttcgacaagagagactatcatcaggaacattcaggaacccactgaaacatgttttgaagaagctcagaaaatagtctatatgcatatggaaagggattcctaccccagatttctaaagtcagaaatgtaccaaaaacttttgaaaactatgcagtccaacaacagtttctgactacaactcaaaagtttaaatagaaaacagtatattgaaagtggtgggtttgatctttttatttagaaacccacaaaatcagaaacacagtacaaataaaacagaaatcaaactataagttgacttttagttcctaaaaagaaacatatttcaaaagcaatggaatctagaattcttataacatgaataacaaaatgtacagcaagcctatgtagttcaattaatatataaggaaaaggaaggtctttcttcatgatacaagcattataaagtttttactgtagtagtcaattaatggatatttccttgttaataaaattttgtgtcataatttacaaattagttctttaaaaattgttgttatatgaattgtgtttctagcatgaatgttctatagagtactctaaataacttgaatttatagacaaatgctactcacagtacaatcaattgtattataccatgagaaaatcaaaaaggtgttcttcagagacattttatctataaaattttcctactattatgttcattaacaaacttctttatcacatgtatcttctacatgtaaaacatttctgatgattttttaacaaaaaatatatgaatttcttcatttgctcttgcatctacattgctataaggatataaaatgtggtttctatattttgagatgttttttccttacaatgtgaactcatcgtgatcttggaaatcaataaagtcaaatatcaactaaagacttacattatctttctcaaagacaaaataaatatattttccagtacaa

SEQ ID NO: 336 - DNA, 24173 bp, Homo sapiens; identical to SEQ ID NO: 335

SEQ ID NO: 337 - DNA, 381722 bp, Homo sapiens
agatgcagggaagttttgcctcttcctgaaaattatattattagctttttaaaaatcaggatgactgctagttttgtttaaagtatttgttctggaaatactaaagttggagtctaccagactgaggttagaagcattttctttggcagcaagaagataattttatagaagccatgcctgttcttggggttgcctcaaaactgaggcagccagctgttgggtcaaagcctgtgcatactgctcttccgataccaaatcttggcactactgggtcacagcactgttcttcaagacctttggaacttactgaaacagagagctccatgctttcttgtcagcttgcgttaaaatcaacctgtgaatttggagagaagaaacccctccaaggaaaagccaaggagaaagaagacagcaaggttagttgctgaagttacctgcagacttgtgtagctaaaatgcacatttctctttaagtgcactataaaacatgttatgaaatggggagtagtagaggaataccagtgtaaggatgtaagtagttataatggctgaaaagctgaatatttagcttatgtaaacactgtattcttagtttagagttgtaaaagtcatgatcaaaattttctgaatatgcatctattgtaatcatttaatactacttattgatgaatgcctagttagttctagatattgctctattactaataatcataatcagtcacaaatgtgagaaaaagagaacctattgtcatccatactgcaatgtatgaaaataggtactttcaaaaagacatttatttgtaataattcatatagacaccatcacttttctctaaatgtcatttgcatttcaaagaatttctgcttgaaaatttgtatcataggctgcttaattcattgcagtatgaaggaaaatgacatactattttccttgatactgcacatttatatggactttcccttgtaaactgaaacgctactcttttacttattactgacatctttttcagtcatttaatttatgatattttgtgagtagttgctcatagcccttggtttctaaagcatactacaaccgttttctccagtcacgcatgctagaatggcactgaagctgctgaacttcatgcggattcatttgtaccttgataagcgtcacttttgttttgtgcatttttacttttattggtacatattaggtgtatatatttatgggtacatattggtgtatatatttatgtggttcatgagagattctgatacaggcatacaatgtgtaataatcatatcagggtaaatggagtatctgttgccttaagcatttatcatgtctttgtgttgcaaacattatatattcttttagttatttaaaaatatagaataagttattgttgacagtaatcatcctatagtgctatcaaatactagatcttattcattctatctaaatgtatttttgtactcattaacgatccacactccccctacccctcgccactaccctttccagcctctggtaaccatcattctactcagcatcactttttaatgcagcattaactatgatgtcaagctttccaaagtcacagcctcgtctctggcttcttaggaaatattttcattttactctgctatccaaatgttagtttaaaataatttaaggaaaaaacctttatacaaaaatcaactctagaagtgaaaaagaaagccactcctttttctacaatgcccatcccaccttcacctgttcagatcctttaagctttatcccagatccaactttattcataaagtctttgctagctatcccttccccaccattcctccttcccaattctttttctgtagaaatgcttgtgtattttaattatctggataatttcttttaattatctggataatttatttgtatctccactaagttgaaaacatatagaaggcaggtctcgtatcttatcctgtgttccagctctctccctgtacaatgctttatgcatgataagaattaaatagtagttggatgaatgaatacagcaattaatgaatcaatgaatgaataaatagttattccgagaaggattcagttaagtttgttcatcttttggaatcatttcgaaacaggaaatgtttccttgtccccctcacagggcatgtgacagcaggagtggcttacgtcttcaatgccccgctgctgaaacctctagagggatcatgcagatgggcagggtgtggagcttcgaccctacagcagcatctagggttgagtatttacagctcctgaagctccagtgggcgtgtgttacagtgtgttcttttagttttgcagtatgaaggtggcttgtgttaatcagctcagttagaccctctgccttattgcaagggcagagggctttctgtattctgggttctcgccttggttccggaaaaatcgagtcacatgtgggcttggaggatgagtgcaaggttcttttgaatgttggaagtacctctcagcagatggatggggagccataaggcggaaaggtgattttcctctggagttgggccgcccagcagccagactctcctctgacctccctggctagattcccctcgggtccatgtcgttctgcagtcgatggcctgccggtgtctgcaggtgcctgtcggtgtcctcttctgctggtgtgttcctttcgacgtccagccgcttatgtgttcctttcgacgtccagccgcttgtgtgttcttccgccagtgtgttcctctcgatgtccagccatttttgtctctgcctgctaaggtctcggggtttttataggcacagaatggggaggtggtgggccagggtggtcttagacaatgcaacatttgggcatgaaaacataaatgcctgtcctcactaggtccatgggcacaggcccaggggtggagccctagccagggaccccatctttctctacacagcacttccctgcccccttcctgtatcaattttatgtataaaacaaggggttgggaatggatgatttgtggagttctatgtctaacatagcattgtccatgtgagaaaaatcagttaaaataaaatattttttatgggtttatagttctcagttcaaagtgaacaattcagagtaaaaagcagggaaacataaattatcaacaaaatactaaaaatatttatctttttgcaaataattaaaagaaatgccataaaattccattctaatcttctgtgtatccacaagtctgtatggattcaatggcaagaatagagagagacactgtctctgctgaccatggctatcttttctgtaggtttagtgaaacttccactttgctaaatgaccttggcctaggatttgagcactataagcactgttttcaatataattttggttgatctctttggttagcaaacatattaatcaaacatctgatatcccaataagcctctgtggtaagcaaagttgtatttatagggatgttttcaccatgccacttatcagattaaaaatgttttcaaacaaatgtaaagaatgcctggtcagcagttcagaatatttctaaatgttaaaaagaagtatatgtagagttattttagcttttgggaaaaaaaaaaaaacccagaactgaagtaaatagcaaaatcgaacaaggtagttatattagagagaattagacttggctgcaaaagcagaaaagtcaacataacaatagcataaagaagatagacgtttatttcattttcatgtaaaggaaatctggagttgagcagtccatgtatggctggtagggagacttcaggaagttgtcagggaaccaggctctattttggttgccatcatcgatttgtggctcacacctcatagtcttgagtagataattgcactccacttaattaaaaagatacaccctgttttattaaatattcttccacactggcctcgttatagttccaaggccttaccttgctccaatggagactgaaaaatgtagtatttgttctaggcagccatgtgctcagctaagaattatgggttcaatttctaggaaaagatactattgatagtacccacaatagacgactgtcattaagaaacatttatgtggggtactctgctagtccttgtaccaaacagttttatgatctggtttgagagaacaaatttacatatgacagtgtcagaaatgtgtgttcagttgtcactcccttcacctgttgtttcaattagtgcaaatgccatcattccagtcatctaatcccgaattcctagactaatatctggtaaagtacatcaccatttcacatcccataacttgccagaagttgagaattttacttcagtattatagcttgggtttatcttcttctgcaattgctcatcctttgatggcctttaaagtttcctatcaattatttcagtgattccaaattggtatcgtctcctcctgtgtctctctacccacatccatgcagcatattcaccatcctgcttaagaagaaaactttatttgcttctcatatcttataatgtcttcattcaggcattcttgtctcccagttgtcactttctctatttccgtcatagctccatctagctgctacatcccagatgtcttcttcctgggtgtcccaatttcttcagaatgtttagtcccactgtcctttaacaaataaataatactagttccagactctatgtcatatgcagttggaaaatcctccacaatatttcaagggcttatgttttccttagctatatcttgttctgatttctttcttatctcaaattttctaatctctctcatatggatttgtttttccattcttcctgggcatacacccaaatgaagaacagagtcactttgccttggaacctttacttaacattctggaagttaaggttaagaaagagtgttctattttgtcacagctcagcaaacaacatccaattaagcattaaacatccctgttcatgaaagtttcttggccatacttactgtggagcacttcctggcttttacatctcaatccccagtctccttccaacttggtctgccacctttcttttactcctattttcatttccaacttctttccagtcttgggctcactcattccttccctctcagattacttgtgcaaactcaagattctgttttacattattatggaaagcaattattttttgtggacaagccttgtattttatagaaaattttttactttattcttaaaacatttcaaagaaagtattataatctacatttacagagaaataaacagagagagtaggagtcatacataggatcacacagttaactagtaacaaaatccaaaatttgaattaaagtttgttcaaaggaagacttttttctatgttattttatttatactttctcttaatgatgtaacagcaatattttttctgggtttaccctatcatccaaatcttacccactatttaagattatttcaaaggtcaaataaaagtatagacaaattggtgtggatgctataagggaggagagattacatccgcttggggcaatccaaagaaatttattcaaagagtagaggcgtttatgtccatggtagaatgtatgcttatttaattcctattcactctgctagttaagggcaaccatggtaagaattatttcttgctgttgtgttcacacagagctggcactaatgctttgaaaacagaaaatacacaaaaacagtagttaaaataaatatttaaaataagcataaataatattgtcatgcaaatgtattgtataaatagtattgctaatgtggacaattcttttgcagaatgttagggctgagagaaattgtatatgaatggagcattcagaaaagaccgaatttttgaaatttaatgagcagataggactcagatatatagagtaaaaacattcttttgaggaaaagttatgtaaacttttaaagtttaaactttaaactttaaaagtttacataacttttcctcaaaagggaagtaaacaactataaatgaagcataatatttatggaaaacagcaggtagacaatggagaaagatcttatgtaagaatgagaccaaatgacactggtaatgatatttaggagaaatcattgcagacaggtctaatattaaccaatggttagagaatggctgtatgtcaggtactgggccaaacacttcatagagtattccattcagtcctcacaatagccttatggcataggaattattattcttcccgttttacagatggagaaactgcagcttagagaggttaaattacttgccaatatctcaatgcgagaatgtggtagaatagagattcagactaaggctgtatggttacagaagacattattcttaaccaagaaactacactgcagcaataaatacttctttcggggttagggaaagggaaggaggactactgattgacttaattaatagtagggtttgttttaggtattaaattagcattgttggtgaattgtaaatcaatcagtggttgtgtgaagtgcctagaattatcaggagaagacaattaagttgacacatggtctctactgcattgtttgagtaacagaaataaataaaaggaaccccatgttagaaatatagcagcagatgtcaataaagtagatcactggctctggcctccagctgtttccttcttggagaagttgcctgattgctgaggactgtcaatgctcctgttggcttgctcacatggtagcatttccagagctggccaggcctacagctgcataggtcagctcttgggtccccagacgattctgcttttcttgcctgtttctgctgtgcttgcacatttagttatttgtatttaaagaaacatgattatttctttttctagttataactctccaggtttcacagttaaactgtcgtggtcattttaattgtttttgcttttgtggtaacaatggtcggagaatgttgaaataatgctggaattttaacattttctctactggcagaaggctcagcttttcattattgtacatttattgctcttgagtaacaattggtagaaatgtggccatcagtattattgtctattattttagttcatgctttacagtgtctttaaaggcttatatttcatgctttgaactggaaattattaaaattgttgatgctaattacatgattaaatgttgctgaaaatttcatacaactttttaatttttttgaaagtttcagtattttgtgtgtttttgatgccaatttgccgaacacattcttctcagtttctttttttcttgtgtcgtagacatctttctttcctttaataaaaactaagactctaaatatattgtttatagaaacataaagccaatagatatgtcattaattttcaggcaaaataattgctacgtgtttgatatttatgctatcaaatcaccaacaattatccatatccaattttgaacttgaaagattaagtggtataattaaaagaatattgtattaggagctcaaattttgaattaaacttatgctagatcctaaaagtgtaaatcatttaaactctctggacttcaatctctgtatttgttaaaaaatgaaatgaaatgaggataatagttgcttataaaacttttctaagagtaacatttttatctcctccctttctctttcttcctgattttgttccattagtgatcccatttctcatattgtcaatgtcttcatccccaatgcatcattggaccaagatgtttcagccttggcaccagcgacatttagaactgataactctgtattaggcatagggatagagtctgttatgagcagcgtaggatatttggcagcatgtctatctctatccaccatgtaccctccaggtttcacaattaaactgttatgtaccagtggcatcctttgtatttgagaaaggcaaaatcaaatacagttgagaaatgctgctttagaatcagcttccaataatgctttggtctttactaacttaaatcatagtaataacaacaacaataataattttcttcaccatatatcaattgctccatatttcctatttcacagagacatttcttgaaagcacagtttatgttcatggtcactgtcaagctttgcatttgcttcactttttttgatctctgacttttggaaaactctgacttttggaatactccaatatttactagcaaaatgactttggcaaggcagttaatacttaagtctcagtttcttcatctttaaaatgaggataatcatgtaaatgagcacagaatttttgtgaagattagaagagatattgcttataaactatatgtcaaaagagggcctaatacatagttggtggtcaacacttattacctactagtattataatattataaaagtatctgatactttcacataaaagtgcataaaattaataattggtagtggaatagaggaagcagtgattaattctctatagatgggaaaagtaacatttcaaccaggtcttgaaggttaagcatggtggctcacacctgtaatcccagcactttgggaggccaaggaaagtggatcacctgaggtcaggagttcatctagaccagcctggccaacatggtgaaaacccatctctactaaaaatataaaaattagccaggcgtggtggcaagtgcttgccatctcagctactcaggaggctgaggtatgagaatcacttgaacccaggaggtggaggttgtagtgagccgagatcgcgccactgtactccagcctgggggatagagtaagaatctgtctaaaaaataaaaaaataaaaataaagaatgaatttgatttagtcaagtaaatatgggaaaaaagaacattttatatggaatagcatttaccaggctatgaaatagtgtgttgtgtttataaacctacaggttactcaccaatcttaggatgtaggatgcaaccaagagagatgaggcttattcaagtcagtgggaagatgggcattaaatgccattgtaaagagtttggacttactctgtacagaatggaagaagtatgctaaatgtcaaagtgacatgattaagttcatattttgaaagctgacaacaaaataaaatatataaagagccagtaaatgggtgggggacatttccaaaatacagatgaggagaatatgatggagcaaggttttcactaaagtaccaagctcaagagcaatggaagagggacaaatctagtaaaacaggctatagatgtttggattaagctattaatcatcagcaatccaaaaattctatatcttggaggataaatacattttcttcactcagaaatgtacagtttagttggaagtgataatttgtgtgaactgggtagcaagtagtagttaaaattaaggattattactaacactttttgagtgcctcccacatgctggaagttatacccaagctataactctggtcaaacagccgtagcaactgatctcagagagatgctagggcagagctggaattccaacctaggtctatttgacttccctgtccttactctctgagtctccctctctgatgtttcctcacaacaatgtatagacaatcagcagtcaaaatcaatgttattctttactgtctttgtggatactgagtcacataataagaaaacaaagaaaataataaattcttaccaggagcactgaattaatctttgacaaatttcactttggactcttctgtctctgcaaatcccactgttacttcatttttctgtaagaactgttttactttggattactagttactgggtccaatacagaaatttgatatctgtggtagagttcattaattggttacatggaggacctcccctctgcaaatcatagaattatttgttaaaatgtgttgcaattctgcctggaaaaaaagtcactagatgaaagagtcatgtaaaaatgtaacattttcccagtataacaacgtgatgccacctccataaacgaaaagcaaaaacaaataaataaaaactatgggctatctcttctttttgctgtattttgatattgtaagtaacttttctgtaaaactgaaaacctggagtgggcaggttcaaaatttttcataatgaaatgtgaccaagcaaattttatatgcaatcaaaatggcattgcactagttaaggtaatgctaacttctataacagataaaacctaggtctcagtggcttaacacaatagaaatttattctccacttttttaatgctctcatatagttaggggttaacaaactatgacccaaaggccaaatttggcctggtgcccagtttcctaaagtcaaatcttgttggaacacagccctgatgctggtttatgcatttcctgtggctgcttttatcctataatggcagagatgagtagtcacaatagagactatgtggcttgcaaagactaacatatatactaactggccatttatagaaaatggttgctgacacatatatatggtaacaaagaaactaggttccctccagtatatggtttcatcatctcacctctagccagccatcagtgaaagagagaaaatggaggattgcataagaggctgggaattccacatatcacttccactctatttcattggtcagaactcagtgagatgataatacctaatttcaagagagactaggaaatatcatgtatctgtgtacccagaaattacgggaaatagtttggtaaactattagccagcatatagttagctagaaactggctatttagtcagatgttcaagattaagcaaaaattcaccatttaaaaaatagtctaaggtgctcagattgtcaataagttgtccagaattacagggatatatcttttaaagcaaaacactgaataagagaagaaccataatgacactcaagttactaaataaagatcttgcagttaacccagcttttaaaagtagaccaggtccagatatacacaaataccatataaaaagctcactgtggtctgtttcccaccttaggatctttctagctatttttaatttcttctgttccaacctgctcatccagtctcacatcctgaaagcaggtctctctcttggtcctgcacccttgcttcaacttgcttcaatacctgttattagcattattttcttgctggacctggaaactctctgtcagagctgggaaccagaaaggccaagactgtgtacgatctgaattgtagaagagaagtttaacaaatcgggtgaagtcaagtatccagcaagaaggaggcattggcgggatactagatgatgccaaataggtgactgcattgttgtgtaaggaggtgtcctctctcttggcttggaggtattgtgaaacttctgtcagctcattgcaaagtggttccaagggtcaccgagtgggaatgtgtgaatggatcactggaaaactcagcatcaaaagaagaagctcatattacaatcctttcagaccatgataagcacatataaagaatattacaccgaacaatctctttttaaatgcaaggtgaatttctaaggtaatttgtctgtagatttagttgtggtataagactatttgtatccaggtttctccttctcttcagcagtgttcattgtttagcttcagcttggatcaagttaaattgctcactttttaggcttaaaaaatgtacagattatatatttctctttattgtccctgaatgctcacatctttcatataaacttgctgtaccttttttttggacaatttattgaatttctacagggtgatatttttgccagaactttttatgttattattttgactcatatattatttggattctgtttcacatttcttttctcctcaaagcacctgctttttatactatttcttccttcctttggctggctttttgatatccacacttgtgtgttgccttcctccattgaatacaaggtttactattatctccaacaatatgttctctcagctattgtcttctgattccagctagacctattgtattacaaaaaaaaagactatttcggtaaatgtaaaccctttcagttaccacttccaggtctgcactgtggaccccaggtaactttccttgtttttgttaatcatttgtgtgtgtgtgtgtgtgtgtgtttgtgtgtgtatcttataggcattatagaaaatatacttagaaaaacagattgaatatagattcctaaaaagaacctggggttctttgaatattaaattcctattttttttttttaggaatctatagtcattttaggtgtctttttaggttctttttaggaatctatattcattttttcaatattaaattcctattcaatattacctagaagccacagaaatgattataatgcagattttaaacaatcatagcttttactgtaggtctggatgtaattgttttatttagaacaggtttgccgtctctaattgtgacgatcaaaaatatatccagacaatgccaatgccaaacatctcacaaagggcggggggcattgccccagtttacaaccaatttagaccctgtcttgtttaaaaaaaaaaaagatttagtagaattaaaaacatacaaaatatataaaatttcaaaacatatgcaaataaaatgggattatatgaagaaaagaacactagaaaaggataaagctagaggaaaggccgatacataaaatttttgctgtgcaattctgtacagtggctaggggtcgtccacacatttggatctgagctgttgagctgttaagattaagtgagtaatgttgctttaatcagtgcatttgtgctgctatgacaaaatactacagactgggtaatttatgaacaacagaaatttatttcttacagttctggagcctgggatgtctaagatcgaggtgacggcaggtttggtgtctggtaagggctaactctgcttccaaaatggcacattgtttctgcatcgtccacaggggagggatgccatgtcttcacacagcagaaggccaaaagagaatgaacccactctttcaagcccttttataggggccttattcccatctatgagggctccatcctcatgacttaatcatcatttaaaggcccaacctgtaaagctatcacattggtgattaagtttcaacatatgaatttgaaggtcacattcagaccatagcaatgcccaaagcatgagctaatatttggtcaggagagtcacaactttacttgcttctaggtgtgcaataaatttttttgagttgtgtttatagggataatacaatgtagtttaaataaaaaatttctcactaacatttttattccagattttaattattattttctccccttatccctccattctatatggacttgttttaaatttttattttaatggttctattaaatattttttcgttgggcagaaagaatatagtcatatacatatacctacatatgatacatgggcatacttattcatcctgtagtctaaatatgtagagtatatgttgcatacagcattacagcagcagtagttaatatgaaatcactaaacttctagtcaggtggcctgaattggagtcctttactccaactgtgtcatcttgcatgtttttactcaattttctcgactttgggattaggacaagaatagcaacctcacttaattgtagccagaaataaaagcgtactgttatagcatcataataacgttaagacattacctatcatttttggaagcaaatgagacctacaaacacacaatttttagcacaggctattctttttttagaatatcaataagcatagaactaacgagaaaaatttacacacagttttgtataaatatgtatatgtgtgtatatatatatatgatattcaatagctcctggatccatctattttaataaaaggaatcttgtggaatacaaatacacttcccaaattcaggcagtcttgttttgaagaaaaacaatcttagtagtgatttatgggatagagctcagatgggtttgtgcttagattggggctcagtgcagtctggcactgcctttagaagagaggaccatgtgctcttggactttgactaagaacctataacatcctaatattgaatgactttatttcagatttttgctacaacacttaaaagaacccaagtactttatttattttattgcagaaagaagcatatctacaaatcatcacgctttacttcaccattgttgaatgttttttcctcctatgtttaagtcaattaaaaaaccaatgtggaatagacagaaattttctcatctattgaagttttggatattagtgatatcttttagaggttttctattttttcatattttcattaagtttgattaggctaatactttttttttttttttttttgagatggagtttcactcttgttgcccagactggagtgcaatgtcacgatcttggctccctgcaacatccgcctcctgggttcaagtgattctcctgcctcagcctcccaagtagcggggattacaggcacatgccaccatgcccagctaattttgtagttttagtagagacggggtgtctccatgttgctcaggctggtctcgaacccctgacatcaggtgatctgcccacctcaacctcccaaagtgctgggattacaggcttgagccactgggcctggctgattagtttaattctttaaacattaagtgtaccaaaatactagctttacaatgcagtgcactccaaaaagcacataaagattactgatctctgagtcatatctccaattccggatgaacgaagattggagaggaaagggataggcttatgtagctgagaaatgaattcactcaagagttgataagcaccaaaaccaaaaacacatccaatactaaatgacaaagtgtctgtaatttcagatcctcctccattaaaatctattaatagagattcagattttgtgtttattgctttaggtatgaactatctgagaatccactgtcaggagtttattctctaaaagttaattcattttgtgtttgcataatgaatgaatgcaatgtatttagaaatagtgaggataatatatgcaggaagataattctaatagaaaaatctcttgaaggataaatacgaaaatgttggaagaataaatgagttatcacataggctgaccaactgtactggttatcttcagactgtgctgattttagtgcgcagtgtcttgttttggagattcttcagtcccaggcaaactgggatgattggttactcgagttatgagtccaatttccttgattttctccttgatttcattctagttttctataatagtctaattattagttctaattttatagtagttggagatctcatatttatcaatttttaaatatattattgccttgttaaattaaggattcgttgttagatgctgtcaattatctatttcagatttaatgggaaatgtcctttctttaacaggaatttttcaaattagaagtagcttcttcagaggttttattcaaaggagaatgattttttttcaatgaggttcaaatatatacatttgctcttcatccctttttcctaccatttttaaccagtgttggcaatgaaaataatacactttccttttatgaaaaaagctttgatttgtcaataaaacaaacatgtcttagttccatgagttcatcatcaggaaatttccaacctaaatcttacgggccctgagttgaatataatgatatcttgaggtactgcagtgaatttgttttttctataccttcagagactacacacagatatcaagactttcttttcacttcaacagtatgcttctcctctgtaagacagacaggatgtggtctaggagaaagtccacactttaacaataggccattgacagaatgtgtggggagtacaaagaggaagagagcatctgtctacacccaaaattatcagaggcatttctgtgtgtgagaatcttcgatttcaaaaatatgtttttaaaggtcacccgttttccttctctgtttttattggatgaggaaaattgccttcaagataacaaaacattttaaattcaggggaggaattgcatcacattttgtctagttatcccaggcagaaaatgaattccctcaggcactaaacacattttctttagctcttatgtatgatctatgtgaatcaagctgagaaaatgaaaagggtgggaagatgaaatccaactgaaagcaacagggcagaggatccaacaggcaagaagtccttctaggaagaataaatggagagtgccccaggtgctgactttatctacaattaattctgtataacattttctcattcattctgcatgagcaaagatgctacacaaagtattacaaacaccactatttttctttctcttctgtagccttgatcaaatggtagttaaattttaattaaatttcatatttcaaggacttgcaagaaagtctctgatgtcttagccccgtgtttgttctctgcatgtgtagcttgttttagccttcagaggaaagttcccatatatagcactctatcacgatgttgacctgtatgaacatccagctggtgcagctgccaggaggctgaaaggagagttagaatgagttcctatgtctgtcttgtcttttactttcttcttttgaatgctgttgtgtaaaccttttgttcaaatgtcttgccacctggattctcttgtggatgtgttgctactctctccaaaagacttggcagagggtgcttcctgttgtacagcagacttttatttacagaacacctataaaaccacaacaagaatagtcagaatataaaagatggccttctaatgaacgtagtaaaacttcagagcacattctttagccaggagaaagtgctgcaaagatgtgatttaggatgagtaagacataagtcaaggtgtggatctttcagtttccactagaaaacaacacttggatttcctggcaatgtatttttgtaatgactgtggtttctttttgtaaactgtgtctcagacagggaggaagaatgaaccaactggattgtgtaactttataaatagaaacagccatgttaaaataacaagactgctctgggttaaggcaatgaattttgctactagctgtaaagctaggccactgaatgaatataagatccatcctgcagagtaacttctaaggcttgcccaaaaatgcttaatgggaaaaatctatgagaagtccttgctcccttctattgtattccaagtgttttactccaaataaatcaaaaccttttctctgctggatatagtcaagttggagacacacaggaactttatcctccactacaaatattgaataatgtgctcatatcatttttaatacagcacatagtttactaaactttggaacagtttatccatcctggcagtggcatacaggataaagagttaactgccttattatctgttgaacaagatatatgctacatttgccataggaactggaacactgaatgatttaaatttcatgattgctctttatttttggaggaagaaacccaggtgaaagcagagaaatctcctaatgaggattaaaaaaaatcaatattttcaatatgattccatgcaatttcatatgtacttgaaagagatatgtgctgtgtttaccagtcagtcaaagtttatagttcatagcttttgagtcttttgggaattactgcataatagtgatgttttcttttattttggtggctaatccttcatagacattgttggcaaactaatcttcctgagcatagccataatcttggcaatcattcaagcttcccccaatgtaattaaaattaaatttatttaaactctaattaaatttctttaaactttctttaatgagaaaccgatttgattcatgtttatatctcttgagcttcccaaacacaatgtgttgtatgtaatagtgatttaaacatatgtgttgaataaaaaataattatttttatgattgtattactttgactcatgatttacttcatgtctatatcgcaaaaagagccatcctagagactgttcatgatttattggatagaaatgccagctatgctatttctatgcaggttgagtatttataatccaaaaattcaaaatctgaaattctccaaaatctgaaactttttgggtgccaacatgacaccacacatggaaaattccatacctgatttcaggtgatgggttgtagtcaaaacacagtcaaaactttgtttcatgcacaaaattatttgctgaaaaaattacctttaggctaaacgtagagtgtatatgaaacataaatttcttgtttagacttagtttccatccccaagatacctcattatgtatatgcaaagattctaaaatctgaaaagaaaactcaaaattagaagcacttctggtcccaagaattttagataagaaatgctcaatctatatatcagtgatccaaagtccaaaccttaataattttggccttagcagagtatactaagtctaccttgagcgatgctaccccaatccaatggtggtcacgtgtgtctccaaacctatctcatcaaatatagacttttgaatgtggaagaaagagtggaggatcttctaagacaagtgtctcctttttgtacctgattaaaattaagactcggcagattgaagtgggttatctcaaagccatggcattttaaaaagtggctataaaattctacgcccgtgtcctaagcgtcccatttattgataattattgcttaggttactctaataaacctgcttagaaaaataaatatgtctttaacataaaattcaagactcataatattatggaaagccagccatagccttgtgctagaaaatcagtaaggaggtggaacatgtttgagtcatcctccaacacttacaagtgtttttggcattctttgatttccttgtcagaacgtaactagtgaaattcctctgttcaataacaatatccatactctattgccagggtaggtttatggatgttaatagagttttccttgtcaagggtgatgtatgatatggatcttcctctaagtaatcataagtccgttgcagtatagtaaatcagccaagtgcattgtaatttatatgttttacttacagggatttcagacaggatacttatcaaatgtacaagaaaatgtaactcagtattttctgtaacatattcttcttgctttctttcaaatctcctttcctgctgctggtggttgcaaaggaggttggtgatgatgggggaaacctaaattaagctattttcttttggtttgagaaagcctcattagagtaaaagattagtaaatttcaaggtcaaatttcttttcagcacctttttttccttttctatgaagtttctctctttctttctcatttttaaaatggcttcttcagatggatggatacagtgtgtgtagggaagcttttgtgtcctcagggtaatggcagatgaagggagaaaaaagtctctggttttcttgctactctttgggtccttgctggtctctgcagagttggccccatccagcctggtcactggacatgtgctgtgagacttgggctatgtggacaccctctgttggcaactattgctcatattctgcacctgtcctgatgccagctctcttagaatactagtcctcagagcattcctgcatagcaccactgggacacataagaacttttggattcatagacatcggatacgctgtctcaagccatatctacctaactgtgtcttatcatttttcctctgctgtggctattccatattggcaaggagcacccctgcattctgatccccccagctatcaaatgagaagtggggcacaaattctttcaaccttcaccctgctctttgacctatcttgaattttttttatgtaactgttaatcttgtgcctagtcccaagggtatggaggcaccagcttctttctcaggaattcaaattgtatcttatctttagaaataccccttctgaatccccttgcttccttactgctatttgaacctttatttaccctcactgtcacaggttctctgaaatatatcttgcaccctatgcattgtggttaatagtgccactgtatgctgtggtaaccaagattttgtatttgatagataaagaaaagttcttgaatttggaaaacacttttgtgctcaatgaaatctaacttttgagactattttgtcacaatgaacttaaaaatattttcaataatattaagcaatcaattatttgttacagactgaattctgtcttcttgtaataatgattgtcgttattttaatgattagggaaactttagatcaactaagaaacaggaacaaaaaatgctatgctattatctcaaaaatgcatactccttcctacttaagaataataaatttatatattatgatatggtaaaattcacaactaattgtatttttccctagaatgtttaaagcattatctaataccagcttcagtgtctatattactgtaacttcatgaaagactactaacaatactggctatcatttattaatattaagtagtacttgccagatgccgttagaggtgctttaaatgcattctcatttagtcttcgtgtgtactaccgttatcttcactttttagataaggagactaaagtataactagagctaagaaacatgagaaagacgacctagctactgcctattttgtaattcccatggactaagcttggagaagtaagaactattactacaatagcagaaattgaacaacagcttcatttaggaaatcacagcaaaagtataaataaaatgatgactcttaggaaataaaaagcagtttttgagagtagggatagatgtggcctgctcattataaagttcacgtgtggtaatggataactgattttcaaaataacagtttaaactctgaaaattctgttattctgactgggtgcagtggctcacgcctgcaatcccaacactttgggaggctaaggcagggggataacctgcagtcaggaatttgagaccagcctggccaacatggtgaaaccccatctctactaaaaatacaaaacttaaccgagcgtagtggcacatgtctgtaatcccagctacttgaaagggaggctgaggtggtagaattacttgaacccaggaggtggaggttgtagcgagctgagatcgcaccactgcactccagcctgggcaacagaacgagactccctctcataaataaataaataaataaataaataaataaataaataatgttatacttatgaagaataacaaaacatatgcattataagtttgtgaaaacggcctagtaaaatattttaaaattgttattgatgtataatagacacataccaataaagtacacataccataaatatgtttcatgaatttgtagaaaatgaacacatttttccagctagtagagaataggaaacagacatttacaattgctgtctgacatttacaattacaatttagattccttattctcgtagatttatattattccagtacgtgaattctcccacaatttattttttattctgcttttaatgtgggcatttggatagtttatagcttggggatttatgaataatgacactgtgaacattcctgcacatgtctttttgcgaacataagaagcgatgtctgttgggtagatccctaggggtgaaacttctaggtaataggcaagacatatactcagctttcatgagtacgattactgccaccatttctaaagtggttgtaccagattgctttcttactaacctgaatgcatcttcagttgctccacatctctgccctctggtatcaccattgttatgaggccacaggtccttagcattttctatgtagtgtgattttgttgtagttttaagcttccatacacttatgactgatggaattgattatcttttctgtatttaactggccatttggatatcttccgttgtgttcattcaggttttctgcttacttttctaataagtagtgagcctctttccttaatggtagatagaaattttttaaacattttctgcacatgagtcctttgtcaaatatgcatattgtgaatatcttttcccattccatgggttgtgttttccctcccttaataatgtcttttgggaaacataaattcttaattttagtgtaatccaatgtatcaatttttatcttgtttaagaaactctactgttcaaaaatttcaaaactattctatgcaaaaagcactatttgagatgaaaattgaatatgtgcaatacttctgatagcaacatttcaacatacacaataaaacaggcagaattggtcattgtacagaatagagataatcttatctctatttaaaaaaaagccacattttgtgtcagatgatttctgaatccagtaaaactcttaacgtatgcataccttttatagtcagtttggcagacttctaaaaatcaggagttaatatttcataaggtataaatttttcttatactgaggtgaaaattctctctctgttagttccacttattggttctagtttactaatatagtcttttgttcacttatctattcaacacatattatatgaatcctatgacttctaagtcttggaaaggtttcagggataattgaggaactcagaattgactttgggaagcagtctgttagcaggtgtacatttttagagctcatagtcataccagttggtaggaaaatgaaaaagcctcacctttttgtcctcttctttgagtaaaggctttcaactattccacacacaatatgaatttcagatgccttatcatcatggttattcgttttcagacatagcctaattagttactgatatatttaacattaagattaaaaattaatagaaagcaatagcctacatgatgtttcatcagcaatatggctccattagtttctagaactggaaggcagcctgtttctgttgattcagcttagagcagctctatcatatttttggcagtacctcataccatgttcacatactaaacttgaatttgaataaatctgcataaatcccctaaatcgtacttttatgattattatcaaacaagtgtcctccaactttttcagttaatttacgaatgtacaaaacttgctgatcattagaaaccttgttttccgagaacattttatgatataggactatgttttctttttgatgtaaaagtaactgaagaaggtaggaaataaagctatgtaatcatgataagccaattgtgtgtatgtgtgtatgtgtgtgtgtgtgtgtgtttgtgtgtgtgtgttaaaattattggaaataaatgtgccagaatatttgtggcacttatcctagaaaacaacatataatttcaaatcatttatgctaattccaagttcatttccttatcaatcatgccgcctctttctactatcttttctaaatctacaaatgagatcatataccgtctaaatattttaagtgtaagcatttattacttagaaatgctgactaacatctggccgggtgcagtggctcacgcctgtaatcccagcactttgggaggccgaggtgggtggaggcaggcagatcacgaggtcaggagattgagaccatcctggctaacacgatgaaaccccgtctctactaaaaatacaaaaaattagctgggcgtggtggcgggcgcctgtagtcccagctactcgggaggctgaggcaggagaatggcctgaacccaggaggcggagcttgcagtgagctgagatcgcgccactgccctccagcctgggtgacagagcgagactccatctccaaaaataaaaataaaaaatatatgctgactaacatccttttgcatgtgtcctaaagaattcaggtggagaatgatcttttaatcaacatttaaaaattataattgtctaaatatttatacagttatccaactgttcggtatagcctaaatttcaatatatttttgccaaaaatagtaaaataatcatcaaatattgtctgaaatcaaaattctaagcttttgttatttttttggcttcccacttaacattgttacaaaatgaaagaaggtcagtttgacagaatctattcttagtgaatctgtgatatccctaaagggtatcacaatatttttctattttctcaaaaggtctctgttcaatgacattgtgatatattataagaattctataatactttgcagctcctcccatcaaggtggggtacagaagtgtattcacatccatcttgaatctggactggccttggaatttactttgagcaatagaatgcagttgaagagacactgtgagaattctgagcccagactaaagaggcccagagctttcccacttgctgctcgtgggcactctatataaataagcatgagctagtccactggatattgagtgacaatcgatgcagggccctagccgacagctagctaatgccagatgtatgagtgagtcgttgactgccagcacattgcagatacgtgagtgagcccagccaaactcagaagaaggaactcctagctgaccttagcccaaattgtcaccctacagtatcatgagctaaaaagtcattgttgttttaattccttaaatttttggtggtgtattttatatagcaagtgctaactgatacagattcgtactgcattttcataataaatgctataatgtttatttccatgtaagtctgttattagaatttactgtttatataggctgtagagtattattatcttcacttcaatataatttttaagaaacgttctttattgtacatatgttgtggagagaagatgagcactatataactggtaattctttttaccaatggatatatataagagctttcatttcctgctgtttgttctgtttcaggagaagtaggacttgcagctcttggctgtctatgaagtagagtattattattatttgttcttgtgacatgtagctatctaagtcttagaataaataatgctttatgaaatgataatgacaaggtgaaaattaggaggaaatactgataacttgctcacaaattgtgcacattggctgttgggccccaaggagtgttttcttacacaggaggtccacccaagatttgtttcctatgttctaaggtgtaaaaacatacatgagaaatatgtatttatttgaataagactatatttggtttaactcaatctttgaatttaaaatcttacctccagaaataattttaaaatattatattttagaaaattttccagtggaaacaatgccacagagttttgaaatgatgtaattaaaaagtaaaataataaaataacattcttaatattaaattattttacaatggttgtgaatgcataacattaaaatgttaacttgaaaggaggaataatacagttaattatccacatttctaaacaatgtttgagtattatgaaatggctttttaaaaacatttttacccagacatttagaattatgcactttaaaatttgaatggtttcaattcaaaataagcagttatactttctgaaaataagctttccagatcttgagtggatctaaatttttagactttggacaacggaaggctaggaatgataaaatgctaattttttagatttcatttagcagtatcaaatatctaaaactattttatggctttgcattgaataaatctgttacttttaacatcaaatgcatttatttggctgatctaaaaaatgagacgctagtcaagggaaattcaaatctacatatttctgataaatttggaggggaattcaagcatgaaagttggaatccaactgttttacatgcaaattctagccctctcttttaatgagggagtacacttgaatatgttacttaatctctctgagctccagcttctttgtctctaaaatgaagatcataatatgaacttcctagagtttttataagagttagacatggcttttcagtgcctggaatagcatgcatctttaataaatgatagctatcatatattccaagattttggttttaatttttttgaaattatgtgataattgtaatttttctttggtgtttagtgttaacggttgcattgaataagaagtttgaatcttttaaattattaaaaaaatctcattaacttaggaaaagtagggtttttcctaactaaaataaaaatgtaatgaattccatttctttcaagtattcagcaacatttatattgataaatatttaaatattatcattttggttgctaacagttccttttgtctgaattttaaaccattatctgtaattatatatatatatgacattactttagtgtgaaaaaaagactttagaaaaagtttgccttgagcaatcttttcctcaaaagaattaatgatattttaatattcttgtaaaaaactaattaaatatccatatataaaataatgtctgaaaactagggatagtaaaaatatgcattatacagattaaaatgggtgaaaactgaacccccccaaacacatttatatttacaatgccatggaatttgttatgtttttatgacacagagttgatgagttttattgttttgtttgcatatttgttactggtatgtttgtaagggcacacattacatggataagaaggaaattcatttcgagtaccaaatgctatccatgcaatttgccaagaaaaaaatatactttttgcatttgagacaaaatacaatccatatttatttcatgagcttaggaattttaaggggtcacttctataggagagttccaagggagttaggaatctggcctgtgagttttacttttggcagtggcttctgaaataaaacacaatcgcttataatatttcaaaaagttatccatcatccacaatgtaaagtacaatatttaaaactctggagtatggcttgaaaaattcactgttcatgggaggtggaaaacatgaaaagaaaatgaaaatgggaaacagggggtttaagcggaattgggttccatgtggataaggaatttgactcaaaatacaaatgttccaggaaatgtttggtgaggactgtgtagttaattaagatttccagaagttcaacaatgcctcaggttctcaggaggtagaatgcatataaccaccaacttaaagttaatatctaagaccagctatttacatacaatagtttaatagagatttaccagaagaattggtgagaaaacagttctgttgaagatagattgggaactcacagccatattttattacactatctcattgtggtttttcacactgtgggaattggacttccagaactaggggagcctctccactttcattttagtctgaccacttttcttcagggaaggcaaaggttcacaaatcaagtttgttcatgttaaaccccaggaagagatttaaaaagaaaatcttgctacataagcatccacaatgtaaagtacaatattttatatgttatatccatataacaataactgttctaccaaaagcccaagccaaacaaaatctaacaaagtctcattaagtattcaactggatatgcagtgcttagcagagaagttgccttaaataattctgctatgatttcctactgagggagatgcaaagttctttaccctgacctaagttcataaaccttttgtgttgactgactggcattgcaggttggcaggatatttcttctaatttactttcactgcagttataaaaagtatagatcctcactcttatttttaaatgaacaagtgtatgtcattcacaataaaataatatcagtcagcccagcaaagaatgagaagtcagtttcacaagtaattgagatctcttttcagtcttttagagaggggagaataaaatttcagtgcaattgtaatttcctttaattcatgcaaatcttagcatattttatcatattcataaactttccttgggattcagttaattcctaagttgccaccttagatactatattgtaaggccctggaaactactactgtaaacgtgtttcagaaacaatctaacacataactcctactttaaaattattcagttttgtctaagagaaatatatagtcctttgagatatggcttttggcctccagggcaaaggttttatgacagtaattttttaggcttaaggaaatcagatgtggctttcttagaacaacagtgttttgggtgatgaaaagacgagttagtgggtgcagcgcaccagcatggcacatgtatatgtatgttactaacctgcacaatgtgcacatgtaccctaaaacttaaagtgtaataaaaaaaaaaatcaaagtgaaaaaaaaaaaatcaaagtcctttggagcccaattccttctttgtgaattatgtaatacatgcataggaatggaatcctagcatgagcagtaaaacaagcatttcccatgctttcaaatgcaaaaaaaaaaaaaaaaaaaaaagactaaattgataatctttttgctatatctttctaattttcaagaaattatttaaaatgataattttgccctgaatttgaaccctggcatgcctcataattctcattttttaattttctccttatcacaccatcacaattttgattatcttttgttccttagttccatcacaagttgcatcaacttctggtagtaagtaaagcacaattaaaatatttccctgtatgttaaaaagaatgtggtagctatatatgaactgataatgaaatagcctcaagatttattaagtggaaaaagcaaagggaagaatattgtaagtagcatgcttctacttttgtagccaaacgcgtaaaatatatatttgtatgtatgtgtgcacatatgcactatttatgcataaatcatctttggtaggatacataagaaaatgataacagtgattgtctccaggaaagaaaggacaactaagaaacttaaggatcaagggtagagatgggcttcctttacttttatatataatatatacatatatatacattttatgtttgtattttatttataattttatatgctatatgcacatatatacattatgtatacaaaagtgaagtatatatataaatatacaacacatatatattcactttctattgttttatattgtttaggctttttataatgtatattattaaaaattagcaaacctctattaaaatgttgctgaggtttaaataataactgttacacccttttcatatttgatttagaaatagccatctctaaagtagtgctacaccaaagcagatagtcataagtatccaaacaattaatgcttatatttatttttttatttttgctaaacaagattgctagataatatttcctttttgtttaatgttttctgggtatagatgcagatgtgaatgcctaaagtcagttttaaaattttaaatagagctctgcatgattttaaagccaaatgggcagggttgctggcagtttctcatatgattttgagtggcaatgaacgtagcattccagtaattcttaatcaagctcttttaattgtcctaaaagggaaataaaggacttgaggatcaaaactatccttcatagagtgggcagacttgatcaatttggcctgaattacttggctgtaccctacaatattcatatggtgtatgtctgtctgtggaaacatgcagaagagtcacttaaaagcataacattgcaaaattccattaattcctttctttatcacagagaaatttgtcccgagcattcatttgcttcagctgagagattcagcttgaagccataaccatgattgtctcctatgtagtagagaaaattagcacgtggttgcaaaatcatatagctctgtggtatttacatggttataattgattaaaatctttcccagattaaaaaaaggaaccgtgtatctttcttcttttttttcctatttgtacagatgattatatgcacccatctacatgaccctctcttgcttagccaaacttgaccagaagttttgtgagtttttgtctagtcttctctattatcatatggcatctgtcatgaagacactattttatgagttaaattaatgccatttatattctggtcaaatgctaagaaatctggaatggttgaactaataaaatcagcttatacatctctcttaagagcaaattatttaagcaatgtttcaacattgcaagtagactgtcatgttgtattgtgaaaaaatgaagcagagacagttaaataacaaatgaaatatgacctctgctgaattccctggacatttacaatctgctacataagcaataggatgcataatttagagttgctattaccttctgtccagatattcatgaaagcctatttggttttaaattgttggggctgggaagggggtagattattgaaaaaacagaaatcttaggggaggctataaagaaacttcctgaaatcttaagtaattttcatgaaggtttatttactattctatattttatcattttctatgtttagagtccacaattgtaaaaattaagctttcttttgagcaactagaagaatagtccctactccgcaatgctaaaatcaatgtgaatacatattaggtaggatttcaaccattttttcaattgatatagcttttttgtctaaaatacctttaaaataaatactatcgaaagtcaagaaggtattccacacacacatgaatatacttttctactttctcatttctgtcatgttttctaatttttccaatagataatattgtgatagttactttaaatcacaggcaaatgcagttctgagatttctacagatgtgggacacacattaaaatgaattttttttttttggtcatgggtctttgaagagtgctgaataatgtaatagtcctctaatttcatgttctatatcattaaaataatggtttttaatgtttttaagttaaatatatagaagagagcagttaatcagctaattcaagggaagtttggtgtgacgttttaattatctaaagtttaatgacaaagatgatgagctatcttgcctttcttgaatcagttctgcttgtcaacaagatgaatttgttttgagttttgtaatgacagaagagttttgggggaggtgaagggaaagttggaggatcatctataactgatgctgaatccactgcggccaggctgcagaatcagttgaataatttgaaagtgtttattttggcttgatgttttgttctgagatggaatgaaaggagaaaacgtttattaagttaataatcctttctgtaacccttcccagcaaggtctaatgggtgtgccaagcaaatgataacaaaaaattataaaaaagggagcatcattgttctctttctgtttgaatttatcaataaatgaaagcctgaagggaaagtatcatttcatcggtggtgatatgtgaccttcttcttaaaacattattttgattaaacaatagcttatctaatgtttccatattaatcaggcagaagtttcttggatgaagcaactgtttattttaggacctgaatagggaaaggatgaaggaggatactgtcatattcaattttggaaggtcatgtaagcttcatcttttttcactcatcttgaaaaaaaaatggaataaagtgttccatttcgttatttctatactattaaacactgctagttacattctgagttcccattcttcttggttaataaaaactttttgtccatgacttgatgaactgtatgcatatatttaaggaattttgatgtcttaaaaatctttgttaaattatttgcagctgctcagaccaatccaacaagtttatatttaaaatgaaagggctggggatgccaactgtccaaatattacagaaaggaaatgcaaagtgtaaacaaacaattctgccatagatatgcggatcagaatacatatttgtatgaaaaggttaatttttaacttatctcaagattgttacaataaaccgtctatatttgaaattgtagaagttcaagtcccttcagcagatgttaggcgaatattttctgactactagtttaactttacagaccaccagatatttttggtcacttagtatttccatctttatagtcactatttgatggacaaatttttgaagtcttcataattatttcagctattatttcctataatataaataaaaaaacaaataaaattctcctatattttcttgtaccataagtcattccacaggacatttttgcaagataattttaaaatttattggactgagtcttgacacatctaactgcaattttctctttgctatgatttcttgattcattgacagaaatgtttacggaattcatccagttagcaatatttctgtaatctctaagtccttttaagtgaagtttgaatttcttacaatgaaaaaaaaaatggaaatctatataaccacaaagaggcttgttttaaggctactctgagaataagataatcctttgaaaggtagggaaatctagagttaagacaaaaatagctacttaaagacagtttactcaaattattttcattctttgtttttataatagggttataaaatcagaaaatgaaagttatttgagggagtcatacagggcaatcaagttaatagtaagacatctccaatttctcaaacactatattttatctcagctgcaactgtaaaaatacaacttttatggcagagattataatataaatggggaaagactggtgcacagttttggtacatcacacacaataaaagcctaaacatgaagattcatttaaatcctgtgatcaggacacccccaatttggtttgtactttcaccattctatagcttcttccttcaccccttatttatattttctttctttttctttccattttcagtcttttcctgcattctgccaacttgtatttttcctaacctgtaagtccctcatcttctcagcagtagggcccaatgattcacaaatgcatttaactatgatagtaaaatttgttaaaacataccttgttatgatatggctttgggtgcatttcatgtcaaataattctgatttaaaccccctttaaaagtatcacatgtacactagcatatatccactgcaataatttccctggtgcaataggatgtagggccttgccttcccaatgtcaccctacatagtaaataaatatttatggagctttgatgcaaggaggcatagtttctgagatgactgagaagcaaagattatgtaaattcttgaggctaacttgactagaaatagacttctctcaggaatatattccaataaagtctctgctcaatttttaagcaaacttttttcctatttgaagtcccctctgtccatctaccatgcatcatattgcccagttaaaatttcctcatcataggtacattaatctgtagttctcctattaatttatttgttgtttttgttgtccttgttgttgttgttttttcctttaaagaatgtatgcttgatgagggaagaagtgttacctgccttgttctttttgattcttgatactagaatgtttggagtagtgtcttgcacaaagttaatagtcagtaaatacctattcaaataatgaattaatgagtgagctgacccagaagtatctccacaaaggtacagagcatttactcttctctaggattagcctcctggaattgggcatattttatgttttattctaatcacttatgggcattaaatgtaaccttgtaagatctatgagaaaagcatttgtattggcaataaatgaggaattcaggtaaaatataaatagtgggtgagggaatctaaggtatgtttattacgttagcttcatctgtaaaaatagatagttttactaaaatttattcattctacatttcagaactcttgtagtttatgtagatgtgtctgtatattattatacttttattttactttaaagcgagagaaaagactgatatgtgaaaggtttctattgaataagaaagaaaaacagatgatttcctttaccctcataatgtctataaggtaccacatatttcaagccctcttctaaacacacataatggaacttgtttttattgcctagtcatctgttattacaaatatattttcaaagggagaatttgaggttcttttaaactatagctgtctttgaaatataagaacatatcctcattaattaatgtttaacccctttgaaatctatgtggttactgctgtttgcagtaattaaaaaattaattttgtttgagttttctacttattataatttaagacaatattgttaagaataatatttagggtatttagacgttctaacataatgtatttaacaacaaacaaatgaacaaaatttctatataactccctataatataaaacaattcgttgcttctctctctctctctacatatatatatgcatatacacatatactacatatatatgcatatacacgtatatatgcgtgtgtgtgtgtgtgtggtcgttctaatttttttagtggctactctgaaacaaactttgccatttcctgtttttcctaagatttgtgattattttgaacatagtgggtaatcaacatacttttaaaaaaatgcatgacaaaagagcctgctgctcttataatgttacccattgacctcacattataagttttttttcaaccagccaccaaaacaatatgagatggcatttttccaatattagtttaccaaatatactttgcaaagagtaattaataaaatttctaagcacatagttcaaaagcagaaaataactttacaaaaagcaaaaatcccaatctacaacagaaaaataattcttgaatgcatctatactatttttaaatgattattcaaaattgataaaatataaatagtggtagaggaattgagtgggtgttcgaatattttctttttacattctattgaagaattgaaagtgaatacattagtcttaaggtttaatttgaatgagtttgaaagttcatacaatgttagtggatacaagaatgcagtttttaaaaagaacttactacatcacaaatgtgttaacttgagtgcctgctggctcatgtagactccagaggccccctggtctatgcagccgcagaggtaactttgatttgaatcagaagactcacatgatccagccaccaaacatttcctcctatcccacatcaagactaaaccaaacatttcctcctatcccacatcaagactaataaataagattttatagtttaattacaatcacacatgaattttaagaagtgacttgtgacaaatttactctgctaatgttacaagaagtgtgccctttgattaggatttaaaacctcatatgtttgaagcatgaatgaatggtatatcgtaactgtatattgttcttgtataacttcatgaataacttgaataacattcaaatggaaataaatcctcttatcatccaatcaaagcttagatctatagtcaaattcttccatgaaataacatgaaacatccaaccctaatgaaaataaatttttgaaaacctctcaaatatacttacatatacttactttcatctttaatgtaattagattcaggcttgtagaatattctagagtattagaatgaactgtgaaaggctccaagcatgacaaggaggccatctctagagttgtgacactaaacactttggtagacccaatggtgaataaaagctaaaacactcaagtaactagtctgagttactgtagttgatatgtttggctgtgtccttacccaaatctcatcttgaattgtagctttcataattcccatgtgttatgggagggacccggtgggagataattgaatcatgggggcagtttccaccatagtgttcttgtggttgttaataagtctcatgagatccgatggttttataagggagttccattttcgcttgctctcattctctctttcctgtcaccatctaagtcgtgcctttcgccttctgccatgattgtgaggcctccccagccacgtggaactgtgagtctattaaacctctttttctttataaattacccagtctcaggtatgtttttgttgttgttgttgttgttgttgtttgtttttgagacggagtctcgctctgtcacacaggctggagtgcagtggcgcgatctcagctcactgccagctccgcctcccaggttcatgccattctcctgcctcagcctcccaagtagctgggactacaagcgcccgccaccacgcccggctaatttttttgcatttttactagagacggggtttcactgtgttagccaggatggtctcgatctcctgaccttgtcatccaccagcctcggcctcccaaagtgctgggattacaggcgtgaaccaccgcacctggcctcaggtatgtctttatcagcagcatgagaacagactaatacagtagtatagcaaaaaattactttcattgtgttagagtggaccagaaagtaataatgtgaccctatgcctcaggctccaaaccgtgtacaaagtaagaaacctgcagttctggactgcactgacctagtagattgctgggcaagggcccctcaagtatggacaaatctgagtaaatcactagggaggattagaaagggaagtggacttacaccagatactgtcccacatctcaggcacatggtctgaattgtagatttggtggttctattataaaccaaagtggaagtgatcttagccaagtttgaatcattttcttccagtcaaaccttgctgtttgttctaacttcagctattaaaattaggaagaagttgagaatacaggagcagcttactaggcttcaagtgtgaagagaaataatcagggcatatgttcctgtatataaaaatgggccctcctaaaacaacaacaacaacaacaacaaaaacccttccatgaaacttggttaaataattgtatgagtgccttaaatgttacttaatatatattaatattgttaatataataacgtatgttattctattttatcttattttattttactttgaactaagaggaaaaaactgatgtgtgaaaagtttctcttgaataagaaagaaaaatagatgattccctttaatagatttgaaaactgtcattgcagaccagtgcaagccaaatgtattatggctcgcacctgcaatcccagcactttgggagtctgaggcaggtggatcacctgaggtcaggagttgcagaccagcctggccaacatggtgaaaccccatctctactaaaagtacaaaaataagcagggcatggtggcacacacctgtagtcccagctcctcaggtggctgaggcgggaggattgctagaacctgggaaatggaggttgcagtgagctgagattgggccactgcactccagcctgggtgacagagtgagactccatctcaaaaaaaaaaaaaaaagaaaaaaaaacttagaggctgggcatggtggctcactcctttaatcctagtactttgggaggccaaggcgagcggattgcctgagctcaggagttcgagaccagcctgggcaacacagtgaaaccccgtctctactaaaaatacaaaaaaattagctgggtgtagcagcatgcacctgtagtcccagctacttgggaggctgagacagaagaatcacttgaacctgggaggtggaggttgcagtgaaccgagatcgaggtaaaaaacaaacaaacaaacaaacaaacaaacaaacaaaactttagaatgctctgctctactagctgaggacgcgaggattaatatgggggaaacaaggtcaaatggaaagaaagctgggctataggcagggctgattcagttcttagatttacctcttagccctgtgacctaggatgaattgcctaacctaagccttgattccccaactattatgagggttcgatcaaataataatataaagttctcgagagatagtaagtaaatattctattgggggcaaggtttttgagtcattaataaatattaagtaaaaacaattttgaattgaaaaatgtgttatggaagtaataatttttacaaaacaaggcattcaatgcaatcaatcttattgcccactataattgcgcataatatatcattaagtaaatgaaaatttgtcttaatgcatatgaccctactcatgtcaactatttggaacatgacatgtctgttctcttctcaagaatttttggaaattccatttctgcagtttccttccattactcttaacctcgttaactcttactaacttccagacctcagttcaagctttactttctcagggccagcttccatgactccttgtccccacccccaattctagatccgtttcttttgctttatgctcacttgtaatatcatgttcctttcattcagagcccttattcaatttttaataatatatttattgttttaattatctgttgaatatctttcttctcctttagacaatatgctttatgcagagaaaacctggtttgacccactagtgtatttctaatgtgtaacacatacaaggcatgcaataactatgtcatgaatgaatgaattaatgcatgacgcatatgttcaattctgttttacctatcatttttgcattggattatgagataaacacatgctcttttgttgttactcaactcaaattttatgtctacaaaatttaccaaggaattatctaaatgttactgcaatataaaaatgcaaaagtagttgtataaaagtttctaataagccgggcgcggtggctcactcctgtaatcccagcacttagggaggctgaggctggtggatcatgaggccaagagatcgagaccatcctgggcaacatggtgaaaccccgtctcaactaaaaatacaaaaattacctcagtatgttggcgcgcgcctgtagtcccagctacttgggaggctgaggcaagagtattgcttgaaaccaggaggcagaggttgcattgagctgagatcatgccactacactccatcttggtaacagagtgagactccatctcaaaaaaaaaaaaaaaaagaaaagtttctaataattgctacatctctaaaatttcaagcaagaatatataggggacaaattggtatgctttaagagattgacgtatccagaataaagcctagaaaatttgaacattttgttttttattagttagacatttaggaatcgggataaaagagaaatactggggttaaaatgagattttaacaactcagaaaatcaattattcttgctgcttctgttacagatgctggagaatgtgtggatgagaatctaccacacactggggaaagaaaaggaagtgaacagagtgggaaaaagagacatgttcaaggagaattgggaagaggaagaaagacagtgggaaatctgactagaagaatctaatccatgaggatcatataaactgagaaagggggagggtttaaattgaattgtgaaaagcacaggttatttgcatgaaatccaagagcagtcatcatccacaacgtagaagcaaagtgaaagcctaagtaaacatttgttcattttaacaccaaggacttgttctatccttaaagttttcctggagacaacagggaggtaaagagattaaaaaattgtacacatgcatgcacaggcatgtacacactcacacgcaagacagagatacatgaagaatgaaataagcacatgaaagtaaccggcccatcataggaggcccacttatttcagctcttgaatctaagcatttacaagggaacatgtctgtgcttaactttactccctagtggcttatacttaatttaagaaagcaaaatttacatgaaatacattccaatagagatctaaaaggataaatttcatgtgagaaataacttctctaagtcagcatataagaagaagaaaaaaattagtaaaagattgcttttgaaattttctatttttaaaattttatttattatactttaagttctgggatacatgtgcagaatgtgcaggtttgttatataggtagacacgtgccataattatttgctgcacccatcaatccatcatctacattaggtatttctcttaatgttatccctcccctaatccccatcccccaacaggcccaggtgtgcaatgttcccctccctgtgtccatttgttctcattgttcaactctcacttatgagtgagaacatgcagtgtttggttttctgttcctgtgttagtttgctgagaatgatagtttctagctttatctatgtccctgcaaaggacatgaactcatccttttttatggctgcatagtattccatggtgtatatgtgccacattttctttgtccagtctatcattgatgggcatttgggttggttccaagtctttgctattgtgaacagtgctgcagtaaacatacatgtgcatgtgtctttatagtagattgattgataatccattgggtacgtacccagtaatggcattgctgggtcaaatggtatttctggttctagatccttgaggaattgccccactgtcttccacaatggttgaactaatttacactcccaccaacagtgtaaaagcattcttatttctccacatcctctccagcatctgtactttcctgactttttagtgaccgccattctaactggcatgagatggtatctaattgtggttttgatttgggtttctctaatgaccggtgatgatgagctttttttcatatgttcgtcggctgcacaaatgtcttcttttgagaagtgtctgttcatatacttcacccactttttgatggggttgtgttttttttcttgtaaatttgtttaagttctttgtaacaaatttacttgaaattttcttaaattaagaaccacacacatggtattcttgtatactatattaacttgcaacttattggtcaagtttcttctctagcatgggaacaggttgccatttctttaactgaacattgaaataaagtaggcttgtgtgtaagaccagctaatacggaaaaaaaaacattaatgtcatctaactccacttgaagtgctatgcttctgaaaaacaaaagcattcagagaaagaagggactggtataggtagtagttggtggaaatgcaagagttagaactaaaagtgaaccttgaagggttggtgtttggggaaggccatggtcttgggcaggagactttatgcttggggaagttctggttggagagtccaggatccaaggtctaggtttaggacagaaccactagttcatggcaatcccagggaatcaaggaaatgtctaagagaggcccaagtactgagaaaaatgcattaaggcttttggcatcacattattttatttaaatcatgtttaccaagattttaatatccctcctttgtgaacttttacatttcggaactctatatgactgttgctttgcttttaaccaatgaggagctgtttatttatgtcatttttttcatattctattgtgttgaataaatgcaatgtatgctctttagagaatttgaaaaatatagaaaaaagtttttacaaacctttatccctgatatggtttggctgtgtccccacccaaatctcatcttgattgtagctcccataatccccacatgtcatgggcgggaccccgcaggaggtaattgatcatggggtggggattttcccatgctattctcatgatagttagtaagtctcacgagatctgatggttttataaagggcatttcccaacacacatgctcttggctgccaccattatatttctttatttatatttatacactttattccttcttcaccttccaccatgattgtgaggcctctccagccatgtggaacttgagtcccttatacttctttttctaaataaattaccccatcttgggtatttcttcatagcagtatgaaaatggattaatacaatacccatttctcagatttactttttagtatattagtatatgtatgtccagttttaatatatgtgaagataaacaattgatacagatcttattgttactttgtaacaaatgatgtaacaaatgtgacaaatcgttactttataatgaaatgatatttcttaaatatttttctatgtccacatatattttgatgaacttaatttttaatgattgaagttataaatcataatttgactattttaatacatttctaatatttagcatttctgttatatgtaactttttttgcagtttttataatgtcttagcaaaggactttactatttcttttcctagatgatttgcttgtctaaatatttcccctaaggaaaagaaatagtatttttatatatatacatgatttgtatgtgtatatatatatatatatatatatatatatacatgatttgcttatctaaatacatatgtgtgtgtgtatatatatatatatatatatatgtatataacagcatatgcattatgtgaaatttctagatatattgtgtcaatttgttttttcaagaacaatatgtaagaatgtgcatttctccataacctagcccaggggtccccaacccctgggccatggactggtaccggtctgtggcctgtttaggaaccagattgcacaaccagaggtgagcagcaggctagtgagttctagctcctgtcagatcagcagtggcattagattgtcataggagaatgaatcctattgtgaactgcgatgtgagggatctaggctgtgcactctttatgagaatttaaggcagaacagtttcttctcaaacccccacccaccctagtctgtgaaaaaattgtcttcagtgaaactggtccctggtgccaaaaaaagttggggactgctgacctagccaacactaggtgttggtattctttctatttatttttatttatttgtttattttgagatgagtctcactgtgttgcccaggttggagtgcagtgctgcaatcacggatcactgcagcatcaaccttgcaggctcaagcaatcctccagcctcagcctcccaagtagccaggactataggcacacaccaccatcctcagctaattttttttaaattttttatagagatgtgttgcccaggctggcttgaacttctgggctcaagcagtccttcctgcctcagcctctcaaagtactgggattacaggcatgattcagtatgctcagccagcattctttttaatctttgcaaatgagattcatagatttaaaaaaaatctaaacttacttgcattgctttattactagtaaacaatttcttgtggttagtaaaaaaaaaaatctaatttcactctatattgtcttattagtgaatgtgtgtaaagtgtaagaacagctcagaatgggtttatatattttaattaccactagggagcttttgtggaccaaatttcacaggtctgtgatgcactagattaccatctttcaaatgaggttaataataccatccttactatgttattataatgaatcaatgaattaagcatcagagacacctggatcaataaaatattattttattctgtattttttttatagatttgttactctgaagtttacatctttcatgaaacgtgtacagaagtatacattagaggaaatgaaataaagtggcacaactaatctatatttcattgtaggaagaatgcatttatttgagcttatgagtacaaaccaattaacaagattaaagttttgtgtggcaagacattaactgctatgagtagaagccaaatggaggtctttctgaacatttacttgcttttatgcaaaagaaaatattttaaaaatatttttattagaaaatatttttgagaaagtcctttaccttcaaacttccagcaagttataaatgtttaaattgttattctagaatacctcatatatggtgtcctcagggcctttgcacttattgtttttctacctaacattccttattcctaggtatccacaagggtcatccctgtatattatactgctttctgtctaatgacaactcttcaaaaaggtcttctcttaccacacttctcaaaagagcacctcctcacttcttactcattatcttgcttcaatgttctttattgtatttaatgctttataattatcaattaatttatcaattagaatattagttccgtgagaacaaggactttgtttcattcactactgtgttctcggttcctgaaatactgcctggcatatagaacacaaacaataaatatttgttaaattaatgaatttatgaatgtatgaatacattgagtcaagtaatgaggaaaacaattataatttgattatctaaagagatagcatttttattgtattcctgctcatatgatttatatatttaattgactgtatttagcctatgtgtaaatagaatgctaggttatacatttcaaatatattaacaataattagtctctaatgtgcttttatgtctccactcgtgttcttgtttaaatatgtaattaataagtagtctatactttctattcatgtgttcatctatcaataggcaatacttaagaggatccataatcatttcttccttgctcttgtagtctcctgaagaaaaatacagcattttcagggagtaactttgtggctcaggtcctcagcccttttccaaggcataggatagatagaatgacactgaaatttgttattgttcttatttccatctaaataccaaaataattaatgtaaatatgaaaataaagttgaaaatataattaatttatgcttctctcagtattttatagccatgattttatgtattacatcattatattgtatcataaatgattttatagtcgatcgttttggatatgaaatttacacctgatcaccaaagttgaagtgaacattccctccatatttgatgattatatgaactgggcattcattgtcttcccacttctccaatactgaaaagatgagagaaagctaatgtgcaataagacttctatatagctctaacttttgacagagtttaatgcactcaaggcacttgagcaggaatataggaagtaggaggaacaaggataataatttgagattgttcattaaatagatgaagaggctgtttcttcacgaatcagttctttttgctagtttcctaactgatttaaaaatagtttatcatggtagtcaatactgcatacacatgtgcatttaatttagttgacaggactctgtcactaagtatgatgaattgtatttgtaacatcatttagatgtaaagaggaaggtgcttttgcaattagtggaatctatagacagtagaaaaaccaaacccctatattttgaaacaaatgcttcattcatatttcctatgataaagtataagaaatattgatgatgtacaagccactttttgagtctttcagtttactgtgaaagttaaatttgctaatcaagcccagtcaaggctttttattaggatttaggattaaaatttggcttaagattgggctgcttactttaaatttttttctgctttttatgtttctaatgaaaagttatttttcctccctcagctctctgtcaaaatgagtgtgaattatcggtatatatttgaaagttatgagactggacacctttgtgctgttaattacagtacttaagaattgtcttaattttaagtgtaagaatcataccacaaaacattgtatatgttccttaaacatttacatcccttaaagctatgcagaaaattcactaacaattcttaggtaatattttaaagttacttattgtaaaaatcttgatttgctacattttaagttttacaagaaatgtcaaaatacattaggctgtaaaaagttcaaaaattccataaaaacaaaaaaagagaatatttcccatttgtttcttccctatcttgctgattccatctctacattggtgtaatctgagattttagtcccagttattttattattaaaataatagaagttttaaattaataatttcaatgggctttgcttaccagtatttctttcaactattttaatagatttatttttaaaatctaagatcaattctttaccaattatttctagtatgcttttctgtcagtatattttgagacctttcatgtcaaaaattcattttatattgcatttataggtaacaaatagcttgactggatataaaaaagtaggtttatagatatttttctcagagctttgttggcaacacttctggagcaaaaaagtggactatctaaatagaagcaagaaactggctggtgtcaagtttcccattaggaaataaataaatggggataatagaccaatcccccatgcataagaattccaaataagtgatgaaaattctccacctgaaggaggggagcataataactccctactccttaagtgtgggctatacatagagactgtcttccgaagcgtgcagtatcatattggaagtgactgtggtgtgggggtgggaaggaggagggagaggcgaaaaataactttacagtggagaaacttgacaaacactgtgccagccaggtaaacaagatcaatatcatcatttggatagtatttacctctaatatgatgtgaggaaagacactttatctctggtctttttcccaaaagcttataaccccagtaaaatcatgagaaaagtatgaggcaaattccaataaatgagcattctacaaaatatctaaccaatgctccccaaagctgtcaaggtcatcaaaaacaaggggagtctaagaaactggtaggaaaaagagcctaaggggatatgccaactaaatgtaatgtggtacctgaatgagaacatgggaagagaaaggacatgaggtaaaaatctcaggaaatctgaatgagatacggaattagttagtaattttgtttttgttttgttttgtttttttgagatggtgtcttgctctgttgcccaggctggagtgcactggcagatctcagttcactgcaacctccacctccctggttcaagcaattttacagcctcagcctcccaagtagctaggattacaggcatgtgccaccatgcctggctaattttgggggtatttttagtagagacagggtttcaccatgttggtcaggcttgtttcaaactcctgacctcaactgatctgcccatctcggcctcccaaagtgctggggttacaggcgtgaaccaccacacccagccagtaatgtattaacatcagtattaactataatatacacaccatagttacataagatagatatgtaataatagaagacactgggtactgagcatatggaaactgtattatcttctcaatcttttgtaatgcttaaacttctaaaaaaaaaaaaaacaaggtctttttttaaagaaagttaatgtgatctgattgtgaagtctctggtgccaggtgagcttagacatgttgattacatttgctccattttaattctatcatttttttttttagcgttcccatcgtatttactctttcctcttgaaatagtctttggcagtgaaatttggacttgaattattttctcagaatagctgaaataaactaatcttcgtaccaacctcattacattccagtaagatgtttataggaaggagaaccaaatttgcaaatttttagttcccagttgagcatatttgtgtctgctgcctatacacactttgtcccagatggtcatttctttatttttactgacccttgcagaggagaagcagctctaaatatagggaacccacagtggaggtttgtagccctatgccaccaaatacagctgctgctgcaagaactatttatgagtaagggagagttgcgaacccgcttggatagctaccctgcaaatttcccaggctcaaaaatgtctcctgtacatctgcattgaaccatgcgattttagagcagcaagttgtttagtagatatataaataaactctttacacactacaagatttatgtacacagaatttatattaaatgggaattaaaatatttgatcaacagggctatataggctgaattatatcatgcatatgaaaattatttcaggctgggtgcagtgctcacacctgtattcctaagactttgggaggtccaggcaggtggatcacttgagcgcaggagttcgagaccagcctggcacatggccaacttggagaaatcctgtctctactaaaaatataaaaattagctgggtgtggtggtggacacctataatcccagctactcaggaggctgaggcaagagaattgcttgaacctggggcggggaggtggaggttgcagtgagccaagatcgagccacttcactatagccttggcgaaagagcgaagtgaaactccatctcaaaaaaaaaaaaaaaaaaaaaaaggaaattatttcacagctataaaactatctacaagtactatttgttgttattagagttcactaccaccaaattaatctattttaatgttggctagctataacttttcaaaaagtgttatctcatgttaagccaaagtcatgttttctataattttgtagtacacagcaggtgataatgaagtcctagagatgtgcgttcaaatgcttgtgcttccaggacattggttaaatgacttaaattctctactctcattttccttattcatgcataatcctgataatccctgccttacaggaatgttgttagtgtgatcatatctgtaaaaatgtacctggcttcagtgtttaataattggcagtagtgatgattaatgagtttacctttcatgcttcaacaataggtgacaatgaataggggcccaagccttctcagcttccaaatggcatgtgataaaaatatatctgaacctccattttcaagtaataaagaagtcatgagtcgcacaattctgtttctcttattttatttttcatttggggaagataccagcaggaagcctgaggaagaaaacctttctttggcaaatagctgtcttttagtgaaatcacatcatataaaatgtgattttcaggaaaatggacaattttgttagcatacagtaacttcatagaggctctatttggggtagaagatggataaaacctgcaagtaagcagaaatcctttgaactactccatccagagcctcaatgttgtattgctcagactaatcactggacgccatcaggagataatgaaaagtgagtgacgccttctggagttatgtggttcattgatgctgtttccacctactctgccaattatgaccagagatattataattgcagtaaggtactgcacagtgatatttccatcaaagatatgccgcatatatgattgtggtaccataagattataatactgtactttatttttattgtgtcttttctacgttcagatatgtttggatacacaaagcttcccatgtataacaattgcctatgctatttagtcacatgctttacaggtttctaacataagaacgatagcacatgtcacagagcctcggtgtgtagtgggctgttccatctagatttgtgtaactacactctatgatgttcacaaaatgatgaaatcacctaagaaggcgtttcttagaacatagccccatcatgaagtgacacattgctttatctttatatttcatttatttatttatttttgaattgaggtcttgctattgctacattgcccaggctagaaggcacagctattcacaagaaccatcatagtgcattacagcctcaaactcctcagtctcctgagtagctagcccagcatgactgtgtctgtaaggcagaatgcctagatatgtgtactttcttctttcctgtcacctttcctttacttagtggatctcaaacttgagtgtgcatgatataagaatttattatggatataacactttttagtggaatttttactgtaatgtcttagaccttaggaactgttttaagattggtctgtctctctagcccactctaatacttggctttctgtatttagaggtgaaatcctaggtcactatagtgtttgcaaatggccagtagctcagctgaacttttccttgaactgtatatcaggatcagatttgataatctctcagcattcatagaaaataacagtcaaccttttacagctttcccactgtgtcaccaaaattattttaaattatacttggttaaaaagctattcttcttgaaaactggaacaagacaaggatgcccactctcaccactcctattcagcatattattggaagtcctagtcagagcaattagtgaacagaaagaaataacaggcattcaaataggaaaataagtcaaactgtctttcttccctgacgataagattttctacctagaaaaccctaagactcttccaaaagactcctagaactggtaagtgactttagtaaagttcaggatagaaagtcaatgtacaaaaatcagtagcatttctatacaccaatagcatccaggcagagagtcaaatcaagcacacaatgccacttacaatagctgtaaagaaaatgaaatacctaagaatacagctaaccaaggtggtgaacgacttctacaaggataactacaaaacactgctgaaagaaatcagagatgacacaaataattgggaaaagattccatgctcatggattggaagaatcaataatgttaagctggccatactgcccaaagcattttaaagatgcaatgctattcctatcagactacgaatggaatttttcatagaattagaaaacaaactattctaaaattcacatggaacaaaaaagtgtccggacagccaaagcgatctcacacgaaaagaacaaagcagaaggcatcacactacatgacttcaaactacactctatggatacagtaaccaaaacagcatgatactggtacaataccagttgacaaatagagcaatgcaacataatagaaaactcagaaataatactgcatacctacaaccatgtgattatccacaaggctgacaaaaacaagcagtggggaaaggactctctatttcaataaatggtgctggggtaactggctagccatatgcagaagaatgaaacaggacctttacctttcaccatatacaaaaattaactcaaaatggattaacgacttaaatgtaaggccttaaactatacaaaccctacaagaaaacctaggaaatacccttcctgacatcaggctttataagaatttctggctaagtccccaaaagcaatcgcaataaaaacaaaaattgacaagttggacctaattaaactaaagaccttctgcacattgaaagaaactatcaacagagtaaacagacaaccttagagcataggagaaaatattcacaaactatgtattcaatgaagttctaatatttaaaatctataaggaatttaaacaattcaacaaacaaaaacaagtaactctattaaaaatgagcaaaggatgtgaacagatacttctcaaaataagacatacactcaaccaatgaacatatgaaaaaatgctcatcattgctcatcatcagagaaatgcaaatcaaaaaccctatgagacaccctttcacatcagtcagaatggctattattaaaaagtcaaaaaaccacaggtgctaggctagtgaggcagcagagaaaaggaaatgcttatacactgttggtaggaatgtaaattaggtcagcctctgtggaaagcagtttggagatttctcaaagaacttaaaacagagcaaccattttgacccagcaattctattgctggttatacactcaaaggaaaataaattattctaccaaaaagacacatgcactcataagttcatccccatgctgttcacaataggaaagacatagagggaacctaagaacacagaatgtccataaacagtggattggttaaagaaagtacaaatatacactgtggaatactatgctgctataaaaagaacaaaatcatgtcctttgcagcaacatgtatgcaactgaaggccattatcccaagcaaattaacacaagaatggaaaagcaaataccgcatgttctctctaactgagagctaaacgttgagcacacatggagataaccatgggaacaatagaccctgctagactactagataggttagacaaagaggagggcaagggctgaaaaaccacacattgggtactatgctcactacatgagtgatgggtccatacacaaacctcagcattatggaatatacacatgtaacaaacctgcacatgtactctctgtatctaaaataaaagttgaattttttgaaaagaaaaagccattttcttctaacgtatttactaaatgagagagagaaagagtatgggagtgagagagacagagtgaggtgagaacatgcatactaactagttatttcatgataaagagagttttttcctcttttatcttgaagatggtcttgttccattgggtttttgctatcaccagttgttactctattggtttttctgtttttcttttatctttcagtttaccacagggaaattggaagtcaggtgtccagatggaaatctttcctagaaaaaatgtgattgtattttcctgacattattttataaacaaggcatgaaatgaactgtatttggccacatgaaatatttgtttatattatcctgttataatttaaaataaagccaccaataacctctttgtgaggtatagcacccaactatagctttgataggtgtttcattcattcaagtaaaggaagaaaacctggctcctaagtcctgttagtttatttaataactggatgatctttagaacggtgcctagaagcagtgtcaattcttgaaaaatggttgtgttttagttgggattctccaaaaagaaccagtagaattgatggatggacggagggaaggagggagggaatgatggatggttggatggatagacagattagatgatgattgattgattgacagatagattgatagatagaaaagaggggatatatcctgggaattctctcatgcaaattatggagtctaaatcccacagtaggatgtctacaagctggaggctcaaagatactggtagtgtggctcagtccaagtccaaaggctccagaaccagggaagctgatggtgtagcttcagtctgaaactaaaggcctgagaatctggggtgccctgttgtaattccctggagcccaaaagctggagaacctggagttctggtgcccaatggcagaaaaagggtgtcccagctacagcacagagagagcaaatttacccttcctttgccttttgtgttctctcatccaaacaggatctcagctgttgggatgatgtccacttacattgatggcggatcttccttattcggtcccttaattcaaaaaccagtctctccagaaacatcttctcagacatacccagaaagaatgcttttaccagttctctaggtattccttaatccactcaacttaacacctaaaattccatcccaggtactcctgattatttcattgtttcagtaattctgatgttcaccgttaatttagtatcacttaagaggaaggaaaagaaagattgacaattccaaattattaatgaatttctcccattttcagaaatattatgaaaatatgtcttagagtaatttttgttaataatgatgtcaatgatggatggagcatttctggaatctcatctttattgttggaagagtctacattcatggaacacaacatctatcagggctagtatataatgtcaaactttatgttacttgctttaaggttaatcagtctcatcattttttaatcatttatcttgaaagcgaaattattcctatatgggttaagcaattaaaatgttaaactttttaggagttaataagtattttaatacactgaaatgtgattgagtgtctctatttatgtcacagagtcacagagatggaaacactcttaaaatgtaatgatctaattatatgaattattaatctgaagtctaaggaagctaaatagcttgccaaaggttgtactgctgctttttttctgctactagttttgtatatatgtctcttattttcagaaaaagataacgatagcagtttccaatagtaccttacgcagaataagtactcaataaatgcatgttggtttgttgcaataaacacccacataaaaataaaagttgtattggccatatatgaagtttctttgctttttacaggttgtatctgccctaaaggagtatttttgtgaatcaaaaattttaagaaaatgttctgatcttaaattggaagtgacttccagtattcttctaaatttctttacctatgcccatttccttctcttagtttctctgttgagtagttaatgatctgttaagatgcacttcaatacattagagtgtccacattcttaaaagaacattgcttgagcaaaataacccatttgaaatttgaattattcgctgtcttgctgcttaagatgagtttaaatacaaccggagacataccttcagttctaccattcttctcacctttcttgataatggtagtaactaaatctttctaataagaataattttatttaaataaatacaacctttttaggcaattcctcctctccattaaaagaaacataatttatctatttatttaagccaaacaacaaatcttcagttctccccttgtctacctctattaccactgccctagtgtcaattattatcatctctctctaaaggcaccttgttggtagtcgatagtctcaatccaggcttactgtctcctaaccaatctttcaactgctgcctgagaaatgtaaatctgaccattctgcacccatatgaatgctctctatagccgcagggttaagcactacatggcatataaaactaccatgacctggtcctgcattcaattacagcctcatttctccgctctagtaacattcaagggcttctctttatacagcctgctgtttagtggttaaattatttccctccagctcatttgaactcccatacattccccactgtcaccacaatgtatgtgtcagtctgtatgctaaacttaacatgctaaacagaatgtacatatgggtctaacatgttggaatctaaatccctcaaggataggggctatcttgtcttcatatatgttcaatagttgtagattatttcaatttaaaattatagcaaattggtcttgaatgtcacttaagcattttgttgtttccacccctggacaactcattgttgaactcatctttctcaaggatgtagatagagcccccatttttttcctgatattcttgcatttaactaccatagcttactgaataaaagcagctgaatttgatccatgtttaatgtcattttcttaatctttctggacttggatatgctttttagaaaaattctttttttcttacataaatatctagaacagtgcctatcaataaataatcattgagctgaaataagctataatattgtggttccaatcggatattggtttatacccctcgattttaatcatcatagtcaacttaaaatgcctttgtatgagatttttcaattgttttcatttaatgtagtgtggattccaagctatatgggaatggaacattcttttccaggttaatgggactttgacaacagtttttcatgttcactaaacaaacatgaattaggttccaggtataatgttagtagctaatgatacaaatattgaccttgcgttagagaagaacccattctggagaaatagaggaacctctcacagtggcttttcagcataggtgcatttaattaggaaattcagtgataggagctggtaagaaagggagagagtgagggtagacttaaagagaaaataatataaatgctatgaaaaaattctgcccaccattccatatagttttgctctttggtaatcatgagatggaagacttagatcccttagttggcttcaatttctacacaactatatagggttgaatccttaaaactacatatcttctgcttcagtgggaacttagaattttcaagggaaaattcaagtatgagtacttattgccttatgtggtaacttcaaaaccagtatccagggaaagatcgtgacaatatgattagggctggggttaagttttattgaaattcatatttatttttgtgattatgtgacacttgtttttctccactagattataaactacatgataacaaaggcaatatctactttgtttattcttatgtgattagcattttgcaaaagccccaagatttaatagaaaataaatatttgttggatgagtggagttattccacgttaatctcctttttccactttgagagacttatttagagagtgctaatacttttgtgaaatatttttagagttttaaactaattcaatatataaaaattaatttaaaagtaagtagtaaactgtaaaataactaaacctcatttcatccacaaaattcagtgaagcttataacaaggttttttaagatatgaaacattatccaacaaagcaataaaattgatgttatcagaaatttttaaatcatgttattgtaattatgcatttaattatttcagtttttagatatctaagagggaaaaaagagataatgggaatagatcgaatgttacagtggcaaacaataaagcgtatctaaagacacaaaagttgttgagttttttttttctggaatgaattccttaagtgctttctggtcatggttccttaaatgaggaatatgcggtaaaatatgatgattttaaccatgggtttgcaaaagatttaggaaggttatttaaatgtacattttaaacccatactctaactaaagtggttatcattgtatacaattatccaaataggccaagcatggtggctcatgcctgtaatcccaaggaggtagaggcagggggattacttgagaccaggagtttgagactcaactgagacccccatctctacaaagaaataaataaaaattagcctgacatagtagcatgtgactatagtcccagctactggggaggttgaagcaggaggattgttttggcctaggaggtcaagactgcagtgagccgcgatcatgtcactgcactccagcctggacagcacagcaagaccctgttttaaaaattaaccaattaaataattaaataatttctgcagtgagcttaatggctgattttgtttttgaaatactttatcttaatacagtaagacaaagtaatgaagagaagcataagttaatagcctcattaagttttgccctcaaatgttatgtcccaagtaagtctttgggttggagtcaattcctggttgaattatctaatatgtatccaaagatcctatagtttatgctgattaagaatgacctgtatgtattaagcattgtgtatgtgggatgtggaattggcatgagtcactgaatgttctaagtcttcaaatgtttttatctttgttttctcagagaggtgagtcatatgtgtgtgactgtggataggaccggtgttcttctgctcaataacatacatactcagggggaactccatcttgttctatataatatggacaagtgatttcttgaaaaaaattttaggacagatttggtcaattgagtgttttaatctcagaataacctcaatgccctccaaacctgcatctgctgggcccagcatgatggttagcatccaccttttgtgtggtgcaatggtttattttatgtgtcaacttgactggacaatggagtgccaagacttttggtcaaacattattttgggtgtgtatatgaaggcgtctggatgagattaacatttaaatcagtagactgaataaagcagattgccctccctattattggtgggcctcatccaatcaattgaagatccaagtaaaacaaaaatgctgattaagagggaactttacctgcctgactacttgagctgagacatcagtcttctgtcctgggactgcagcttgcaccatcagctctcctgcttctcatgctctcagacttggactggaactacaccaccatctttcctgagtctctagcttgctggctacagatcttgggccttttcagccttcataattagttctgtttctctcgcaaaccatgagtaatataggtagacatatctatggctgaaatactggacaattaatggaaatgtgactattttaactactctaagttaattcaataataactcagtaaatattattttactttgcaatgattcatgttatactgaactctataagttgttatgttgaacataaaataaagtactttatcattcatattcatgacttttctgtttaggattaatggtattaaatagttgaaacagttgttagtagagatgtaaattaattaataactttaggtttttctcaatatcactctgaagtacaatttatatgtatagtgtgaaagaagatactagttgaagactagcatattttagcataagaaaatatgtccaatggttatgatgttcttatgcatctggtatatttttcagggtatacatagatcagccgttataagtttgaactctgtataagtacatacagtagttatcattcttggcctatagctatctgaagtccaactggaataaccagtcaaaactgacaccaaaaccagtaggtgagggaaataacacaaaaaccagtaggtgagggaaacctaagaagctgaactgaattctcgaattatatcttatgttagtctcataaagctttattttataaattattcttataaacaaactataattcaaattgaatcaagtctcagttctcagttgatcactgcaaactccgctccacagctcaagcagtctttctacctcagcctcccaagtagctgagacgacaggtgcctgcctgtcactatgtctggctttttatttttatttttatttattttttgtatttttagtagagatggggtttcaccctgttgcccaggctggtctcaaactccttagctcaagcaatcccctcacctctgcctcccaaagtgctgggattacaggcatgaaccactgtaccagcctcagttgaattttttgatgaatgcatttcctgaggactctgctattagcaacatattttcatttctttaattgtaaatgaattatgaaataaatatgataaatacaatatttatatgttagcttgtatttgcttcctacatggttatcaatagttgtttccatgtctatttcttacctttctttaaaaatgtagtgagaacctctgtttttactttgatatttttacgattcttcatcgagtaaatgcctgctctatattgactcagaaaaatatccagaaattacaatataacaactataaaattagaatttaaagtatgtagatggcttcttacacaaagtagttacttcacaataagtattcattgaatatgtgtaaacatctcacacagctatctgtaaactctgcaggaaagctgcacgagttctcctgaaagtaaattcaagttacagcaacatctgaaatgcctataatgttgcagaaactagttcaaagagaggaatcatacacaatgttctaatatgataaatgatttcataatttagacaaaaggtaattctccaaagcagactgtgattagtcaaatattttccatcctttttttttaagtaagattatcccatttcataaataggactccctgttaatttagcattcatgatgaaatattagaagtttttcttggtattcctgtcttaaatgttgacaaataaaacaaactcaaataacaaaataatttaaattaaatataattttcccagtaatttaggtagggccttttgtatctatgctgtgatttaatatcaatttataaagataaatttataaagataaatacatttataaagataaatttataaagataatataatttaatataaatttataaagataaatttataaagataatataatttaatataaatttataaagattacttcaatactaactcagtaaatgtttctatggtgagcatctttttcatattatgttgaacccaaaatatcctcaaaagtgccttgtctttatatctctttgtttatatcttctgcagataaatatatgtagtctttttggacaggtggccatttcacttattctcaaatccagattttttttcagtacttttaaataacgttccagtcctattatttatgacttgatacatgtttttgaacagcaacaacctaagttaaagtgactttaaaaaatgtactcggtcatagaaatcacagacagggctaataacttaacaaacactgtttagtgaaactgaagcttagagagtttaaggacttgtacatgaccccaaagccagcagctgcagagacggctttaaagtcttgctttccagtgtaatgcttttctgtgttacactctgctgccttccagagaagaaccactcatcttaagtgctggctcccttgtccatttattttatcctacctggaaggtgtcattgaacccttcattctctcccttctttgccccaggaccaacagccttgcaggtgtggttcctcagccactggtctagtagaagcctgtggggagggaagtcatttctgtactctttgtcagtttcatgggtttagagaaattgacctacacagaaatttttcaaacttatttgacatggaacactttttataattatttttgtcagattctcatattgaaaagatactcacaggtaatctgtggaaataattcaaactgacattaaaatagaaagcaaatgcactcataaatttattaattgctgaaataaatgatcaaagattgacttatgtttattgtgcaataaagatgttgaagttgtaagacagggtccatgatatagttgtaatcattgagtagaaacattcaatgcaaaagtgaattggcaaatgttgtctatattttcttgctgatggaaaattatttatttgtgcattaggtgatcaccaagggtttcctcaaattcatagagggggcaagccctaaaattagaccatttgaattttttttttttttttagacagaatcttgctctgtcacccatactggagtgcagtggcatgatctcagctcactgcagtctccgcctcctgtgttcaagcaattctcctgcctcagcctcctgagtagctgggactacaggtgcatggcacaacacctggctaattttttgtatttttagtcaagatggggtttcacggtgttagccgggatggtctcaatctcctgaccttgtgatccacccaccttggcctctcaacgtgctgggattacaggcgtgagccactgcgcccggcccaactatctgaattttatttcagcatttccatttactggctgtagattttgagaaaattatttgaacctattaaacgtcatttccttgatctcaaaattataatgatgaggataaaatatacgcaaagtgcttagtgtggtacctggtaaaaagtgataaatttatgttggctattaaaagggaaaagaaaatagaagccataattgttggtgggtaactaattttgatattagttaagtgaagtagcattactataaattacgagtttcatgagattccttctgtgccattgagtgacacctgttaacatctcactggatgttaggtttctgaagaacatgggtttggatggactgaattagttataagaatttcctctatctctaattgtaggatttttacttgcatagcatgtaaaggatctttataaatataaaataggatgcaaagaaacaaaaaggaatcaaagaaggaaaatttgaatttttaacaacctcaggaatgaggtagataaccaactacagttacattatgctgtaaattttctaatcacaaagtttatagagggcacattctatcaaagcaaaccatttctttgaagtttactggtaagtcagtaacagtaactgaccaatatgctatgctgactaatatgaagttttttctcaagcataaaactgagagaagggattgagattgttaaacaaaagacacagttgaagcttataatactaatgtattgatattagagttgaaatgcatagaatatttatattgacattgtcatgtctgtatattgatacatggcatcttattaaaaatgaattgattaaaaagaaagtttattaatgaaaaaactcagatagccaaactaaaaaaaaaaaagaaaacttggggggattgtaattgtacgccagcttattctgactttcaaggatgagttttactcaaagacaaaaatcaagaatagtaagtagaattagttggcaagaataataccttactcgaatgaggctttggaacagtgactacagcaacttccatgtagaatttttccagtggtggttaaatcaaaggaaggcaagagccagagaaatatcttcaagttgctctaagaatttttgtttaattgttgatgttaaaactacaagtgtactacttatatattgctctcctctatcgagttacactaacttattccaagaaaactaaagcccaaagtgtattcattttcagcagaaaataccaaggatgacacaggacaagttatttttgcctttcagtgaggttaccttcctctaatttactccttgacccttacctggtttcctctttcaaatgcatagtttgatctactgaattccagaacttcagcttcctccttacctcctgacttccagaaactacagcagatggactttggtttgttgatgttggaactttgcccagcacttgcccagatcttttgccaattgactaacaagatagtgttgttgtcaccaccccccaccccagcatgacaattatgaacataacctagagagatttctatccccaaaataagattacaaataaagtttataacccaagataaaggttagagaaaatgtacatctgttattatagtctttaaatcttggtcaaagtgatatttcatgttaatataaacattttaataatttagatttgcaaaatgtaataatttagatttgcaaaataagccagaaatctggaattttatgtaaaagtttcgagtttaaaaaacaacaataagctacccataataacaacatgagagagaaacttgattaatagaaagaaccaaattatcgagatttgattactttaaccaaccctcactaggccaccagcaaaattagaaagaactagccagtagctaccacagaagttgcaaactcaaataaatgtctatgaagataagacaagatccctattttgaataagagtaaatgagtgaaaagcgctgagtagaagcaacagaatgtggtagggagagttgggtaactgaagagtacaggctctgtatgaaagggaaagctcccgctcattgctgacatgcaagaatgtggactcagtgtagacagatctcatttctcaaaataagccagaaacctggaattttatgtaaaagtttcaagtttaaaaaactggctaaaatctttttgaaacactgtgcttgccaaatacagcatctttggagagcttcatccagttcactactgtgctctagcagatattcctccggtatccctattttcttgacttcaaatgcccccatctgcagaggagtaacttattaaaatattagtaacttaaagcacattcaaaagagatgtgtgatgatgagatctgaaagaagaaagagagatagaaaaaggacaggagtgtttcttgaaaaaaaaaattctcacagattcacctaacatagactttgcattcctatgaccctactgacagaaatgcagatattcaatatgaatagagtaatcaacaaaggaagatagaaggtcaacagaaaattaattgctattctgtcaaaggacattttaattttaaaataggtttagaatgattgtgtgtgtgtgtgtgtgtgtgtgtgtgtttattttgtggggaggaggaaggtggagaatagcagattgtgggtgatataatttgtaaaacttgctggccagccatctcatggtaaacaagaaaggaaacattatttgagttttgggcatgcagcaagatataaaacttagaatctactctccaaataaaagctaagtgtgatgattagaacctgcctttttattatttttgctttgattttatgttaatattctcagtagttctctaattggaaacttttacccctgagctatgtataaaacatgctaagttttgtattttcttaaatatttaaaagtatctgcattaaatagttatcatgactgtttcaaatctgttttccttcaatgctaccccatcctctactaccacatatatgtaccctcttgttttttttttttttttaatcctgtctggaaacatttacccaaatgttcctttttaaacaaaatacacagatctgataaaaggtgtcatgtttcccagtccttttcaaagaactcatataaaagtataaattataatttataaccactgacagggggatctaattatattctagccttttatggccatttagactgccttttgatctcaatttccagtaaaaaaaaaaaaaaaaaaaaaaaagaggaactcttttatgctatttttaagacagtgaaaatcttttacaaaaatgagaaagtgccaatgttagaaaattaatgaattaaacaatatagtaaggatgtatttttaatttaatcacatctaataccactaaccacaatcattttcaagagacagatcgctactaccttatcctctggtttaattgtcaggccacagaattaacctaaagattaacagtgaactctgaagttcactgtaagtcgatatagtaagatagctcatgggtctgcctgcacatcataaccagtttcatagtgaaaatattaatgtaacaaaacaggataccacaaaaggatcccaaactagggctcttaattctgatcctctgttttccttagatgtgttttacattagagattcaaattcacagtattatatctcagactttgtcttaggtactagaaattgagaggtggataagaccaggtgttacaaagtcaaaaatttaaagagtattggcaggtaaatataaataattgatgtggaaaaaagtatagaatatgatccaacttggtctatatttgttccttcttaattttgacaaagacatgggggaatatggaaaaatatttctctactaaacaaatgaacataacaattgcattatgaatagcaaatggtctctgcctctatcagggatttacttagcagtgaaggtggctatggagaagtggagggaacacgcttcctctaaaggggtaactctcactcagctccagttgatggttgccaggtagaacttcaagctgctcaatgccagctgtcctaagtattttaggagagccaggaaacccaattttgatgtgaaacccttgctttttccatgtagactttaaactgtctgggccaaacagagcaaagctttaggtcatggcctgtgggaggtagatgaacagccacaaaagatctacatcagactcttcaatccctcacccttctgtacctccctgatcaaagtgtggtctgttgaccagaggcatgggcatcacctgagagcttgttaaaaatatcgaatctcagatcctgctccagacctggtgaaacacaatctgcatttgaacaagcccacacatgatttgtagtctcataatatatttgacaagcaccagtctaggaaggcatctagaggaagaaattgatttttctccaaagaccatgacttttaaatcttccctggtgattttctattgtgatttcccatgtccactgttgactatatcgtgaatacttggtccgttttggaaatcagcaaatcttaattctcatggaagtaaatctttggtacctgctaccagcagtttcagtaaatgattagtgcacactagcacacatatcacatgcctcctttcatgcgatagctttgaatattgactggcattttccatgtaatcctagaactctgaccccattctcttttgccctttcacctcatctctgctttttgatatttcctatatccatgaacaaagaggtcttttccttgccagaccttggttgtacttctgttggcttcagtttcaagtaacttcacagcagtttgaattgcaagctggtaagctgtcctaggcttcatacttatctggctcctgtggctccctctttgacttatttctccatgagttgtacctatagtctctattggccaatcctgggctcctattttgtcttttttttttttctttttcttttaggggtggggattgttggcagatgtttgtgggagtatatatctgtaatatgtctttattcattggcatgcttgctacccaaagcattgtgagaattgctaccacactaaagaagcctcaagagtgtgtatctttgtatttaccatggattctactcttgttaaatgcaacttccaatctcatagtcttttgtttcttcacagctctgcctccgagtggttggcctcccagctaaactcacgctggatgactttaggtcacaaggagttttccttttaagcacctatatttgtttgatgatttgctgcttttttattttcacttcatttgtttcttataaccattacagattatttttattcacattttatagaagaaaatgagatgattatggaaattaactacctagacgaatatcacacacacttgaacaaacactagatttttggcatttggtattttttatattatatcatgatttccgtcccaaccatcagaaagcctctaataatacatttgcatttcatttcgttttaaatatcatcgaacttgtcaaacattataagtttttatcacagacttaagtatatttaaaacatatttcaaattggcaaaaatgtagtatataatacatgatcctactatatttacaataagagaaaatgaataaattttggagtgaatatatagacgcaaacaaattgaaataaggtattgaacatttttcagaaaaaaataaacttgatgaagatgtaggccactttaatttaagtaaataattgaaagaattaaaaagtgttcgtattcattcagcaactattgattgtgtcccttcagtattattcactgttttaggcaaagtatgtgatcagtggaagatgataaacataggcctcctgacatcatgggttgaggaacacagataaaatcaacataatttcctgtcaaaatggttgtccgttctataagtaataatcattataattttctaaaacgtggacaaatatagatgagcttactatagctttcaagactttcaactctcactctaagaaatacatttcataagtctagagctgccatagtgattcctctgatggatctgagcagagtaaattgaaaaccttctggaaaggattcaccattatagatgtcaaagggcattcgtgattcatgaaaggatgtcaaaatgttaatattaacaggagtttggaagaagttgtttctaactattatggatgacttgaaggggctcatgacccaccatgggaagtaactgctgatgtggtaggaatagcaagagcaagagaactgaaatcagaagtggagcctgaagatatgactgacctgctgcaacctcatgataacacttgaacagatgaggagttgcttcttatggaggaacaaagaaagtggtttctattcttgagatagaatctacttttggtaaagatgctgtaaacattgttgaaatgacaaaaaggatttacagtattatataacttagttgataaagcagcagcagagtttgaaaggattgggtctaattttcaaagaagttctattgtgggtaaaatgctatccaacagcattgcatgctgcagagaactctttcatgaaagtcagttgatgcagcaaatttcactgtcatcttacttaaattgccacagtcaccccaatttcatcaaccaccaccctgatcaatcggcagctgttgaccttgagaaaagacttccaaccagcaagaagattacaattccctgaagcctcagatgattgttagcactgttaagcaataaggtatttgtaattaaggtatgcacattacatttttagacgtaatactcatgcacacttaatagactacagtatagtacaaacataacttttacatgaggtagaaaactaaaaattgtgtgacttgctttattgcactatttggtttaatgtagtgttctggaatggaacgtgcaatatctccaaggtgttcctgtatctaaataataaaatgaggcatattttacatgtccggaatttaaaagtttgtatgcctttttcaaaaaataaagcgttaattcactagctatgagaaacccatcatttaaccaacttaatatctattagtaatacatatttcttttttccttaatgcgctagcactttatttattaatcgttttaattttagattcaggaggtacatgtgcacgcttgttacatgggtatattgtgtgaggctgaggtttggggcaccaatgatcctgtcccccagacagtgagaatagtatccaacaggaaatttttcatctcttgcccctgtccctctctcctctctctagtggtcctcagtgtcattgttctcaatttttttttttttttttttgagttggagtctcactctttcgcccaggctggagtgcagtggcacgatctcggctcactgcaacctccgccttctgggttcacgccattctcctgcctcagcctcccgagtagctgggactacaggcgcccgccaccacgcccagctaattttttgtatttttagtagagacagggtttcaccatgttagccaggatggtctcgatctcctgacctcatgatctgcccgccttggcctcccaaagtgctgggattactggcatgagctaccacacctggcctgttctcatctttgtatccatgtgtactcagtgcttagctcccactcataaggaggacatgcagtctttttctgttcctgcattaattcacttaggataatggcctccagatgcatccatgttacaactaagtagatgatttcattattttttatggctgcatagtattccatggcgtgtgcacatgcacacgcgtatgtgtgtgtgtgtgtgtattatattttctttatccagtctaccatttatggtcttctaagttgattccatgtctgttattgtgaatagtgctgcgattaacatacaagagcatatgtcttttggttgaataatttatgttcctttggttatataaccagtaatgagattgctgggtcaaataaatggtagttctcttttaagttctttgagaaatctccaaactgctttccacggggtcacccaccaagagtgtataagcatttatattcttaccaagaatgtataagcattcccttttctctgcagccttgctagcatctgtagtttgttgactttttcataatagccattctggctggtttgagatggtatcttatagtggccttgatttacatttctctgatgattagtgaggtggaacattttttcatgtttgttggccccttgtatgtccattttgcgaagtatctgttcatgtcctttgccaactttttaatgaggttatttgttgtttgctttgattaagttccttacagattctggatattaggcctttgttggatgcacagtttgagaatattttctcccattttatagattgcgtatttactctattgatagtttcttctgctctgcagaagctctttagtttaagtaggtcccacttgtcaatttttgtttttgttgcaattgcttttgaggacttagtcataaattatttcccaaggccaatatcaaaaactgtatttcctaaattttcttctaggattcttagagtttgagttcttacaagtatatctttaatccaccttgagttgatttttgtatacggtgaaaggtaggcacaggtttcaggccaggtgtggtggctcacgcctggaatcccagcactttgagaggctgaggcgggtggatcacctgaggttacgagtttgagaccagcctggccaacatggtgaaaccccatcgctactaaaaatacaaaaattaaccaggcgtggtgacaggtgcctgtaatcccagccacttgggaggctgaggcacgagaatcacttgaacgcaggaggcagagattgcagtgaactgagatcgcaccaccgccagcctgggcaacagggtgagactctgtttcaaaaaaagaaaaaaagaaaagaaaggtaagggtccagtttcattcttcttcgtatggcccatggctgcctgttgataccagtctcagctgagctactttggctcctcaaagaggaggcatctcttcctcattagtttctgtttggagtccccaaatttgcttggatatgcagctctgagatgccccagtactgtttttccgggtaacatgttaggggtgacctttggatgtaacaatagttgtccaccatatgtatatgcttaatagtacttggggaagaagatataggaatttaataagtgattttctcaaaattgtctctacctttacctctgaaactagtgatatatatacataattttcatatctgacattaaattttaattataatatgttgtttgcaaaaattatctcctgaaactttagttgtcgagttattttattggtagtggaacatctcttaattatctctcttacttaatcatctgtaatcaggatgctactttgccggaaattggtttctagactcattgttttcactctgtgaattgttcagttccatcaaagcaggggtttgactggctgaccagccatttcatagaaagaactattttgttttttaatgttgtgtaaacagaccatgattttgaaactgagcctatgaaaaatacagtaaagagatacatcccatcaatacctaatttattgagagttttcagcatgaagtgttgttgaattttgtcaaaggccttttctgcatctattgagacaatcatgcggtttttgtcattggttctgtttatatgctggattaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccatcgtctcagcccaaaatctccttaagctgatagacaacttcagcaaaatctcaggatacaaaatcaatgtgcaaaaatcacaagcattcttatacaccaatagcagacaaacagagagccaaatcatgagtgaactcccattcacaattgcttcaaagagaataaaatacctaggaatccaactttcaagggatgtgaaggaactcttcaaggagaactataaaccactgcccaatgaaataaaagaggatacaaacaaatggaagcacattccatgctcatgggtaggaagaatcaatatcgtgaaaatggccatactgccccaggtaatttatagattcaatgccatccccatcaagctaccaatgactttcttcacagaattggaaaaaactactttaaagttcatatggaaccaaaacagagcccgcatcgccaagacaatcctaagccaaaagaacaaagctggaggcatcacgctacctgactacaaactatattacaaggctacagtaaccaaaacagcatggtactagtacaaaaacagagatatagaccaatggaacagaacagagccctcagaaataatgccgcatatctacaaccatctgatctttgacaaacctgtcaaaaacaagcaatggggaaaggattccctatttgataaatggtgccgggaaaactggctagccatatgtagaaagctgaaactggatcccttccttacaccttatacaaaaattaattcaagatggattaaagacttaaatgttagacctaaaaccataaaaactctagaagaaaacctaggcaacaccattcaggacataggcatggacaaggacttcatgtctaaaacaccaaaagcaatggcaacaaaagccaaaattgacaaatgggacctaattaaactaaagagcttctgcacagcaaaagaaactaccatcagagtgaaaaggcaacctacagaatgggagaaaatttttgcaacctactcatctgacaaagggctaatatctagaatctacaataaactcaaacaaatttacaagaaagaaacaaacaaccccatcaaaaagtgggtgaaggatatgaacaggcacttctcaaaagaagacatttatgcagccaaaagacacatgaaaaaatgctcatcatcactggccatcagagaaatgcaaatcaaaaccacaatgagataccatctcacaccacctagaatggcgatcattaaaaagtcaggaaacaacaggtgctggagaggatgtggagaaataggaacacttttacactgttggtgggactgtaaactagttcaaccattgtggaagtcagtgtggctattcctcagggatctagaactagaattaccatttgacccagccatcccattactgggtatatatccaaagattataaatcatgctgctataaagacacatgcacacatatgtttattgtggcactattcacaatagcacagacttggaaccaagccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacaccgcatgttctcactcatagttgggaattgaacaatgagaacacatggacacaggaaggggaacatcacacactggggcctgtcatggggttggtggagggggagagataacattaggagatatacctaatgctaaatgacgagttaatgggtgcagcacaccaacatggcacatgtatacatatgtaacaaacctgcacgttgtgcacatgtaccctaaaacttaaagtataattttttaaaaaaaagaaaaatgtggtaaagattattccaaaaggtaggtggtcgtgaaaaccaagctaacagggaacagaaggacacagcagtatttattaaatttacttcagaactactgccagattcactttaattctatcctatcttattttggacttaagaccaaaagttgttttcatgactttttcattacacttatgtctactgtaatttttcttctatactttatctgtgtcagagttggtgtttgctttctgaagtgctggttgtaccatatggttgctttaatttgaggaagtatcttatttaaaaaaaaaaagtaagaaagcgatttgaaatgagtatgtattcaatgcagaaatcagttattctcatatttaatgctttgtgatagagaagtcagtatattctccccgtggtctccaaatgcatttgaattcatctcaaattatttcattgaaagttcaccttttgtcatacaaaaatggtaacaatgtcttcagggatctggggcttttctaataccaaaatcttggattttgagattcaagatgaatagatgtattaaaatttatagaattgctttgggggaaacacaaaatatattgcctctgtatttattactagcagtatttaagtgggaaaaatgctttttctttcctatgcattctttatatcatcagtgattcattttgtttgaaaggaattctctttagattttagatcattaccttaacttctctttatagggaaaaaattactataaaattttaaaaatagagaggatcttcaaaatacatgagtccagtgaccctcacttataggactgttgagaatccagagacttagtgtgatttgtctaagagtatgaatctttggtgccataacttactgtatttttttcctttttcacatttactttcaaatatattctgtttatgttttctttctacatattaagttacatatttatatcttctgtattttatgtctaaatttaatgcatttcttactcttggaagtttttggagtaaatgacaatacaacccacaatccaggaatagtatgtttagcttttgtaatagtaattatcttattgtttactaaaacgtgtattaaatatggctgaccagacccataacaatatgagcacaaaaattactacaataatttacttttgtacattgagtacagtggaaacattttgagctaactagaacatttagattgctgttaactactggacatgacatgatggcctgccaactcccatcactttcgtgagtaccgttcccacgatctactgggtagttaactgtcactagaccttgctccctctggtcacttctgattagacaaaaggtgaacttctgatctaagctataccaattccatttcttctccctgaaaattgtggagcatgcaggaaaggtagagagctataggcactggattgattaactcagatatataggagctgaatttgccgcaaacttgcaaagaaaaccaatttctgtacaatgagagaagaataaagcagggaaaagcagggttgaaatacattagagataaacacagacagacagacacacatccacacacagaaaggcagagagacagagagacaaagaaaaatgagagaaagcaaacaagcttttgttccccaatgctttccaattaatttccaattaacagcttattggaaagagccagcagatcgcccttaggaaagacgaacctctgaatctttataataaattccattttcacctaaattttctttgcatgagtttatgtttattgcaatcagtataaaaaacacactgcattttatatttgaatgatatattgagacaatcattaatactgccagtaaagaaaaaaaaatattggtggcaatggactaggttgagggattaggaaataatgtccaggtattttagcagactattaaaactccgactgagccacacaatctgagttcaaatctcagtggcaccagacactagttatgtgatttggacatgtttcttgatctcccttccttagtaaaatggaaataataatagtatccacattacagggatgttgtgataacttaatgatttaattcatataagagtttggatgaatgtctggcacatagtaaatctgtataagtgttaaatattgaactactaacatttatattgaccaggagtaaaactgctaaccctatataattttgaagaaaataaatattttacctatatgaaatacagttgccaacttctgtcattacttaatagttacatcttttgtttttcacttatttgccaccatcctggtctatctatatggcttcagtgcccttcaagcagccctcccagactccattatctctactttctaagaagctatgctgattgtcactcatccgtcaaaaactctaaaatctgatttcaaatctgacatcctttgtccagcttgaatttcctgtgtgacaggctcatgctagctactcaataaacaaaggtaaatcaaagtctcttacataatggagttccagggtggtggcgaaagccatgtgtgaaggaagagcgtgtacaagggcctagcatcaggagagatgatagctcattcaggtaacatgtatgtattcccaagtctgtgtctttgccaattttattcatctatgtggaaagccattgctttttgtctttctacaggttgaactttggttgaagtagtttctagttgcctccaggtgagagtttttggtaaccttctcatgtctcaagatcgagctcaatttcatctcttttataaaacttacccacttcagacttcctgattatttccttgtaataattagtaacaggtatcactagctatctctatcacatgaatggaaaaatgcatgaacacttttagggcagtgatgtgccatttcaaccaaacgttaactttagaataactaagtagcaatgtgtttgtggaaggagaaaagacttttatacaatcttcaatattgtatttatctgttttatatgtaggagtcctcataacaaccctatagaagaggtatcattacacctgatttttagttaagaaagctaagactccagtaccattttctaagactaaacacctaagagcaagctaatttgtcaatatattccacacatatgtgatactgagccggtgaacaggctcagtaaatgttaactcactgcactatttcttgtctacataacgttacatgtgtatcacatacttgtaaggatgtgtggatgtttatcaacttttctttctcagagtaaatggctgaataaaattgatgacatgcatattaaacacaaagtgattgccacagaatttccttccataatatttttgaaagctggaactaaaccactcccatgtagatactatagagttgtggtttacagtggtttttagcatatttactatattttattattttaaaacataatgagctgttgtatgtaagtagcaatcacaaattatacgtttatttgtcagcatgatgttccaaaacaacttatattcaaaactgtttattttcacatagactactaattacatattggaaaataaacataaatattaaactcactgtattgtaaatataatatgaagccaaaaacatatgcctcaagaaagtattggagctgacatatggtttataacttcttgtgggctaaatacattgtccttcactgaaaagcttggaagtcttttattcacttatttaaggaatataaaatggtttccaaatgggcatcacttaccaaaatgcacataaatgtgctttctagaaggagaaaaaacaatgatacaggtatttttaagataaggtaaagcaatttaaaaagaatatatccctgttattctttagcttccagtgtctagttttttatgattgtattgattttgttttatagtagtgtttgaattttgtactttttttcccaaaaatattactcatctaaaaagcacattgctttctttgataactggcttagagatcattaaaatatctgattaatgagtagatttttttcactgctttactattttcaatatgtcagagaaacattcaacccttctaagaaatttttctgctttgcataatttatagatcagattgttccttctctataataatggcacttaatttttgcctatgaaaatagattgtatagtttgtatttaaagaagttaaaagtctaagtagtgtaattaaaatcaagctatagatttcatagttcagtaaaagtaacatagatgtggaaatgggctgactggatccaaatcatgaccctttcatttgtcgtttcaccctgctcatgctacttaatttctctcagcctcagtttcttcatctgtacagtggggataataacgtttgctgatagttttgtggaaggattaaattagatactgaatataaagccccttatatatgtcctagatgttacaagtactcaaaatgtggctaccgtttttgctagattaacattattgggtataggattttataatagtttgataattaaagatgataattttttcaacaggaaataaaagtcactatctgtatcttaacatatgtagtagagaaactttcaggaacatttttcttctctgatcttactaaaacatcagttcaatttggggagagctttgtccatccgggtaacaactgttccaccctgatcaagggtgatcatagtgaatactgataggaagaagaagcataagaaataccaacttaaaatctttaattccaaaaaaaaagggaagaaagaaaagaaacagtatgttattagacaattgtggcactgcatgctggtaccacatggaaaaaaggcagattagcttgttatttatctttcaggtagaacaagttctttactaaaatattagctgatgcaacatacttttgtcttttaaaataagctactggatgaagttcagccacctttcaaatacattgcccattatcttataagatccaatggaaatagagaatttaatttatgactttcttgtataaatgcttcttcatggatgctttatataaaatataataatatcaatttttatgactattaaagattttattgaaatagactagcatcagagtctatagttagaacataaaatcttaatggtatcacaatttactttagacacacaaaatgaatgtctaaaaatgggtttcatataaatttttcatggtgggatagatattagagaactaagatatgtcattatatatatgcaatcacttaaatgcctttgttgttttcatgtttgagacatctttacaatgttcctaatatttcgatgttaagatttttaacagaatagcacgattttactctcaaggcatacttaaaatatgtctcatagggagtttaattagataggaaatttgggtattcttatgtctattatttcattttacattgttatgaagggttatttgagaccgggtaatttataaagaaaagaggtttattttggctcacagttctgtagactgtacaggaagcacagtgccagcatctgcttctgatgagcacctcaggaagcttccaatcatggtggaaggtgaagggggagcaggcaggtcacatgaggaaagagggagcaagagagagaggggaggaggtgtcagactgtttaaacaaccaattcttccttgaactaacagagttagaattcactgattaccatagggagggcaccaagccgttcagtagggatatgtccccgtgacccaaacacttcccattaggccctacttccagtattggagatcacatttcaacatgagatttggaggggacaaacacttatatttaatagattgctgaaaaggtatcattacttaaaaatgatcttttgcctatgtctaagtttaattttgacctgaacttcagcaattgactagtgtctgaccaccagaagcattcctgatctctgaggagctgcagttccagcaactcactctgtacctaagattggtgacaaagaaagcccaggcatccaaacaagtcagcccttgaggaaaaatagggctgaaagcacacaggctgcaccttatattctgtgttcaggagattcccctagagacagagaaataaggtacaccctaataggttggtggtgtgccaccaaagtcattttgcttgaaagctgaagcatgaaagaaaagaggtgaaacagtaacctaaaacatgaagatactgtgagatactgaagtagtatggacacttatcagtagagacaaacaacaatggacatgcagagggaaaactttttaaacttttgtatttgagagagaagtgaatggctatctttttatacctcaaccggccaggatggtactctacctgggaagtactgtgtttactatagagatcgtgtatgaatggaagaatgaatacccttaaggcagtgctgtgccatttcaacccaacattagctttagaataactaagtcacagtgtgtttggggagggagtaaagagccaactccaggtaaaaagtgatcaaatgcttctggactttttgataaaaggcagccagaaacagatgatctgtcctagtctttggaaattccagaattcccttaaagaactggattagaatctgccattaacaaaattaatctaacctgttggccagcataacatttttccaccaagtaaatttataatgcacttgatccaccatgccagaaatgttcaaggttttcaatctcaatcttatgtctgtgcttctgttaaaagatcaactaataagtacacataatggagtattttggtttattgtcaatgcaagaatcagaattgcatcctatgttggacttttcccacaatatcttggtaaatgatcatctactctatatgcaaaaacatcaattattctggcaatgcttctttaattttttaacttaaaaatacctacagatggatggagtgaaaaattactcataagagtttaccaaaactcagtcttctgaacttgaaaaaatgtattcgaaggatcaattatttatagtaccctatgtgaatttttcattttatgaccaaatgtgtttattttagtctaaaattaatgttttaaatcattgtcattaaactaattttcaagcaagttgagccacgctaattagaaatattcttataccactgatcatatattttttttaactccagggtgttcagaccccagtttcagaaacacagtctttattatcaaacagttctatgtttaaatcaagcctttacctcacatttgctgtgtcattctggaaaagtagcttaaccttagcaagatttgtttttcaccaagttaaaaaggaatgatacctactgcattgagtttatggcaagcattccttgaggcaaggtaatgtaaatttcctggcatataatactgtttggggtggaattgtgcctaccaaaaaagatgtgttgaaattctaactccatcaccacctgtgaatgtgaccttatttggaaatgggtctttgcaggtgtatttaaagatcatacagaattagaatggactataatacaatgactagtgtcctcatgagaagacagaagtttagacatacacacacagagaaaatgacatgtaactattgaggcagagaatgaagccatgtgtctacaggccaagaaaggcctaataatctgacaacaaaatatggtattcctttgagttgacttgttcccagtgaacaaggtctggctgctaaaattatcttttaatgtgaaaatgctcacagatgaattactcagtaatttatgctagaatatttccataaattaacatcaagacagtgatctacatatacacatttgtcctagttttaaaaattgtaacaatctctacttttaaaacatactattattacagtagtattattatctttgtagttttgtgggggttttttgtttgtttgttttcattttttgagacagagtttcactcttgtggcccaggctagagtgcaatggtgcgatctcagctgactgcaaattctgcctcccgggttcaagcatttctcctgcctcagcctcccaagtagctgggattacaaaattaattttgtatttttactagagatggggtttcaccatattgctcaggctggtctcgaactcctgacctcacgtgatccacctgccttggcctcccaaagtgctgggattacagatgtgagccatgccgttttacatgcatttttcaagaactgagaaataagtaatatgtacatttaagtgttttcataattatttttattgtcttttatcttcagttatttcagtgacccttaataattttcagtttatatttgagacacagttttgtttgagtagcttccaaagtcaacttgtgacatgaaaaaaatgcatggtgaaaaaattcttaatgtagcatacttggccccaaaacatggtctatatggttttgtgttacatatacgtgtacttttactccatatctcatgtacacagcaattcttttgctaagaggaaagtcacttagctagactaaaagaaggaataatgcctagtacatggttaaatattagataaatgttagctatgatcatataatacctttattcttattatgaatatattaaacttatagtagtttatgaaaaagagtaaatgttagaactgtttagaatttcctactccataatccagtcatcatagctaacatttatctaatatttaaccataaactaggcgttattcttttctttatttgacacagtctcactctgtcacccaagctggagtgcagtggcgcaatctcgattcactgcaacctcccgtactaggcattactctaagagttgcattacatactatattaacatagtttgattttttaaattcattcaggaaattttgacctagagaagttatggtttcttggaagattggacccaaaattcagggagtgtgtgtgtgtgaatgataaaaactctgctatactatccttggttgagaggctggaagcaaaataagagttgagtatttttacagtctctcacttaagctctatcttcacaatataactaattaaaatgtttacataattcttagcttgtgctaagcttcagacagagaatttaaaagtatgtttccttaattatgtttcccttctttctgatgattgtgcttgatactttttcagtctgatctggatttagaatttgtcatgtaagtttttaaaagcgctgtgatgagtgtaaaatatagtttcattgaatgttgactgtccttttttttttctttattctttgtggatcttaatcatatccacagcagaagttccccctcacctctgagccatgagattttaaggaagccaagtggaggttttatgagatgctctgcttttaattgaatgaaaatttcagcagatgtttagctggttaatgcttcccataaatttatgttttgtaccagtgccaatttttaaactgccttaagagagaatcatctcacaatctcttttgcagactaatactattggtcttactggcacttaaagtggtcatgcctttgattcactgtcaaaggcttcattcatttattcacacgtcaggcagtccatcggtcaatcatttgagaatgtgcaagatgttttttggaggtacccagatgatttatactgcttgtgcttcagctgtcctctgagtttagtagttactttgatatcttagtgagggatgctctctagtgttttcctacagatgtttccatgtcatgaaatggcaagataaatgattttgcttttatctaaaaatcacatttgaagggcaacattttgttttggagattccattaaaataaattatggtcagaggcatggactaaattccctcaaagggtttgctagtgctctttgggataacctttacttcttgctttttcaccccctttcatgattatggagtgacaatacatgtagttttgtctagtctattggttttgtctagtctattgtggagtaaagttaatattgaatagcttgtaaaaatcaattttcagatttctgttttgattcagtaaacagatatcttaagctcaaaacaataaacacaaaccttttaccaggttaagaaatgcagagattctttgtcttttttttttttttaattatctgatgttttgagctttatgcctaatgcctgtgttttggtatgcatattatttacaaaatcagttatttaaatggttttaaaaaatccaagccaaatgcagctccattaatttctaaagatctttttgtttagttacaaaatacatatttaagtgatatgttgcatcttttggattctagttgtcagatccttgaaaacacgttaacaaaatctgaatgtcttccttcatgccttaggatcttcttctcttccttctctgcaaaaatttctccaccctggatttacttcctgaccagctgcacattttctttggcttttgcctcctccaagattcaaatggcttaattttagtgtgtaattaatgcttattttttaatacaatagtggacaaatcacaaatttcacatcacatgctatgcaagagaatgcatcagtaggcattatgtgaatgattaaattaaacctaacatttatataatggtaaaaattcttcctggcattgcaaagagctgtggagtttgtttagggtttctctgaaatttcttcttgtatagccctccagagatctgtcaaataaataacagatgtagagattatcaattattgttgaacgtttgacaaaaacaggcaagccagggatttcccactggatctcttcatgttaaaagaaaaaaaaagatcttctagccagaatcaagtaattaatctagatagtatattattagcatatttttaatgtaattttgctatgttatacctgcaaaattttgtcaggatgaggagggtacattttctatatccctgaagatagttatttcatctctatgaaataattaaattcactgcattattatggtctctagtagagctgtaaagacaaaaaagttgcaaaattggtaaggtctttgatatgtgtattttgtggcttcctgaattccccattcattcatttagtcccatcaatgtttattgatcatttcctgtgacctagaccctgtccccaccactggccatagagcagtgagcaagacagagtgctgaatgacatgaagcttaccttccaatgagatgagtgaaagtaatcaggagacaaagttatggtgttttaggtgatgataagcacttgaagaaaataaagcaatgtaatgggttagacagtgatggaattgcaatgggaagaggctgttttatcaagaaatttaagacaggccactctgagatggtgatatttgatcagagacatgacttaaatgagtaagtaagctatttggatactggtgaaagagcattatgagtaaagggaacagagaaagcaaagccctgaaattggactggagttatttaggatttagattgcaccataatgttttaaataacaaaacaaaaggaactatttattatttgaaagacattggaaaatatggacaactgctccaatatttatttcagagaggaggaaagaataaatccagggaccgttttgaaaggaaagactaaacataagtctctttttggttgtactacatgtagtccatacccttcaactaaaaggaacagaaacaaagaggaaggaatgattaatcctatcaagagaagaaaagatgtgaagagacagaggaaaggctattaggcatgtgttgacatgtggggaggggagtggcacgtttttcattgattttactgtacattttcaacaaactctaaagcacaagatctaactaatgtcttctttttttcctgtagtaaaaggtattttaacctatgaatggaattctacatacaatactcaaagaaaaggcatttgcaaagacacatttgattaaatgcacgtttttcgtcagacttttgagttgactcagaagaggtgctgattttcattatgatcagacaacagaaattactgaaaatcaaaatacaattgttgatctcatttcaatgctcaggacaccactgttttatgattacaattagtgttaaaaaatatcttttcagactgatgaagtttttaatgtgaaatattaaaaaaataccaaatacatagaagatagaattcaataccaggagacataaaaaacaaaattcagtttcttctctggcaatatcacatcaataggatatttactgttaatttagtgttaaattaactagtcttataaactagtcttataaacatagcattattatataaaaatcataatgaaaaagaaaactagcaatgtaaaaatctgacatattataaagtttatgtaacttgtatttcagtacataaaagctaataatataactaaaatctattgttggtctattccaaaccagatgctgtggaagaggtttgcctgcattagtactttaaccttccttataactaaatggcacatatagtattattatctgtgacttaattatcaaatttacccaagattataaaggtatgaattaccagaaccaggattgcagcctaagtaagctgtctccagagtcccttctcttcattattattttaaatattagttttaaactactattgataaccttttcagaacttttaaaaaacaccatgtaaaaaagcaagaaatggatgaaatacacatcttttatatcatcagttttgttcaattatttatgtatcgagggttatttctctgcttaagattatatagcaatatgtctaatgttttgcatgtgtaacggtcctattttctactattgtcttacttgaagtgcctgggtattgcctgtttgccctccttgcattcaccgaccttctcttgaaagctatattttaatttgcccatgtgtggagctatgaatggaactaatggaaggttaaagggcaggaagcagagaaaggccagagtgtttctttttcaggtgatggtggcttcttattcttgctgaaatctggattatttaaacattaactgtttgtttgaagacaaacgtttcagcccatagccccaaattaaatactttctatttaaaatacctagaaaggtttctatattcttgactagacgctgactcatacagtgactttttgcattcaaaggcagtgaccaaaaggatccttataattgataacttctcttcttaaaggtagaaaaatggaatggcattttaaaaaacttgaattcacctgcagagagtcagcagcattgtttgccagcagtagtgtcaacaaatttaaaaaagtccaaattgaattaatcaaaataaattgttaagacttgagtttatacctaaagaacaatattttggcgtctttccttccatatggaatggttaactgtgatattacactcttccctctggacgctgaggattcttctggctgtcattactaaagctcttcctaaataaaatacatttaacactgttttgtgaccctccatttggacaagtttccatggtcagggctattttgttttagaaactgtattaacttgcataattgcaaatacattctgttagacccataaagaaaaaccgcttggctgagtatcattatagctaatattagagggacctttttaggtcaggcagtctagaactgttagctactgattttcttagcacacccacacctagcatagttattggaaaatgtatcaggtagcttttgctagaatacaaacccaaaactccatgtcttaagacaaaaaccatttattcacaattttgtgggttatctatttgggctgagttcatcagggaagttcattgctgctctacgggcttactcaagtttgtggccggctgcccatcagctaggtgatagtttctggggggtgatatggctctcagcaagctggtttatgatagtctcatttggtacagctggaatgactggagcttgcctccatatggtcatcatccagtaggatatctcaggtttgttcatatgtcagctcagagttccaagagcagcaaataagccaaagccatcgtacaagtgattttccagggtctgcttgtatcatgtttgctaaggttacattgggcaaagccagccaaatgaccaacccaaattcaagattggagaaatagactccatatcatatgggaagaaatagtctatatcattataggaagagtagaccttgtgatgattattataatctgcagagaatataaacaatgggcaaggtatttcattcaaacaaggaaaaagaatgaagcagagagccgatttgaagggaccatatgagaaaaaatacttttaaagaaaacaagatagaggaagaattagaaactttatcttaggattggagtgggtatggatatcacagaaagtgaacaaacaacaaatattttatgtctatggccagagaaatggatgctttgagagcaggcacttaatcatgaattaatctaaagtgaaggtcaaagtgtggtcaagtatttctttgctttgttaaatcttgacatggtatccacatgaatttccacattagtcccaccaaatgaaggaaacctatgtgaattgatatatttagaacttccttaccagaaagctcaattgtatgttactacattcttacattggaatataagagttgggtatccagcttaacttctgaaaatgctcacacagtaacaattgcaactccgtatctgtggacatggggctagaaaggaagataccatgtcacattaagatattttctttggtatttatctacttcttaatcccccattttactaaaatacataagtaagaaaagtattccaaagtctgtaatttagcttatttcttaaccgcaaatatgttacctagcaaccattgaaggacatctttatatctttaaggcgaagtacttcatattaatttagcaaacatctgtttccttatgagaataggcatgctttcattgagacagtctgcatgtacactgctctcaatggcaattatactccctttgcttaatagttgatcagattaacagaattctagctcttaaagggacactatttatttgaccctattgaaaatttaatcacgcttggattgtttggtgaccttttgtcactgtgggagctctgagattggaatttgaagtgaacagcccatgatttctccagaagactgaattatcacttatattttagttttgaaaatgatgctgtaatttggcaggtttataacttaccactaattgaagcaatatttatcaactgcacgtgaaatatagcatggtgttaagaactctagagattgttaagtttggttaataatccgggttctggcactctttactgtgtgacatttagcaaattgcttagtatctttaaatagtagtttcctcatctgtaaaataagagtaacaataaaaccttctttaatgtgttgttttaggagtcacattagtgtgttctaaaccccataattaaaattagtgctctaaatcccataattaatatttgaataaagaataccatgctatatattgtacttaattttctcagttgctttatcaaaattaaccagttttattttgtttgaaaaaatggattttgtttcaacagtggcttaaaattggacatgaagaaaatggaaaagtcagatttaaaaaacacacaacaaaaagccccaaaactgtaagatgaattaagtcctatctgacctttttacttataaattttatagtaccaaaaaaacccttcatgacaattttctggaaatacaattaacttgctattgtgaaaaattaaaatgcatttttagctaaatatatattttgaaaattagaattatcagaaaaacaggtacaagcctttgaatttacttttaggtacaatactcaaacaccttctggttcatgtaggcgaatatttgtcatctttttccacttgattcacatgtgtgagtccaaatgttaaccagcaatgtttgttacaaaaaaggaagtcatccgaaaaaaaattactctgcagatgcctcttgtcttgagaaagaaaatattatcagaaaataatgtcagattgatgactgattcgtcctgtgaatgcggatagtagtagactttccaaggtcaccatttggattcatatgaattatttgttcatatccttgtcacaaaagggaatagagtggctgtgggtactttcaattagagaattttgaacctgtgtttgaagatttggatttctaacaatctcatcataagaaaacgaaaaggatacctattcttaaggctcatctgccagtagagaagctgaaatttaagtctagtggtatgtgaaatattcaacagactttgtcaaaggcttaactttaaagctagggtaactattttgaggaaaaaatgagaaacgtcttttggtcatcataaatctagtgcctgaggatatgcatattcaagatatgaaattctaaaaatgttaatatttactcaaattttaacttggaatttttgagactaataaatgttcctcagttaaggcaataccgactgtgaaatagttcatgaagtcatagagatgcagttcaaaattctattttcattattcatagaaatgttcaagaacaaggattagccaaggtaggaaccattcacttaaaaatcctgaaaccgagaagtagccatacttacataaacgttggcagcctggaataaccaacaaattgtgactattattaaatgaatatattagagcaggaaaatcatgccgttgttaagaactgcagtttggaaccgacttgggaaagattgtcttatgataagttttctcatagctaaattccttttccttggagttaaaatgagagttacaatttctaacgtgaaagatgaaaaatctagtggaaatgatagggttaaaatgatatatttttatgaggatacaaggcagtacttggccaaacaccttgaaaaattttagtgtttctctttttattttttataccaacaaagaaggtaatatggtgccactgaaaatgtatgggtattgtagagagagagaagcaattttaaacttagctctgtgacttgctacttaatgacttggggcaaattagtcaatgaatctgagcttcaattgtttcacgtgtaatataacaatgcccatatcataaggtcctttggaggataaatgaaataaggtctgtaaagtgcccagcacatgggcagagaatgctgtatagggtaacctttatgacttagtggaaacagtggcaattatatcaaagttctatctctgaatctttgtgtcaatgaacttgaagtgcaagacctggtcatatgcgtagcagaagctacctccttggtcagccctgaaaacacttcaatttagccaccagttccaattaaaaatattagcccagaagatgccaaaatagctaccttggtatggttccctgcctctgtgttttgaaatttttgagctgtgaaccagagaggtttttttgggttttgttttgatttgtttgtctgtttgtttgtttaatttttgaacttttggagggccagcgcttcttttccatctcctaacagcttttcgggtcattcgggctcttgtgaatgttttggtttttgactgatccctttattttttagttattctctgacctccactactctatttttgggaaaatccctcgtgggtgtttattaagacttttgcaattcctgtgtgccctactccattgttatcctacagaggtgttgctcagacattctggacctgaacaggccactccaaagtgccttgccctttcagaccactgttccagcttaggatcccacctatgtccagcattgactttactcttgtcccctcggcctgtgttcctcaaccagaaacttcttgttacttgtggttctctctttgagaataataatgagtgtttttattattgacttgaatcctaagactcattgtacctttgtttttctagaagaccaaaaaatactcttaaactgttctcattaacttccttagaataccaatgaggtaatgctttgaaatcaattttaattttatgagtaatatattaatccagaacatttttaattataaagaacaatatctgaaatcagatcacccttattgtaaatactattacaccctgaatttgcttctagtatttttatacgtacatcttaagatggttttctattctacttttttttgcatcatatttttcattttactctacaagtatcacgatttttatttttgatggctacttaacattttgaagagtgaataaaccataatttgataataacaatttccctatcattaggtgttttagttccaatttataaatattataattaatataaactacatttttggaatatcagttcacataaaaagagaataaaggaatgtcatagtggtatgtggtaagtctaaagtcaatttaagaaataaaaagcacattttctatcgctccagtattctaccagcttgattatgatagtgaagaattttgaatttaaaagtcattgcttatgtttttaaatatattttaagctatcgaatttaatttcacacacacatatcagagctaaaataggagagagagagctagatttagaaagtgatcatcttccaaatttttaaaaaaatctattttactgaaatttggaaacatcattaatgtagaaataatgtcataaatgatggttagttttcttgaacagcccacctaaatctgtatcatctcttctgtagatttgtaaagtaggactgtaacatctactgtatatacctcaaatgagtataacaaacaaaatgacctatttgtaaattgtaaagcaaaattagaatattagatacattcagtacctagttcattttaataataaaaaaaaggttatatgaagttccaaggaccccagcagtggaaacttgaccaacaaatgctcacactaccaccccagaatcagcagtaaaaaatgaatggaactgctgggaaatcaagctcagagcttcaaaaggaagagaggagttactagtgatgaagagtccacaatatatgctcagaagatgctattaaattagtaaaaagataaccagaaaactgtaggtacaacacaatgatctctgcaagggaaatagggatttggggaatggatttttagctctctataggagttgtaattgaattcctgtacataagggagttgttctcctaagggtctggctgcaaggagaatctctgtaatttaaattaaaaccagctgctctaacaaactcctgaatttcaatggctctgtacacagtagactttcagcagtccacagtgtttcctgggggttgggtatggagttgagatgctttgttatgtacagtcactcaagaactcagactaatgaaaacacacattttcattatgtggcctcattgttttacctggatatatcccaggtggcccatgggcaaaacgaagaataggttagagtatatttttgtgggctagagtaggaagagatgcataatactttagctcttattacattggtgatatctagtccatttttatccacctaaatgcaaggagaggagagctggaaatgaagtccttggtgagaagctgctttctagagaatattttatgctatggaaggtggagcacaaattttggtgaacagtgaaaatgtaataggttctctcatgaggggtggcagtagggggacttccaggcatgaggcagctggaagtgtatccccgcttgggtcaactcttcacaaaaagtagtttttgcacagtcattaattttcaacatagatatctaaagtataatgttccttgtaatatatcaggtaatacatcagatatggacaaagaagaaattcaagataaggatattctatgaaagtaaattagtttctgtgtctcaatgcaattaaaaagaaagtagtcgatctaaatattgacatgtgcaatggttatttgaaattactacacatttgtttggggagaatatgtttttaaatgtaaatcatgagtaagcatattccattgattataataatgatgacttatagtgtatagctcattttacttttgcacatgttttctattacagttaatcctcacaataatcctacgagataggcagggtagataaggatatgatcctagcatgaaagacaagactcaagatccagtagttagtggtggaacttggaagaaagcccagaatttctgactccaggctccatactttccacttctgaaacccttcaaaaatttaactttacttttttgaagggtgggggaatgatggggagggtgaaaggttgggaaaaaaaacaagattgacttatgtctgcttctctaactagtgagaatttttactttttgtgtcttgcatgttgaatgaatgttttagaccatatttcacatatattttgaaggtcaactttaatcataggaataggtttataagaagggaaattttctaaaatttggtttagaggcttgaatttgaaatttggggctaatttaaaatctttgacttttattcattatcttatatttgtatataaaccgtataagttcatatagtgagcagtctgcatgttttctgtttttatttttattttcctttagctaatatattccaataatttgtaagagattcaaatggaatccttagcattttaacaattgtgcattccagcaattgtggtgcattacaaatgaaaggattttaggatgaaaaggcggggggaggtttagggtggctgttaatgctatgacttctaagtctccatgctctcttagtggtcatgtggttggctcattatttgagcagcatcgctttgcggtttgacaaggctacgcagcagcagccactgttagccgatggtcttgcaggtatgtggatctagctcctacccgtggtgatgtggagctacagcatgtcactggagagacaccaactgcagaaagctgatacataattgtgtatgagtggaatacaaaatgaaaccatcaaagtgtccttagcaaatagcaaactagatgacagatctcaccaatatgttttgctataatttattgtagttttaaaattttcaggtatttatgaaaataggatgccctctagtggggatcaacagaatcttccaagtagtctaatatttgcttagagttgatgtaaaaagaaggaaagaaagttgttgaaaaaacaaatattttttgaaagttgcttactttttcctggaaatttctctattgctccctgtcaactgatggctggattagtactccctgtgcactgcatttttatttccattacttttcacagaggctcttaaacacagcaggcagagtgttctctctcagcttccaagttctatgtttttagcctaagtgaacgtaaacaatcccttggccacttctttctaaattaattaattaattaattataacctatcttgaaacacctttgaggtagatatctatctttgtcactaacaatttaaagtatttaaaacataggaatgaatgctttgcaaggaggattgttgtaggcaatgcttaccttaccttatgcatcttaccttcccttacctcccaagcttctttttacaaagcatttcttcctagcaagagaggcttgggaggtaagggaagatatagatagatagatacatacatacatagatagatacatagatagatatagatatagatatgccatggctgttttattacttttcacttacattaaaatactatattctttacattgaaagacagtttaaggtattagaattaaatctcttgtaatttgtgaacagcattccatccacgccagaggttctcaaacattaacacagttcagaatcacctggcagactttttaaaattcatttgttgggccccactaccagtctcggattcaatagatctaggatggggcctggtaagttgcatttgtaacaagttcctagatgattctgatgcattggtcaagaacctgcattttgagaactacggtctacgctaaaccaatctttccatcagtcaatttttctctgttaattgttggaaagtaaggagaaatgctcaggtcagaagcctggaaactctgaactgctaaggcttaaacggaatttattctcttttaactttgtgttttattaacagtattttcttatgcatatttatagcatgttacttggtctttggaggatggtagctgattttactttgaatgtacttgcacaatttacatcaatttatcagactgatacaagaagaagttaaaagaatctcaagtattctcacttgttttcttagaaaagggtagagatggactgttttcataactgttttttaaaacatactgtgtggtattaatatttagattttagctaatattgtcaccagcattattagacttcacagactgttaagatgaattccccatggagctctctgttagtactagatgttgcagcagtcaaataaaggagacttttctccatattttgagatggacataagatgtaacagaaataaggtagaaggctggagttaagaaaggctcataaataaaacatttccttttgtacgagctgagagtataaatcttgagacagaaagtatgggttctatgtagcacttactgttgccaccttgggaaaatacttcacttctctgttttagaatcttcatctttaaaaacggaatagtggtaccttcctcttagggagctttaaggattgaatgagttaaactatttaaagtatttaaaatagtgcttactctcaacactgttattagtagacactacatcttggagaaagaatgttatgtagccctttcttgtcatactgctggtagcagtggaaatgcaattaaagtgaaataaaatttaagttaccaccagattgtgccttataattataatagccaactcctttttcaaaaatgtatatcatatcattttttgtagaagaaaagatcattagtcaggccccatgcatttaagaccgggtagctggttcttcattatgtattttatttctgccagagtgtttgattgactgtctgtattgaccatgaggttgcccagtatgactgcatcactaaaggttagagaaggaaaatgctggaagtgcacggtgactcatacctgtaatcccagcactttgggaggctgaggtgagcatattgcctgaagtctggagttcgagaccagtctggccaacatggtgaaaccccatctctactaaaaatacacaaaaattagccagacgtggtggtgtgcgcctgtaatcccagctactcgggagactgaggggagggaattgcttgaatcagggaggtagaggttgtagtgagccgagactgcgccactgcactccagcttgggtgacagggctaggctccgcctcaaaaaaaaaaaaaaaaaaaaagagagagagggaaggaaaatgctgactcagtttccaaagtattcagtacatttggaacagcaagaaagattagagaacaacacatatggctttaaatgaatgccgaggggttctcacaatgatgatctggacacgaactaggtagctagaatgccaaaggataagggagatggaggaaagatgaggcagtcatcattgcagagaacccctactaggatttcaaaattgtctgacctgttcccgaccccctccctcccttcctcattaacgaaaaacttatgtgccttatccttgttggtactgcccatggtgccaagcacagtactgctcaataaatgttggcaggtttgatttgactatgaatgacatggtttgtgttatggcctcagcttttttctctattaaaaaactgcatgtaaagaaaaatcagaacatactgtagttagcatagtaaatcctaccctttcttttcctatcaacttacctgtatttctgttcatctaaaaatttcctatttccaatctaataatagagatatgtaactagattctaagctagtgaattgtggctacaattttaaacagataaatgcagttgcaaatgaaaatattaatgtaatttcagctctgataaaatctgaaattgagttaaagggtgcacttgatatctgcataacaaagtgtcactgggatgggtaggggtaggtgccagagagttcaggaggtcaatgttgattatttgtccatctggctttatggtcaaaagaagtacagtagcctgctgtggtgaattctctgtttgggtaggaaataactctcagagtacttgaaaagttaaatgctgtaataatgatatttatgcatatcaatgtagtttattcattttgtctgaagacagctaatctcttcatatgaaatatatcattagtaatatgttagatataccaggattttaatatattaattaaggacttgtattctttgcaactaaaatcaaaccgttttaaaaaataattaggagatatgtatattttcttaaaacctaaaaaccaatttttagagttccatttttagagttccattccattagcctgtcaaagccaccacattgcatagctctggctgcgtcacggacagggacatgtcattgaccctataagctataagccagtctttattgagtgtctactaagtgggagacaccagtatctagctaatccaaaccagaaatttgaatttatccaccttgagtcaaatctgtttcactttcaagtcttgctgattctactccgtaaatacggcttttctatatccccacacctttggttttctgtatccctacctcatcatctttcgctcagactctttttataaccttatttttatttatttatttacttatttatttttattttcttttaagatggagtcttttaagatggtgcagcagcatgatctcggctcattgcaacctctgcctccctggttcaagcgattctcctgctgcagcctcccaagtagctgagattacaggcacccgccaccacggccagctattttttttttttttttttttttgtatttttagtagcaatgaggtttcaccattttggccaggctggtcttgaactcctgacctcaagttatatgcctgcctcggcctcccaaagtgctgggattacaggcatgagccaccatgcctggtctataaactttatttttaaatgaatgattttcattgttattagactattaaaataaaataacatgtaaagttctacaggtaaacaaacaagagcagtcctatccctagctcctctccaacaaaaagaatgaatttctacccatttagcaatttcttatggtgattatttttgtatttccaagtaatatgctttaatatcctactttatgaaatttagagactattgactttttgggatggtatataaggactttgcttctttataacccccttcttctctgcactacccccaatatacttacactataattttcagtgaaatctatattgttttcattgttcccatgtaaatattattcactaccagactaatactagcctaggattaaagtctctttcttaaacagagtttgttgttttttttctatagagctaataattgcctcacttttttattgtataatttatgttgactttatggctacatttaccttttttttttaacagtttccaacagatctgtaaaatccatccgtatacaattttccttataatccaattctcacacagtgcatcagatttattatttccctagtgttaacaattctagaatcatttctctttgttccaatgtaaaatgattgctctctagatctgttacatagcagttacactgaactttccttatcatcagctgaaaatgtctttgcctctctcttacatttggtcacctgtttgttggattccattattttcacttctgatagcctccttacaagggatgtatgaaaatatttttttctcttagaatgtttttgtataatatatccttattttattatcccaactgttggaaagtttgtctaggcatagaatttgagattgaaaatcaatttcctccagaatttcataggaatttctctgtatcttctagttgcaatgtcactgtagagacttgtgatgtcattataatttctgatcctttgaaggtaacttgaacttttaaaatttgtttctttgtgccccaccctcctgaagcttttagaatattctttttatccctgatattgttatcaatttttatcttcttaatagtgatgaacactttgaaaattctttcctataatttttttcctatcttattttttggaactagtatttttttgacacttgacttactgaatcctctaatatgactatatttttctattattgctcatctttttcaattttgatctcccttccaataaaccttctcaatttatccttccagcctttcagctttaaaaagtcaatcatatttttaatttacaaaacttctacttaatccctagatcttcaaatatatgtgtgtgtatttgtgtgtgtgtgggtgtaagtgtgcatgtgtgcatatgtgtgtatgtatcattcattttcttctgcatccgctgaggaatgcaacttctcatttctagggtattaattttaatttccctgaagttctcttatgcttcagctttgtctgtattttattctggcttctttttatctgtctattttggtatctccattttatttcagagaattttatcaaacccctggtaaacctcaattctctgtatcaagcatgagacaataaaaatctacttggaagcggccaggtgcggtggctcactcctgtaatcccagcactttgggaggcccaggcaggcggatcacaaggtcaggagatcgagaccatcctggctaacacgatgaaaccctatctctactaaaaaatacaaaaaattagccgggtgtggtggcgggtgtctgtagtcccagctactcgggaggctgaggccggagaatggcgtgaacccgggaggaggagcttgcagtgagccgagatcgcgccactgcacgccagcctgggtgacagagcaagactccatctcaaataataataataatctacttggaagctatttgtgcgtgtgtgtttgtgtgtgtgtgtgtgtgtgatgcacatagttgttaatgtcttttgtgattcattataggccatcctataatgatggccagctcattgattcactgggtaccatgagtgtcagtatctgttgatcttagggatgatcattgttgtcaaagacagattttttaaatctgactggagtgagggtggaggatatgaaatcctatattcctgaaggagagggtgccagggaagcaaaaatcagttgctggggtctcaacataagtatatataattttacttaatccttttgttttcatttccatgcctttaccttttgtcttcctgataaccctaagtccggattttccctaaagtatgtcctggcttttgatgggagaatggataggccggcaacaatataactcttgaatttggttcatcctaccttccatttgatctgatgctcatactttctgagccattctgggggtctgtgggaaaatctgtttgcattactctgtctccctctgcaggcttctgtgggtccatcttcctttactactctgctacatgtgtatcattctttcatctgccttccacactcatatattgtgttcatggaagatagaatttgagttaagattttttgttcttgctgtcctgtgggcaatttcttagtaaatacagggcagaaaactattttatcatctagaatacagaagtcttgtaagtaatctgtctttactttcttgactctaaacttgactctaaactccatagctgcactcaagttcaagtttagtaacaggagcatggctgtcattttcatgttccctacatgaaaataaactttcacctaaaaatcttaataaagccttcttagcttcagatattattgctttttgcccaacccttacctgattcctggcctcttcctttagtgtttccatgtgccccttccccatgttctggccaaatagaactatacaaaattctctgaaatcatgaggctatttcatagctctgttcctctgtagatgtaattatttatgcatattctgcatggaatatgctttccccttccttctgattgtcaaatctcatccttttatgtgtcatttctcaatcatcattcttctgtaaccttcatagttatgttttactctttttgctatttttatttaaactaattttctcttaaaaatggaataaattgacttcataagggacattttttttgaagttaagtgggagctattttgtgatttttactaacacgttaaattacttgatcagatttgcattttaaagcaatcactatctgtagtgtatagaatagtataatgcttagcctgcctgcactcagaaagtgtttatatgactgttagagtgattgggtgagagatgatgagaagcgacccagggcaatgatagtagcaatggaggagtggaagggtgaagagatgttagggagataaaattaacagcactaggtcagagattgaaagagaatgacagaaaaaaagtaaaaggaaattatcagacttcaatttatgtttactttataatttacttgccttcatagaccatccaccgatcttatggggtagtcaactcattaatattcacttttaaatcaaactccaaagttgagatttttgaaaaacttcatacagtgtgagctttcattttaatgtgaatattgaggtgaactatctgtacagactgaggtgaactagctagatggtgaatgtattacatatattgtgacaatatgatgttacccaaaacttttaatggattcgtttcataattataccacatgagctattgagatttctagaaggcctacaagagtcatgagattggactcattcacagatcttttggtcatatcagttctgtaacaacaactgcagatccagtctgtgatcaacttttcaaaacatctaaaaatagtatgtattgtgtcttaatcccacactgtgattttgcaaccttctttgtccaatgttgcctaccatttttgaatttttgagtcttaaaactgtggtgtacaaaattatatctttgaaaaaatatataacttcaccttttaagcctctttctctgtatagtaggagaaaatgtatttatctcagttcaaagtaacataatcactttcagtttaaaactcagtgtttgagggccaggctcattcagttccagattcttccttttctttctgcagtgatgggctggggagggttgttgattgtggttccttattatcatggcaccaggggtgacacagcttgttcattgccattgctacccaccaaggctgctgtctgatgagtgcccgaaggtaggattcctgtcatacataacttgacttattttaacctatcctcacatcttctgtgccctttttgcttttctgtgccagctctatacatccttcctgtcctgatttcaagtgctctctaggatcacttctttcttccagaaaattccatatggctcttgggaaattataaaaaaaaagtatgctttcctatactgttgtggtcaatgttgtcctttgtgattccattctcaggtccaaatgctactttgaaactcagtccagagaggtaacctcttaaatctgttctagggctccttttccttccaattctcttccctatactagtttttctttttgtgggaaaaacacttacttcactgatcacctttccctaaggtatgatttctggttgcactttatatgcttagtcttttgctgctttttaagatgtagaagtccagttattatcatagaaacccttggtcttcaacacaattcctgttatgtcttagaagaacccatttaactttacaaagccagtaatttgaacataccagggagcagtgcttatagaaatgtaatgctactgcttgaatgttgaaggaaaacaataatgttttaaataagtacagggttaaaattagctcagctaatatttttaaatcctctgattatattcataatatcttctaatcaggttacagattagtgtgtttttattcaaacagacttttaacttcaatgaagaggcagtctttcccctatcacttctccctacttcttcgattatttaggattccttaaaaataagttactttatcccattgaaacacatatacctctatgtagtgtatggaataacaaaaatagttataatcatttttatataactgagtggtaggttacttataaaatactaaccaaatgctaaaataaataatttttaaaaatgtaggagcagcttgctgtgacagacaaagatagtatgtaatactgtcagtagtaaaaaaaaatcacaaatgtttaggacttcaaggaaaatcagagtagatctttttctgatgttgtttcttcatagcaggttcacttctcaaaagaaatatggtatcatatatgttgccttctatttcatcctcatatttatagtgaataatgagcactgtaagagaaatatcatagaggcaaatgatgaagctacaaggtcattacaacttcctgcaattttccttaattagttaggtaaactatatttggatgaatatatatgatttaagagtttaacaataataatggtttacaatatttctcatggttaatggaaatgtatttcatattaaagcagtgagctactaataacaatatttaacatagtgaaagtccatattccaaagtagaaattcattaaatcctcacaataattccattggttgaggtattagtctgttttcacactgctataaagacatccctgagactgggtaacttgtaaggaaaagaggtttaatagactcacagttctgcaggctccaaaggtagcatggctggggaggcctcaggaaacttacagtcatggtggaaggtgaaggagaagcaagatcatcttacgtggtgggagccagaggaagagagagagccaagggggatgtgctacgcactttcagaaaaaccagatctcatgagaactctatcagaacagcaagggaagaagtctgcccccatgattcagtcacctcccaccaggcccctcctccaatactgggaattacaattcaacatgagatttgggtggggacacagagctaaaccgtatcagtaggttataatattattgccattttacagatgagaatactggggaatttagagaaaagaaatgttcaatcaaagtctgcacaaatattaagtggcagagcagacattccaacaatgtgaattgttcctcaaagaatacatgctattgcataataggccccaaaattcatactgataaatgtaaaatataccatgatacctttgatttttatcacttttaattatggttaatgaatgattatgcatgcaattgtactagaatttctaagtagccctcttgtaaacgcaatctcagtaattcttctgaattccttgagataaaattattagatgggatgatatttatattcatcacgttgaagttcatcaaaacagtcgaagaagactggcttcagatttccagagataaatcgtattggaagctttagccagaacattcatgattaaaatcttcaatgacccttttacaaaaattaccaaacactgaattatgattagtttgatattgttcccaattataccaatttcttcactaaaaaaactataattaattcatagcataagcctgcaaaatacattactgcacattttgtaactcattcagctgaaactaaaatgttaaatactgtgattattatttttgtgataatgaactgagggcaattttggagttcaaatccaatttcaggacctgatttcaccatcctgttgtatttatttaaagatcacattctaatgacagttgacaaggttgtttgtattctctctcatcacggcattacagtacatttattgatgagttttaaatacatttttataccatgtgtcctttgctcgaagtctccttaaagacacaactcatttttccacctttgtattcaacttacacatatacaattttgaaagagagaagtatgtttgtatataatattttaaaatatatttacatgttactttgtaatttttgaaatatttcaccatctagattataatatccttttggaaggcactggttttccctctcttgtcatttccttggagggtctcaagtatcttttaagtatggaagacacagctgtttattagaaggaacaaataaagtgtactacaattatttttaaatttgcattaaatttctttatatagccattgctctcactgattgcagctgaagttagaaatacggcctgagcaaagtttcagatattagagatgctggacatatcaaagcccttaagcttgggattcctctggaagaaattctggatcaaacaaaaaatgatttgtgagctaaaacacaggtattaccaacaaggtatcttgaagccaactagctggcctcccatttgttttctcacctaagtcccaggatgaatttggataaaggctaaggaactgttgacatgcatttggagaatgaaagtattcttattttcactttccattcatatcattttgttttttatttaaacaaatgtttttgtataattaatgttatcataaaacaaaaccaacgaaatacagtttgatggaagtggtgccacaatagagacattacaggtctgaatgagaatatgacagccttaatctgttatttagatttccctgagttcagatggcagacagattcacaacacctgtgaagtggaaggcaggcagaattagtgataggagtagtgtcagaagcaattactacaatttctttagtcttctgatgccagccttctcaattttcttaacatttgtgaaattataactttaacaagtatttgttggaaagctatcacagcaaaataaaactagatgccatgtgatgataataatagcaagcatgttttttcatgactagctttgtgacagatgctttacaagtgctatcttatttagtcctggcacaatcctataatgtaagtattatttttctccttgttttacaacaagacttttttttacaagaggaatctgaaggttaagtaacttgtccagggttccactggtagtaagtggtctcaagtcagatctgtctgactccagaactcattctcctcacccttgtgaatcctttttcaacccatggccccagtctttgcctatggacagatcggcacaactcaagtctgacttaacctgaagtttctactagaaggccaaaacaattctatcatttaaatgaagtgttaagaaggggagtgtgctcaatgttttaaattctaaacagtataaaatccttccaaaaaatgtatgatcatacaaatataatcaaatcttaactgagaaaaattattaccaaataaaagcatccacctaaaaatcatgtatttgtgtgctaattcaggagacagttatgcaagtaatttttcttacccttcaatatcttcaacatagagatcatggatattaataaaaggagatgcaattttgctctcacatatatttttcttatgcaatgggatgcttccagttgtttacatctttcaagaaacttaatcaccaccagatatgtactagtcttatgatgccagtaggactactttgtattttctaatagaaaggaacactttttcttctgtgttgtaatcttgtgatatttagacccaagattcattcaaaacacttagcagccccatttctaggtttttgacatataacaatactagcatatgagttcaggaaggtacatatgtcaggctgtctcttgcaactttagatataatagaaacacatttaaacaagtcaaatatctatcaactgggggattgatatatataatgcaatattaaaaatagatgaacatacatgaaatggctcttagaaaagctgttaaaatattgttacttataaatttgaaactgcaaaataatatgtaaaatttgagccaaatttggtttaaaatgtgatctcgtgtgtgtgtgtgtgtgtgtgtgtgtgtgtgttctgtggcatggtgtgaagtgcggtgtagatacatcaattctggaactcttcataccaaattattcaaaaatggacagggttgaaagttgtggggagactttcattttttagtttctatacttctggtttattattattacttttttaaatgtgaatttgctttgttagaaatgtttaaaaagtttttaacatgcttggcatttagtgttcataactataaaatgcaacttaccttttcagcctaattttccctaattttagacattctgcctcaattacagtttttactgctgtgtcctagatttctttgcctgtcggcttttctatatgttatacccactgcaaggaaggtccttctcctcacttctcaggcctaggttctatgttatttccagttctaattccagtgcttctaacaataattttaacaagcgtatttcttactttctttcttctattctcatttcaaatattttgtttttctgttacaccacatcatagagtgccttgtaataaatccactaatatatgcatatgtaccacccataaagctgaaatcttcatgcttatttttcccttacaattagtaagtattctattcaattgaaaaaattaacaatgttttatttttgtgaaatttttgtagagtttcagcttttctgtatatcatgatctgctgttgaagagacacctctattttatgtcaaattgtcaattttgtgccttataatccacttctgaattctacattgtaatttctgtgtaataactccatttgctgcctctattctctcatataaacacatttcaagaggcttaaatggaagacgacaatccaaatcaaatttcttagacaggaaggtatttgtaattatctcataaaatgatgccaaaatcttgtcacatacagtatctcacatgacaaattcaatagtgttctcagagaaacacaattttttatagtaatgtttctatgtaaatcagtccaggtgggtttcttttacatgaacaagcaagattgttttcaaaatgatagaaacaataaagagagagaaaacccaaactgatttgcaatgggagtttcctcagtagtcatcccagagggaagttttgctttgtcacaagtgactagcccttaattttgagagtgaatcatcccctttgaaatgagagataagttggggaaagagctgtttaaaaattactttacaactatttcctttagagctatgacttcttaaactggaatgtgatccagaatagcttccctttgaatccaacatttgtcttcagcattttattgtctctgttttccctcaccccatctcactttttccttctctctgttcaacagatttacactgactgggccaaccactacctagcaaaatcaggccacaagcggctgatcaaggacttgcaacaagacattgcagatggagtactcctagcagaaatcatccagattattggtaagcccttccttctgaaagaaagcatgaaagtctctgctcccatctctttggtaaagcacaacttaagttaagcgccttactgaactggtccatgtgtctctgagattcatgtagctctcccctgatttaattaaaatgtttatatgaggatgtttgaaaaaggcagtttggccatacttttaaataactagaactgtatctttatatacataaacttgctaacctttattgaatcatttgaatcgaactgtcagaaatgaatgcttcattaaaccatatgtctcccatgtgtgtatttcgttagctggagcaactcatacactctgagatgccttgaaactgtatcctgatccagcagggacaattgtgaaaggtttcatgtcagcaatcatttggcacaggctaaagaattagcagcaacttccttctcactcatttttttttttgcctgatttgtgcatatagaattggcagctgctaataagtgtgtcttcttgtacactgcttggaagacagaatatatgtagcaggagcatttttgcttggtattttttttttcctgttttcgtgtgtgtgtttcacttcattgcttaagcatgtcgttctttttttctctcttttattttatctcttggctttagcaaatgaaaaagttgaagatatcaatggatgtcctagaagtcagtctcagatggtaagaatcatatttattctcaatatataatgctgatcttcacttccagaattaattgcatttgtaaatggatattattttttttctgcatgtcttcctgcttaagaaaccatttgatcccattctctcatatgtatttgtgtgggttcaatttaggcacatcaacatcattaagtgactcctatatacacatgacatatttccagatgtcttattagatccttgacttttttttgttctgctgttctgtataatttaacactggtcttaatggtagtaaatttcatttctacttttaagtggattatttttgtctgaacaactggcttaaagaacaggctttgccatgggcattttaaaatatataaatagtattttctttgttcataacaaagtccagtgtaaacacatggactcttcaacacttctggaaatagttctcaaggcatgctgctgtcagtttggtgagcagtgactgattttgagatatgattcgtagtctcttccagaaagccttcagcctggatatctgcctctttcccagctatctcttatctttatcaaccaataaaaacttcaagttttataataaagtcaaagagtaataaactatagagataaaaatatgtttcttaattaaaaagccacaacttagttttataggaaaacctgaaatataaaatgccttaactaaagttacatcaagcagatataatcaggaatgacagccgaaatccacaagatgaagctttctccaaaactcttcagcacagaataggcattttaaatgaatttaatgagttcttagttgtcagaaacttggaagaataaaaaaatctatgaacttttaaaatatactgacctactttacttaatgtcagaaaactgaaatccaaaataataaacataatttatttctaaaagtgattaactatcatgtatatttttaaaataattggccagatgtggtggctcacacctgtaatcccagcactttgggatgccaaggcgggtggatgacctgaggtcgggagttcgagaccagcctgaccaacatggagaaatcctgtctctactaaaattacaaaattagccaggtgtggtggcgcatgcctataatcccagctactcgggaggctgaggcaggagaatcgcttgaaccagggaggcggaggttatggtgagcgaggattgtgccattgcactccggcctgggcaatacgagcaaaactctgtctcgaaaaaataaataaataaataaataataaaatcaaataataaaataaataaataaaaaataattactcccaggacctattatgatgtcatgaactctgtgtatatggttgtgaaaaaaatcactgtaaaagaaaggatttctatacaatccttcagttttaaggaaacttcctgatctaattactctaagtgactctgtgggaattaattacagttgttttctgaggttttactgtgaacaagccaaatcagaagacatttagaccttgatacagtaataagctgtgtgatgttgagaaaaatatgtaacttctttgagccttagctttctcatctgtaaaatgaaccttaattagaatgtgacaatgagatatgtatgtgaacatcctttattaacacaactaaaatgcaatgcagaatagtattgctacaaactttgtaaaggacacatgcgtggattaacacctgttaaaagatttttaaggctttcagttaaaaagctcaacagtcccctgaaaccataattatgtttcttaaacccaacatggttgcttttgctttcattatttttaccatgaggaggtgttgaataatataaaacattttaagtctagaaactcttacctacttggctatcattccaatttgattctgggattacagagaattcaataaacaggcaagcttatactcagtgatggaaaaacaattccaaagctcataacaatggttaatagagatgctgtttttacctatttatctgaaacagctgttcctagagattctacaaatctgtgaagagtctcttgagtttcagactctgttaatttttttattacttcttattcctgttaactgcaaaatatcatgttacagatattatgcaagttatgttgatatttccacttctgattaaaacaaaatagaaagaccacagtctaagaaatgcaaatgctataaaaaaggtagtttattcagccaaaaagcattagttggaatcatatcgaatattgactaagaatgacttagatcctcatttctttaagatgtggttgaattttgaatctgaagttggcatgccttcaatttcttgattcagaaaaatacatatgaaataaatgtaacttttttggctgaattatttttgcctctgttcttaagaatttgtgtaagcactattagtgaataaaaattccagactttaattgagacaagaatgaaaaggaaagataattatgatagcatgactaggcttatgaatttcatgtatctactccaaacaggatgttgcctgttccttgattgcataacactgggaggtgctacattagtaagagtgagtggtatacttgctcataggactactttggccacctctttttgtatacctggtctcttgtggcctttggttgctgttggtgcttaataacaaaagataaagtaaaattaggtctgctgctatttttaatcacgaattgtttttatttaaatgttaaacttgctaccctttattgaatcattttaagcctttaagaatagaagatcccttttgttgtatgaatctacaatgtattgataaatttccatagtagccaggtaattcacatgtaatcaatatttactaagcactgagtacaaagtataataacatttggatgaactacacttgagaattggaggagcaaatgtttagataaataacagcaacagttacataggcgagaacaaaaacgactgagaatggagtaagtttggtgcattccacaaacaaatagaagagcaccgtggattaggcacaaggagagttgtttgaagggaacaaggaagcctgatagtgtagggccaaagtaaggagttggtatggtattctaactcaggaagactttggaagatgtttaaagctgggctgtggtatgatccaatataaatactttaaaagatcaccctagatgctttatggggattataaagtaagtaagtgttggtgtccagttgaatgtgggtgacggagagtacagggagcttaaaatggccccaattttttagcctgaatgggtaagtaattaccattaaacaagattattattatagaagcagaaaaaaatttcttaaaaaggtggagggaggaaggtgatgaattcatattttaacatgtggaacttgatgtatctattaaaacatcaatttggaggaaacttaaggctattagacatgtgtttctgaaggtcagaaaagagtattggttagaatatactgaaaaaataggtaatatttgaaaccatggacaagaatggaatcttacaggaggtctgcatgaagtcacaggagaagaaacctgaggtttttcactctaggaaatataaatatttatgtgatagaggtataggagtcaggaaagggaaagagtgttgagagagtgagactattgttgaggaacagaatcacagatgtggactgctaatccttagggaagatgcagtagctgaagctctaatacgtggactaccccagcaagtcagggcaaagtaagatgagcagaatgtgtaacatgctgtcaaatgttatgcagctaaatagctggtatactggaatgtggtatttctttttggtaattggataggcattgattacctgtatgtgaacatattctgtagagtgaataacgtgttaaaaagtaactcagaagtgccaatatccattgagtcatgaataatttttctaagagtgtcctgttaagacactgttagagaaaaaaaaaaaataaatagcttgagaagaagacagagttgaggggagtttttgcaaggggggaagaaagcatagaaggaggaagcagtagagggaaaggaaagggttcagaggaatgaagtggtaagtaactataccaagtcctaaaggaagtagaagaggaggaaattttggtctgtgtggaagatttgatattggaaaacaatagggatacatttgtttctgtatcatgtcataaaaggttatgatggggtgaagatacggatacttgaaaaaagtatgtatgtaacatatttgtataaacacaaatctctacatagcagctaccactgaaaggattatggccggaacagggaagaaacacataaatagaggcaagttatttgaaggattctagttctgtagggtataatgtactatattattctgcttttacaacttacataagtgttacatgtattattttatgtacatcaaatatactaaataatttcaaagtagaaaagaaagtatattaaatagaaactagaggaatttaaattaatataacaacttcagaattttagataatattaatgtgcttgcttttcatgtgattttctaatggtttaatggttactttatttattattattattattttttgagacgaagtctcgctgtgtcgcccaagctggagtaaaatggtgtgatcgtggctcactgcaacctccacctcccgagttcaagcaattctccctgcctcagcctcctgagtagctgggattacaggtgcccaccaccacacctggctaatattttttaatttttttaatttttagtagagacgggttttgccatgttggccaggctggttttgaactcctgacctcaggtgatccacccatctcggcctcccaaagtactgggattacaggcatgagccaccatgcctggccatggataccttataataaagaaaaattcaccatatatatatatgtatatatatatatatatattgtgtaaatatacacatatatgtacatatatacatatatatataatgatagcactatgactcaaaggagtggaatattgctatatacatacacatatatgtgtaaatatatgtgcgtatgtgtgtgtgtgtgtgtgtgcgcgtgcaccttataaagaaaatttaactctctatataatatgtgtatgtgtgtggatatatataatacatgtatatataatcccaacaacaattcttttgaatagcatagtccaaagagcacatatttaagaaaaatatgaatttgtccttttagcactttattaatataattactgagatattgtggttcatatttatcttaagtttcaaagtcatggttatttttctttgatgagcttgagactaaactggtcctggaaaacagaacttagtttgttggagcttagtcaacactaaatttaaccttatccaaagatgaagttactaatgtggatggcacctgttgagtaattcctaggtgggcggcatcaggattcaaaatatatactgcatgtcccaactttggtgagcttacatgaggaaataaattagtaaactataaataccaggaatgtcccaaatgcccagcaaattaaaaatagcaaaaatatgtccaacatttacttagaatgcagagacacaagtgcaagtttcttagacaaaaatgttagacatgtagggtaaaagttgtttcaatgacatttaaaacattttttaaatagaccattatatttaaggatcttcaaaaatgcacagaagaatgaggacatctgattatgtgaaatagttacaaaccaagtattaggctatgtaagacagctaaggatctggcaaatgtatttcacagcttgtccttcctctttcttggctctgttttgtcgtaataattcaattgttttccagccacaaccttcaacctaaggttttagtataacatgtatgttgtttacaatttgctgatatgaatatttttggcttcttattcctttttaaatcctagtagctggaaaattagatttaggtctttactgcctatctgattccatgtccgatagggttatggctcccagaatcattactgttatggaattcacatctttatcccatttgggatagaaatttcttgatcctatttctattgcttatatttatctggaaagtgaaactattcttaatagtaaaaaaaaagcccatgcttttatcagtagcctgtcctttaaagttttatttttttcagctactgcttgtaatcactcttcttttaaaggatttttttttttttttaggtaagatgagaagatgaggttcttaaccaaatagggaagagataaaatactggaatgctcttaaaggtttaataaaatcttatatatggcatactgcaaaattgtagcactatgactcagaggagtggaatattgctaagttagtccagtcacatgatcccttgactttgaaaatattcatcttctggaatggctagaaaaagatagcttaatgaagacaaatgctttattacaagtagagttctgatctataaagaaatactaaatgaaaatctttactttgtatttttcttaatgatttcattatttttatacaaacttcgcaaaaatatgtataaactactagtatcagggaatttatatgtaagttattagaatatcacctaaatgatttttaaatctgcctgtctctagaggttgctccacacactagtcaagttcaaatgaagtaattgacataacatggaggcattaagaggcagtgtgttttgttaaaagaacaaaggtgactggaattccaattttgtatgtatgacccaggaaaaggcattcagtaaattctcaaggcctctgctcatttctgcaatgaggaaattggacagataaactctaaagtcaattggaactctgatttgctaccttgattaaaaaaaatgccaaagatgatgatttctcttcagttttagtaagtctaatttacaaagaaaaacagcaacatgaaatcatttcgttgtgggaattctttggtctgccatttagaaattaaataaaagttaaaaatacaagaatgccttgttgcattaactttatattatagaatgaatagcttaaatgttgttcttattgttgtcaatatttatacttgtttgtgtaattaatatgataaatagaaattggaataaagtaacggtttgaattacagattttttctttgcttttgaagagaagaaataatttttaaggacattaaatttatatatgcatatataactattgcaaaatgtagttgatatttctactatatctttgaatattgaccactttaataaataattggcatatttttatcctgattttttttgtacttaaaatgctacaaattgttttttattggtagcccagtattactgtaaacacaaaatacaatcattgtatttgaagacatatttcgtaagaatccttttataattttagctttttatatttaatagttggtgtttttaaggaacttattgctccttctttttcaattgcccccccaccactgccaaacttaataaaattatcacttacaataatcagtggaaaaatattaacagtaggataattttaacaatcttagtttaggaaacaaaatattaagatatttggccattttcaatatgaattgtaatactcctatctgaaaaaaatctgtgatagtttatatatttaaattttttcaataataagaaaaaagagtaaataaaatagggaaactcttgttcacttaacctctgtgtaatcatatgcaaaatttatctttgatcagataagtattttgaaatgtagtagatatgccaaagctagttgcttcatgaaattatatttaaattattttaatatgaattcagttaaaaactgaattgtgtggatagacacagaaaatatattgacattccttgttacactctgaaaaatcgtatttcacacctgccttctattagccatgtttcaaacataacaagaaatactgggaaatcattacataaaaacatacaaatttagagaaagatctgatagttcaatgatgtaattatcacttatttattgaacatcaatggtatatacctagtgctgtgctaggtgttttgcttatgcttttcatttagccatcacggcaaacctataatggaactgcgtctcattgaggcgatctgtgtcctttatttagtaaagtggaaaaattatggtttggactcatgtttatttagtctaggccaaattatctttagacttattaacaaataaatttaacaaaataaggtctggaattcaggtctttggatcttccgctatttttttccttctcctcctcctccacttcctccccctctttatttttttaaaaactactttttttatagcaaatttaagttcacagcaaaattgggagaaaagtacagatttcctatctacccctttccctcacacatgcatagcctcccccaatatcatcatcacccaacagagtagtatatttgttataattaataaacatatattgaaacatcagtatcacccagaatccatgattcatattaaagtttactcttggtattgtacattagacaaatatataatgacctgtgttaccattatagtattatacagagaagttttactgccctacacatcctctgtgctccaacccctgggaaccagtgattgttttactgtccctgtggttttgccttttctagaatgttatattgttggagtcatacagcatgtagacttttcaggttggcttctttcacttagtaatatggatttaagtttcttacatgtcttttcatggcttgatggctcatttcttttaagtgctgaatagcattccattgtctgaatgtaccacagtttatccattcagctactgatgaacatcttagttgcttccaagttttggcagttatgaagaaaactgctatacatttccatgggtagattcttgtgtgaacttaagttttcaactcctttgggtaaatactaataagtgtgattgatggatcatatgacatttgtttagttttataagaaaccaccaaactgtcttccaaagtgttttattttgcattcccaccagaaatgagtgagagttcctgctgcttcacatcctcactagcatttggtgttgtcaatgttctggattttggccgtcctaatagatttgtagtggcatttcattgtaactataatttgaattcccctgatgacatatgatgtggaaatatgcatcttttcatatgcttatatgtcttcagtatatctgttttggtgaggtatctgttaaggtctttgaccccagttttaaaaaccagattcaatgccatccccatcaagctaccaatgactttcttcacagaattggaaataactactttaaagttcatatggaaccaaaaaagggcctgcattgccaagacaatcctaagccaaaagaacaaagctggaggcatcacactacctgactacaagctatactacaaggctacagtaaccaaaacagcatggtactggtacaaaaacagagatatagaccaatggaacagaacagagccctcagaaataataccacacatctacaaccatgtgatctttgacaaacctgacaaaaacaagaaatggggaaaggattgcctatttaataaatagtgctgggaaaactggctagccatatgtagaaagctgaaactggatccctttcttacaccttatacaaaaattaattcaagatggattaaagactgacatgttagacctaaaactgtaaaaaccctagaagaaaacctaggcaataccattcaggacataggcatggacaaggacttcatgtcgaaaacaccaaaagcaatggcaacaaaagccaaaattggcaagtgggatctaattaaactaaagagcttctgcacagcaaaagaaatctaccatcagagtgaacaggcaacctacaaaatgggagaaaagttttgcaatctactcatctgacaaagggctaatatccagaatctacaaagaactcaaacaaatttacaagaaaaaaacaaataaccccatcaacaagtgggcgaaggatatgaacagacacttctcaaaagaagatatttatgcagccaacaggcacatgaaaaaatgttcatcgtcactggccatcagagaaatgcaaaccaaaaccgcaatgagataccatctcacaccagttagaatggcgatcattaaaaagtcaggaaacagcagtgctggagaggatgtggagaaatgggaacacttttacactgttggtgggactgtaaactagttcaacaattgtggaagacggtgcggcggttgctcaaggatctggaactagaaataccatttgacccagccatcctgttacttggtatatacccaaaggattataaatcatgctgctataaagacacatgcacacgtatgttcattgcggcactattcacaatagcaaagacttggaaccaacccaaatgtccatcaatgatagactggattaagaaaatgtggcacatatacaccatggaatactatgcagccataaaaaagggtgagttcatgtcctttgtagggacatggatgaagctggaaaccatcattctcagcaaactatctcaaggacaaaaaaccaaattctgcatattctcactcacaggtgggaattgaacatgagaacacttggacacaggaaggagaacatcacacaccagggtctgtcgtggggcagggggagaggggagggatagcatcaggagatacacctcatgtaaatgatgagttaatgggtgcagcacaccaacatggcacatgtatacatatgtaacaaacctgcacgttgtgcacaggtaccctagatcttaaagtataattaaaaaaaaaaaaaaaacaggttgtttgttttcttgttgagttttaagagttctttgtaaacttcggatgatgattgtgtcttctgtaaatatttctgctagtctgtggtttgtcttctcactcttttgacactgctttacagggcagaagtttttaatttttatgaagtccagcttatcaattatttattttatacatcatgtctttagtgttgtgtctatttttatttatatatttgttgcatgtagatgtccagctcgtctcgcactatttgttgaaaagttgatctttgcttcattgtattgcctttgcttcttcaacagatatcaattgactatattagtatgggtctacttctgggctctctattctgttccactgattattttcccattttttcaccaaccccacactgtcttgattactgttttgattacatgacttacttcatgtaggtcataaagctgtgttgtgtcagtcctccaattttgtacttcttcaatattctgttggcaatttaggtcttttgactcttcatataaagtttaaaattagtttgttgatatccacaaaataacttcctggattttgattgagattgctctttctaaaaaaaattatttggctcctctgcttctcccttccctatgcccaaacttgcaatataaataagaattattcttcaatattacacttgtttcttctatctgtggcagggatataaactctcgtgaaactgggagagggagtggtcttgtgaaacaaataatgatttataaattttatggtaaaattatgaatttggcaaataataagttgttatatgtaacttgagctctttatatacatacatgtttttaggtttagaagagtttaataactttataataaaacaataaattcccttgtttggttttgttttctggaacaaacttaaaagcagaaatttattaaaaaacaaaagaatatatcttcaggtcaatgaatactgatgtaatttttaataaattatatttataacacttttgccaattatagcttataatgaagatttaatatcatctataactgatacaaaatattaaacgatgctcataattctccaattatcaagtaaattaaagaagaatagcagggttttgaacaaaatattttatctgattatatcctcgggaactttccatatctatgtctatacagctagtcacagacacacacaactctgttctagcatacatgtgtttatagagcttagctccatattaggaagagtatgtttacatataaataattgaatatacccttctccatttctagtgtggatatatgtgtgtgtatacatacacacacacccacacatgcctagaaacttctcagtttcttacattgtgtaaattgtaataccatgatgcaaatccagtttaactgcaaaatttttaattacaccataggacctaattaataaacgtactccttgtatctaatcacagaccaactaaacaaataaacaaaaaccgaagagcaaaacccaattactgtcccctattcctctccctattttgcaacacaaacacatttgagatgggaaaggaaagcccgcaaggcgttcctttgcaatgacacaggagtaactaattaaactgcacctctcatcctctctgcccccagcactaagactcaacaaatcacagttcgaggaaaaggcctggaattacgcatgctcacaatgatccctgctcagctttgggcttgccaaagttttgatttctactactttactgagtagatccttgtattagtttcctgtggcttctgtaacaaattaccacaaatttggtggcttaaaacaatagaaatttaacttctcacagtactggagggcagaaatctctatcattgggctggaatcaaggtgtcagcagtactgtacgtcttccagaggctgtagggatatccattcctttccttttctagcttatggtggatgccagcattctttcttttgcttgaggccacatcaaccattctgtatgttaatctaccaccatgtaaaatgcattggatatttgagaagtaatatacaagtagttaaacttgtgaacttatgaaatgtgtggaacaagtggatttttgcatacccatttctgtctttacctttacactacacagttttcattcttacattcaaccatatatttattgagcccctactttgtttgtacctggcactatttcctagccatctgccagttgtgtagtaagcctgagtcagaggctgcgaatagcttagtgagaatgtttaaattatagtggtagtaagcataatgaggcagaagagcaagctcattgcagaaagacaggtttaagttttagttctggctctgctcctcattaattgtgtaagcttatataaactatgctatctctctgagcctctactgaataagaaaaataatactgactttactaaaacttacagtgaagatgaaaagagttttgtatatggagtaaatagcatacttgcttatgactctgtgtaaacttccttcctgtgcttggttgttgagtggtggaggagaacatagagaagctccaaatcattttccctgcttccattctttacatgcacagtaggatttttaaaactgcaaattgctcacatagtatcttatgagttagtgtattacaactgaatttaaaaatgaaatatactaaaataggattttttaaaaaattggagtgtatttcagatatgagtaaaaattgatttgtgaaatttttattactatctgttaataaatctatgtatgtactgtgtggtcatttaaatggatgtattcattgcaatactgatcatttcccttttttgattaaagcacacgtttagatctctgatctttaagatcaagcttgacccttaacaaggcatggaggatgttcctcattgagcccttacttatttctgtggccttgtctcctgccactgcctttctccagatttcaggatttgtgctctggagctccttctgcctgatgccttctacccatgttcttcaaactgatttgaaggctactaaccttttgagcagtttcacagtgataaacaatgggaagttgtggagaaagatttaaatgagagtcaattcaacattcctggctattctgatctcttaaagatccctcaacctacgctgtttctcaaccatgcccagttcacatatagctccttcccgcgttcacctcgtaccacatcccctccttcagcaaaaccttcctaacctctcagggactaactcaggcttcccttaaagcagcaaaatgtgggggttaggaacatgggctctgagtgaccttgggcatagcaattcagttctgtgatcaacacttttataataaattggtatagtaatgacaacttcgaaataacatatctttgttactatgttaggtaggtcttagttactaataactttctcctttcctagtctttttggcctctgatcagaaatagacccttctggacagctgcagtggctcacacctataatcccagcactttgagaggccaagcatggtagatcacttgaggtcaggagtccaagaccagcctggccaatatggtgaaaccacatctctactaaaaatacaaaaattaacctagcatggtggtgcacacctgtagtcctagttacccaggaggctgaggcaggaggatcgtttgagcccaggaggtggaggttgtaatgagccaagattgtgctactgcatgccagcctgggcaatgggagtaaaaccctgtctcgaaaaaagaaaagaaaagaaagaaaaaagaaatagacccttctgcattcttttctaggagtctgtgtttctgtgtcataatatttattgcattaaattggaattacctcccttgcctgtaaaactatatactttttagggcttggaaatgtcttgatgaaccaataattgttaaatgaatgaaggaaaacaagcatcctacaaattttaaccaaagcaaaaatattactgtattttactttaactctccagaaaaaatttatgtctagttaaaatcttaggataaattctatgtaattacttgaattcagtgttaggattggcatttgctgaaactaaaacatcttatctattttttaattgaaaatttattaatttaatttatgtaatggcgctagtattacatgtttaatgtgaaaaatgagaagtatagttcatgaaaaatagcacaagtcacaaaagaatctaccttcccgaaatatccaaagttaggattggtttacgtttttctagacattctctatgtatgattggcaacagcaatatctagcactttagccattttctaacttggatgcatttcttatggagagagaaataaatctttgaggtattatacctgctatctggtttatgattatttaactttttacattgtagcagggtttgagtccaatgggcaacacagtgttttaaatccaaggtcaaagtcagctctataagcataactgcagaaggtaaggactggagcgatcacttctcaagcatccttgtgaacagttttccttatagttgctctggttggtatgccctgttcctccttctgatgcttgtctaaccttatataaaatccaacttatttatttatttatttatttatttatttatttgagacagagtctcactctgtcacccaggctggagggcagttgtgtgatctcggctcactgcaacctcctcctcccgggttcaagccgaatctcctgcctcagcctccagagtagctgggattacaggcacatgcgaccacacccagctgatttttgtatttttagtagagacagggtttcaccatgttggccaggctggtctcagactcctgacctcaggtgatctgcccacctcagcctcccaaggtgctgggattacaggcgtgagccaccacacccaggcccaacttagcttttaagtctaaatgacacttttatgaagctttctctgtatctgtagtggaaattaataactccattctcctcgctgctctacagagttgtttataattctctttggaatttatcatgttatgccttgcattatgacaatttataaatcttttctgtctcctcagctattttacaagctcacaaaggcaaagatcttatcattcatttttatatcccttcaccattgagcagagctctttgaccataataaacagtctatagttgctgaatgaattaatcacttagtgttaagtgttgtgccatggtttagatttaatcacaaactataaggaggttattaatcatatcttggtatttagtaccaaactgtaatgttcattaactatccataagtgtaaaaaaatgtgaatagacaagatattactttgttgatattgtgatagattcttccaattacatgtcctgaaacatgttatatttgcagtaaaaaatgctaaaaggctggctgtaataaaacacacagcttaaaatgtatgagttcaataaagagctatgctaattaaaagcactacatttttagaatagtttattcatcactgaaatgaataactatcagtatttttttttttgagacagagtcttgctctgtccccctggctggagtgtagtggggtgatctcggctcgctgcaacctttgcctcgcaggttcaagtgattctcgtgccttagcctccctggagtagctgggattacagaagcctgccaccatgtctggctaatttttgtatttttagtagagacagactttgccatgttggccaggctggtttcgaactccttacctcaggttgtctgcccgccttggcctccctaagtgctgggattacaggcgtgagccacgtgccctgccaatatcagtgtttctaatacacactctatggttgatatgtcaagaacacgtgttaactctcaggtttaacaaaataattgtagttaaaaatacactggtaagtgtcttgagttttcatatgtgaaggtgatgaaaattcttcctcttctcatctgaaacccaatttgtaatttagcaatcagacatgtttatatttagcaagtatgtaagggtcagtataaatatacagctatgaaaatagacaatcagaaaaattctgccttgaaaaatttctgttccatttttcatgtgagtagttgaaataattcagtgctctttagaatatatgaaaatagtggctgtgtctcgaaattgatctctgtagcacagagcacattttcaggcataaaataagtttaataaatgtgtgatgagtgaataaataaatagtgtgtttgatagaacatgaaacaatggtagtgttacaggatgctaatattaagtatataggtagaaactactcaattctaaaaatatggaccaatttctattacatttgtttagtttctataataaagaaaataacagtccatttgaagaattactctaacaaaactgtttttctttagggcattatgataagattaagtattttgatgaaatcccaaaacctcaaggctcaatgtatccatgcatttggatacttctgaaaataatgactagatctagctctcagaaacttttcattttattttcattacacagccaacatttttatagttatcaagccatgcttaaatttaacatgaaaaagagagagaaagtaggtgttccatgccaataaaagataaaccacaagtagaaaagaagggcccaagaaattgtgcttgacattaaattgtgcctgacataataatagcaagtaaatgtcctgaggtgactgtccataagctacagatttgactgttacctgagccaaatgagaaatgtggtgtccgttgaaatcataatgaatttctttgtattactgctataaaggaatacgtgttttaatatcacaggaataacacatgaattatatagtattatggtccaaataagaaaaatataatgtattactctagtgtgaacagtgcaattccagcaacgacatggtattaaactgaaattatctgcagttagtttctttgaagaacatagttggaagttgtaatttacaagttttgctacaaattggaatcacctgcagatttgtaatgtataatgaaactggcttctatctgctgacattctgattaaacttttgagttcgtaaatgtaaattgggctctatgggtttaaaagatcctcggttaattcttaagtgtagtagagtttaagaaatactagattaaaaatttgggaactgagtttactgggatacagataattctcaggaaactctgtgtaataccaaaagtgaaaggggctatgatgtgaaatggcatcatttataccattatagcattgttaccctccattaatattaaaaactgttataataacaaaaggtattttttgttgttgtgagttattgaatccctactatgtacattgtattgtgctaagtgttttacatgtaaaatttaactgactcttctaagtaattatacatattatctgcttttaatttttcttaaattgaaaaaatcagctaaaatgattattatgggccccaccatcatggaatttttttgaaatcatttatttctattaatcccaaaatataatggtaacaaattttccccacacatcatttcaatttttatggactattgatttttctaaatgttaattaaaagctcaaaacttgactaaccccttggcacttccatttctcactcatttgcctgttgtgatcgtgttttggttttctattctcatcaacatcttttctactccagagtagtatattcctccctgacccgacaaaaaaaaaaaaaaaaaaaaaaaaaaaagaccaaaaactaagttttggacatatagcaggccaaatgctattacagattataactgatgctatgtctaaatttattaattcattcagatagtcaacagtaatgcattaagcattgattgtgcctggccatggtgtgaggtcctgggggtaggagggtaaatgtgagaagagagacatcagctcccaccagcagacatgagttcatgtatatcagaggagaggcttaggatgccatagaagtaagtcagctcatcagggtcaatgttcaggagacataattaatttgactactaatattatttccaattagggtttaattatttctcttttttatttgactgcttcaagcatgaaaacactattttattcttgctgtagttcatttgtttcctcagcaattgtttatagatcacctaagtcatacatttagactggggagagagcagtagccaaaattaaaaagaatcaatagggagtatacattctggccagtcatatatatatatatacacacacacacacacacacatatacataaacacatatatatataacacattaaagtatatatcatgatgtatactgtaatatatgtaacacatatgatatagactttaataacacatagcatatattacctataatatataacatatatgtaatgtatgtaatatactattatatatactttaacaatgtttatacatattagcattacatatacgattatattacatatatagtaatatataattaaagtatatgctatatattatatatcatacacatatgtatcatgtatataatatatgcatatatatgatatatacatatgcagtatataaatatacaatacatatatgtaataaaaatgcatacatgtatggtatgtgtaatatacacatatgtatatattacacacatataataatatattgatatttaatatgaacatatcatatattcaatatacatgtgtttaatatattatgtgtatacatgcctatgtcttatgcatgtaatatatgtatatatgtatatgttacatgtatacgcatatatgtatatatgtatatgttacatgtatacgcatatatgtatatatgtatatgttgcatgtatacgcatatatgtatatatgtatatgttacatgtatacgcatatatgtaatataataaatatatactttaataatatattactatatacatatgtctatattacatgcataagacatatttgcaatatataatatatattttaataacaggtattactatatatgtaataatatattaaagtattaaagtatatgtcatatattacatatctgtatgacatatgcaatatacacatatgtatatattacacatatacatatatgtaatataataaatattacacatatacatatatgtaatataataaatatattaatataaatacattatatatttagtataaatgtttactatattatgtatatacatatgtctcatacatgtaatatatgtatatatacatatgtatctattacatgtatgagacatatatgtaatatattaaatatataatatatactttaataatatataactgtatatgtaatatatattattaaagtaaatattatatattatgtatctgtaatatatatatttgaatatatattactatatatgtaatatatattatgcaatatattattacattatatatattacatacatgtaatatatgtaatatatgttatataatataagtaatgtatgttacatatatgtaatatatgattaaagtagactggggagagagtgtagacaaaataaaaaccatcatgaaggttacattctggctggtcctctatgtatacattacacacatacaaacacacacatgtaatatgtaacatatactttaatatttagttcatgtgtgtataatgttatgatatatactttaatatttaatttagatatttgagcatttgctatttgataagcactattatgagcacctttcatgaatttatttatttaattctaaatctaatagtcaactcttagctcttgtcgtacatgacttgttagcagcttttgatagagctcatctttcccttgtgcttaaaatactttcttcaggtggttttctgtaccccatcctctcctgattttcctcatacttcccggtggctttgttcactcttctctgttggttcctcctcttcttcccaaggataatctcctaaggctcaatgtttgttcctcttcttttatgtctacacacttttgttgataatccaccctcaagacttcattcacattaccaaaaaatttgaatttagatctccaccccaacctctcaattgaactccagattgtgtgtcctactgcctacgaaccatctacttttgaatgtttgatggaccagccaacatgtcgaaaaagaaacttccgacttccattcatgatcttttccatctcattggatacagacttcatccttcttgtgattaaagcccaaaaccttggagttattcttgactcttctctttctctcaaatgccatatcttcccatcaatttctctcagaaaacatctggaatctgaccatttctcatcaccttcactgtctcttcactaaccttgttgctacccttgaatatgccccgtactgcataccacctgccacgaaccccaccagaaaagaggcaatgtaggcatggcaatgctctggtcttcttagggcagtgttttacatattgtggattaccatccattaatggaccctgaaatccatctagtagattttaagcaacatctaaatagattaaacagaagacagtacagtgcactaggaagcatcacagtaacctgaatttagtaaggtaaagtattattccgtgaaactttgactccattataattatgtatgtgcatattgggttgtgctattcaatttatttcttgctgtgggtcacagtcaatattttagaaaatattaaggtacatgaagttattctaattaaaatttcacccaaatttttggtgttaaaatatgatttgaattttgttagtttgtttgatatccgattcaaataataatgaaggaaaataaaacagattacaattatttggctcaatttgatggtaaaataacttttatctgtttgtaagttaccaaaaagttttagaggtttttagttaaaaaaattgacattaaatatggaaaaaagcaattaaaacagtgtttgtactaggtctatttataataactgagagatgtttaagggaaatccatattaaaaacaggaatgataaaatctttacaatttcttgaaataaaattcttaaccagagaatatcattttatcattaaaaaatccactcaaattatcttaaagtatgcctctggtgagaaagtgaccatataaatggcatttaacaagatatcttaaaaccacttctttttactgtaaaatgtatagcctagtatatactaacaaatgttattgaatttacagaaggactagaattaagtggggaaaaggtattattttcttgaaagtcatgtttattatgctgatacattgtgagaaaataaattttggtaaactgttaattttaacaataaatgttgaataaataaatgcactttaatgaactagcctttaatagtcatattggaaactgtattcaagtacttattctgtcgctaacttagctactcaggcaataatggggaacataactaactatcttaaattgctggtcctcataatgaatgactataaaagaatagtaaaaatggttgaatgctcctgataaatacatttgaaaataaaaaagaatgtattatcgatcatttgttgttgttgttctccttccccttccttccttccttccttccctccctccctccctccctccttccttccttctccttccttctccttctccttccttctccttctccttccttcttctcctccttctgctcctcctcctccttcctcctccttcaccctccccttcctcctccctcctcctccctcctccctcctcctccctcctcttccctcctcctcctttttctccttctccttcttctttctttccttatccttctccttttcttcttcttctcttttgcattccccttctgattgtggtgcaagttgagagagagagttgtgtctaacactcaatttagaaatcagtttattttatatgctggttaaatggtaggcaaaaatttatcttacaaacttagttacagactcaatgagccttttctggattttcagtgagctaatctgttcatgtataatatgagtaactaaactttaggtaataatatcctattaacattttgtagcaaatcacatttgggtcagaaatcttccttctttctataaaaggcatataattgcattgaaatcaagaactttaggactgctcttgcaaacatttaaaaatattccatcacattatctttcttaatattaggccacaataattatttggcatctttcttttactaatttttaatggatcttaaagaaatacatttacaagaatactgtggatggatagagaacatcaaatttacctcatttcttgttattgttcctcctcttttccttccttatataatcttatagctagcggcagaatgaaatatgaagaaaggaaagaattaatatatatttcagcactgtcgcctcattggatattcagatggtgatctgcagaacaataagatttattatgttatgttgtattcagcatcttcaactctattatttattcattagaataatttcagtaaaacttactttgaagttaattaatataaatttttttttcctcaaaataaatgagtatatcttggctgtggtcatttttaagcaaacagcatatcattgtatattatcaatttttgtataaaattactattttaaaggaacataaatagtttctctattttataaggatagattcttgaatctatttttttcttttcattttctttaagagacattttgaccttgctatgaagctaagctagggaggacattggcagaactctgtgtgtcctcatgcatagctttcgatgagaatttagtaagacagacaataggaccttgccaagttattaattttaaatctcttctttattgtagaatctaaagatttatagaatacccccaaatccagggagatggatcacaaagaattggaactttttagctttctatgctcttacgaatcttagctgtgtcactgctatataatgtcatgatcaaatttttatttttttatttttttgcttttcaccctaaatgaatataaactggtaatcatattgaaaccaatcatttaaaatccatggggcctggcatggtggctcacgcctgtaatcctaaaactttgggaggccaaggcgggtggatcacttgaggtcagtggttcgagaccagtctggccaacatggcaaaacccctctctataaaaatataaaaaattagcggggcgtggtggcgtgcgcctgtagtcccagctacttgggagagtgaggccggagaatcgcttgaacccgagagagggaggttgcagtgagccaagatcgtgccactgcactccagcctgtgtgacggagcaacattctgtctcaaaatcaaaaacacaaacaaacaaacaaaaagtgccttgggaatcacccttttaaaatatcaaacaaaatacctgtatttaatcagcagattattcacctctagaaatacaaatataatttttaaaataagtatttgctatgtttaggatgaaaatatgcttcattttcatgttgtttcaaacctgtctccatctatctatcttttgacgtacttgacaaacactgctggttgaatctaaattacccacatcctaacattctaagactcacacatgcaacaatctcagtctgtatggatgctttcacggggacttatttgcaaaatacaagatccagttttatgttaagtaggtgggttgctaatctgcaagaatgccattctttatcaggcctttatgaattgtttgtaagtaccagctgtacaatgaaagctttatattcattctgcaattagccaaaataattctagttaaactctggttaagacttctagtatgaaatgaatgtaaactattcattctttatcgttctttctggtttcattttggcacatgtatttgttaaaatataatcctctaagttgctttttcactgcttttcatgttgcagattgaaaatgttgatgtctgccttagttttctagcagccagaggggtaaatgttcaaggtctatctgctgaaggtaagaaaaagaatgactgaattgtcacaaatggcatcaatgtttttaaattattttttataatgtaagaaatgtaacattggagtatacgtctccttaatatgataaaggaaattggtgaagtcttcaagacaaccgaaacataaacataatggttattaatatgtgctctaagtatttaaatgttttccatattttgccagaactgttcttttcttaaccaactatatgggagaggagtgaatcaaaaaaatatctttatgttattactagtttatagtataattagatttcttaagtagatgaatagataattagataaatgttggatggacataaatacaggtaaaatattttaattaaggcttaaaatattattttatcaataacatttctataatatattcaagttggtagaaatagtcaaaatagttggtaagtttaagtcactatgaagtcttaaataattagaactaacagcgttaatcactgttatatataaatgttttaaatcattaaagattcaaaagatcatcactaaaattgaaagagagcaaaatggggaaaacttgaacaaattttgacattgatcttttttctgagtttattttactttcacttataaaggtggcaaaagtttgcaaaagcttgctacacttaagataaaatttgccatacttgagaacactgatatttaaatttcttttatatttgcttgttatgatatataattaaattacacatttaatgaccaagaagcttaggttcaaacctaactggtagttctgtaacttcgaataacatttgagtaaaattccccaggataatatgttgctaagtagttacaggctagaaatgctgccatttattcactttttatgtctcttccttatgaaaacctttattaatatcagcctattgattttcattcatctttaaaatatacatgaatgctcaaaatttactctctaaattagttaaacatgcaaaataataaaacaataattttttaaagactctttaaacaaaatctttcaggtttataggagaaaattaacactctctcactgtagcctcagattgatgaagccaactcttcaatatgacgaaaactatgagaaatgtttgggggaaaaatagaacaactcagagggtcattttatattaattattttactgcatagtttgagttatatgataaaccatcagagagcaagaaatccaaagagttggttaattttcctaaactccaaaaggggacataaaaccttaatctcagaggaggatgcattttattgccaacatcaagttttatttaaaatatgattacaggttgtgtagcttattttcaagctttacatccttctcttttcctatttttttaagttataactacaggagaaaaatgtaggcttatgtgtaccctacattgtgaattgaatttttttattcaatatttgaaaatcttacacagcaacttcatctgttagaacaaggatttctgcttattcaattatgttatctgacgtaagctaatcctccttatttattaatatatagcataaattaaaaataaaagaattggaacattaaaaattgatatgtctgcttttggaagatatacctacacatacattttgatatatatggatatatatttggaggatatatacatacataaatatgtataaatgagttggtgagtgggtgatttagaaagaaagttgattgcaacaaatccagttggtattaggaggtgcacccacatcatcaatatttataaatgcaggacaaccaacatttaagtggctttctttctccagttcgtagccactgctatgctggcaacagctgtgtatatttgtgagggaatcaacatgctaaatcaaatggttagcacaagagagagctcatttatttctaagaagcagctaactcgagaaaaattgtagttcaaggtcagcaaagaatatcacttctgagtgtgctttgttctttttaccctctatccttttattctctccctgaaattccaagttatttggaaatgttaacatgtttcagaaattcaggtttgtttgtgattcaactgtgactgagagaattaagttgtatctctgtcttcatagatttatttcaagagaaatgcatctagaatttgttaaaaaggacattaaatacatatgattctttttttgtatttttcatttcatacagaaataagaaatggaaacttaaaagccattctagggctgtttttcagtttatctcgctacaagcagcaacaacaccatcaacaacagtactatcagtccttggtggaacttcagcagcgagttactcacgcttcccctccatcggaagccagccaggccaaaacccagcaagatatgcagtccaggtaaggaaaggaagtagggaatgtgtttccaattagtttgtgtagatacaacttgtttttaacaaattattgtccatgagtttgaaaaacgtactcatgtgcttgtatcagtgtgatgggattatttgacttgtgtaatagaaactaaaaccactcttgttttgcttggacaagcaacatctatcatcttttgggtgacgtattttgtttgttttctaaagattgttgttctgtatcacagtgtgaaatgtctttggtgtaagtaatgtggcatgactactttcttctacaaatgactttagtatttagaatgtgctattgagtcctagtctcctgtcatgtagttatctttcattgatatttttgattaattaagtctgtcagaaatttcaggtctgttaaacataggagtttgaagtttgggaacatagtgtttttgatgtgtgtgtgtgtgtgtgtgtgtgtgtgcatgagtgtgtgtgtgtatgtgtgtatgcacatacatgtattatttgtctggcttgagtcttttggcatatgtagacacagcctggtggagtgctcccaaatcatggcaacttccttttctcttccattattattatttttttccaatatagaattatatcaatcagtgttcaactagaggagtcaagcaagtaaatgatatataacaagagatttattgtgaagaattggtttagcatgattgagcatactggttaggcaagtatgaaatctgaagggcagcccagctggaagggcaggctagaaatctcatcatgagttgaaattgcagtacgcaggtagaatttctcctctgaaggaagcctcagttctgcttttgaaaagccaaactttcggccaggcacgatggctcaagcctgtattcccagcactttgggaggccgaggtggatgtatcacaaggtcaggagttcaagaccagcctggccaagatggtgaaaccccatctctatgaaaaatacaaaaagcagccaggtgtggtgacaggtgcgtgtaatcccagctactctggaggctgaggcagagaattgcttgaaccagggaggcagaggttgcggtgagccaagatccagcctgggtgacagagcgagactctgtctaaagtaaacaaacaaacaaacaaaagaactttctttcaactagttgaatcaagatcacccagattatctaaagtaaactttactgaaagtcaattgattatagacttttattacatccttaaaatatctacatagcaacaactagactagtatttgaaggaataatttagactatagtctaacatagtttacatatcaaaataaatgatcacagaatgaagtttcacttaacaactttcatacaagctactatatttgttcctgaacaatgactggggtattggttagttagctctattacataaatagttatgattatttttcttgaggagagaggatatgaaaatccctttcatcgtctttgaaaatataaacacttgtcaacaaatgtaaatatttaactttgtccaccttagaagtcaagcttgaaacctactaacattcagttaaccttgagtttggtaattagaaatgactcaaacaattaaaataatgttccaaagtacatttatggaccacctcccacttactgtcagttgttcaactgttcagaaatcacttctctttcatctaccaaccaaccctcatatggattttgtttgttactccataataaacaatatttatttctctatacaaccatgtaaatttggttccctttggaagattttcactcatcagtgaatttttaaataaattttaaaaagctatagttttactaaaaacatagcataaaatataaagcttatgaagtgatgggggatattttttattataaaataatgcagatatttgactgttctttaagctcatcttggcttttggttatatcaagtgagattgtataagactcatagtggaaaataaatctctataggctaagtttcttggatgtttgtaagcatatagaagaacaaagtggatgacatcgtgttttatgtgttattattttttgtgtggatgtttgcaacaaagagatggattctgaaaagtgccagaaataatatttactagagtttggtttaagcaatttaaataaagaagacacaagaatagtagctgaaaaaataaaggaaataaaattattttacgtaaagcatgttgactctggaagtgatacggaatatcatttgacattgctttacctcactctttttctgtatcttccatgtgaaatttattgtctagaatttcttgcccagaatttcttggtagttatgacccttttaggaaattgtttattttcctattcttcttgctggatatacatggctgttgtgaaactatggggtagtttaaaatataaagccatgtataatactcatggtttttatactcttttgtggaaggatgtctcgatttttcattacaagtttatgaaaagtattcttttcaacagtgtcctttaaagcctttaaggctgtggtagacttttagcaaaattttctctgctaaattggatttaattactttttgaattgatatataatttaataaatgtttatagagtaacagctttaataaaagtagtattcaggacccgaatatagaagagttcaagtcttacttccattagtcttacttttagagaatttttacatggtttaaaggatatgatatttaagacattaatacttatttttatttatatagatttagtgtatcacattaatatgtaaattagaatttatgtggacttacctgtagcaatcaatattttaaagcatttttcaaaaggccacaatgataatatacataggaacataatgtagtatctatgggttagaaccaagataattaatgcagaaaaattcctagtgacaaatttatcttcatttgctggaggtgtgagtcataaatcatgatttatgatgcctttctattgatttcaaagttctttccaagtaaatagtttaaatctcaacttgctatacttctctgggtatttggccagaaaatgttcttatatttttctctgtagactaataaacatttcttagggcacattgtttcagttcagtgaaagtgtttctgttttattctctttgtttaaagtaaattggcataattctacatatttccacaacatttattttatacattaataatttttaatttgattttgctattttgaaaaaaactccagatgtttttcctcaagttgaatagctttcatttaaacagaaatttggatttaaaggttaacaagtgaaatatacaggagaaaaaataaaacatggaccaagaggaaagaatagagtaagaaattctgctctcctgctctctcagctccctctccacctttgagtgtatgtatctataggtgcatgggtcatgtgctatatgtgagcttgagtgtgtgtgtgtgcacaagtgtgcatgcatgtgtgtcctgctcaagtggcacctagagttctaattattaagagtttacctcaggaatcagactgccaggacctggatctgtattaaagtaaaggtgggattcagattttaagtttcttaaattcattacagggtattatttggcttatttggagtgataaagacttgattaaccaagtaatcaattctttaaaatttaaatatatttgatatgaaaattagattttatctatgtcagtatttttttgatggactttatgtgggtaaagattcaatatcttgctatattccgaaatattaagcatcttatttgcatttatttaatatatgaaataaaactagttcattcagtatttcttaattttctttttattttgaaaaaggtagataaaaattctcctctccagccaaaaggggaaatatgagaagtgttttaatataaaatgctaaaaaaaatcgtatataaatgttggtatcatagttattttccacaggtattcattgggagatgaaggaaatcctatttcttattctaagaaacaatgtaaaaataaatcctacaattttaaaattcataaaattcattttcatcctaggctatttctgtgaaccttactttttcatatgttgcattttgacaattagagttctagttggcaggaaagctaaaagaaaattctatttcaaccctaagcagtacctagcacataccagacaacaacactcagtaaatgaatgcatgattttcctaagaatacctggaaaaacattacagtaaaaaaaaaataaaatgaaacttaatttttcttatgtactgacctggttatatacaaggtgttaggatgatagtacatgtaaaagatacatttttttatttgctaaaagcttttttaaaagacgtgatttttcttaaaatacatacttttatcttaatttttgaacagattattaaatgattttccttcctgttatcaaatagttgatgaattttaccaactcacagatagtggttattaaatcacatgaatagtttatgtagtatacaattaaaacatgtaaaaagaagaaaattgaatgtgaaagtagaggtaagagattacatagatagatgatagaggtggcaaaaccagtggtgataaatctttctgaattaaaaaaaaatatattgggaacttgaaagtttatgatctctgcagatgatcatatgcccttttgcttttgattttatgggagcaaatcaagaatgtgtccactttcaaagatgaacgtgctcctacaggattcacaagttaaactgtgaaatccccgggtacacgttttctgaacggcttggctgttcccttgcagcccctttccaaggttcccgtgacccctaccacacacattgcttttggaaccctcttaccatagaggacatttgccttccagggtatcttttccaggaaacattatttccttctgggagattcactctgaaactgggacagtttacagctttttggccaaaggttataaatcttgagaagtatataaggaagtttaatttaagatgacaggtaggctttagtaatttaagcccttgtgaacctggcttcaattagttgcctaactcagttctgtgttgtggccatagtgtgccctttaaaaaaaaagtcagttaatcgattaaactttaaataaaacaaaaacagaaaagaagagggatatttataaaatcattacttaaagcaggatttttttatctctagagagaaataattgaagagaaagaagttattcttaactgactgcatttggaaaccaagagtatgtaatattaagagaaagtttgtgtgtgcacgtgcacacacttttgttacgttctaacactggtgtttcggttgttatagatgaagattatattatagtaaaggtgggactcagattttaagtttcttaaattcattacaagaaaatatttggctatatttggagtgataaagacttgattaacccagtaatcaatttttaaaaatttaaatatatgtaatataaaataagattttatctatatcagtatttttgttgttttgttttgttttgttttgagatagaatcttgctctgtcacccaggctggagtgcagtggctcagtatcagctcactgcaaactctgcctcccgagttcaagccattctcctgcctcagcctccctagtagctgggattacaggtgcccaccaccacggccagctgtttattattattttttttttttgtaatttttgtggagacatggtttcaccatgttggccatggtggtctcaagctcctagcctcagatgatctgcccgcctcagcctcccaaagtgctgggattataggcctgagccatcattcccagatgctatgtcagtattcttggatgtattttatgtgggtaaagattaaacatcttgctatattggttatttcagagtcaagcaagtatgggttggagtcctgcttgccaattcccagcgcagtggcatggtcaagtgattttaacctgctcaaattccagtgttcttcctctaatattggaatggtgtcaactttctcataagggttttgaagagaccagatgaaatggtttatgtataaaatgcttacttagcataacacagcatataatagacactcaaaccagctatttccatcttcccttctttcacttgaagatcatatcacatgtgtaataaaatacgttgacccacattaaaaaccttaagtcaacctcattactgttctcccttttctctctttctctaatcaagtctgcccattccactgtttaattaaatatatgaaaataatttaaagtaataatatttccaataaaatagcttaataatgctcagtcctttgtatgcccagtctaaataagcagaataacccctttaattagtttagatttttttaattagttacttccatatagctaaatagaatgctcctaccactagtttctattcatcaatttgaccattttcattggattcacacatctctatttctctccaccctcattaattgattctacaaacttttattaagcacgtagtatgttctagacaatcttctagtcactggagatatgcagaagacaaaagagattaaaaaatctttgctttcttgaagctttcattctagtaattggagataacacaaacttaattaaaatatttaccagtaatttgacagctgatgacggagaaaaataaatcagaaaaaggcaaatcagatgtgtgggaacaattttttgctaatttaaatttaatgaggaccgaggaaagtcctcattcagatgatgagactaaacaaagaaaatgacagaatgttgtcggtgaatatctcagggcagtgtttcaggctgagagaagaaatgctcttagaccttgaattaagagcctgtctgcttctcttcaagaagagaaaacatctatcccagttgcgctggatcagagggaaagaggcagaagaagagtagatataattcaaagaaacataagaataagtatggccctgttgccattgtaaagactttgacttttattcctggagagaggggaagatactatgtgccatgaggaacataaacaggcacataaatgaagtggtcatattggctgctgtgttgaaaatagagtgtagtagggaaaaggtggtagcaagaagtcatggaaaaagcttgggctatcatgttgaaagtgcagagaggaagttaaatgccaaatgtgttttgaaggtagtgtcagaagaaactgatagacttgtaatgaaattggtaaacagaaaggaaactctagcatggataaggaggctataaaggtgagactgtacgttatcgatatagtattagctgttggaaagatggcgtttccatttgctgaaatgaagaaaaaaatatgaggaaaggtttggtagggagaaggtcagatattcacttattgccatgtgagctttgaaatatatatgagatatatccaaaatactgaggaggccattggaattgcaaaactggggtttaagggacagatggagcctatagataaaaatcatggaaaaataagcagatagcaacaataaaaagctataaggctagacatgattaagtcaccaaaatctgtacatagttgaagaagagaactgaggccttggatcaggagcttaccaatatttagagatcaaggagatggcaagacctgatagaggagaccaaaaagagttagcctgtaacgtaggaagaaaagtagaacttgatgtcctggaaagcaggtgcagaaagcgttcaatggagagacagatcaatagtcataacttatatggagccctttctgaaccattctaaatagtttatacatacatttactgtctcaatcctcacggcaatcctatgatgtgtatactgtattctttctttctttctttctttctttttttcttttttttttttttttttgagacggagtcttactctgtcaccaggctggagtgcagaggcgtgatctcagcttggctcactgcaaccttcccctcccgggttcaagtgattctcctgcctcagcctcccgagtagctgggactacaggcacacgccaccacatctggctaatttttgtatttttagtagagacagggtttcaccatgttggcaaggatggtctcgatcttgacctcatgatctgcctgcctcggcctcccaaagttctgggattacaggcgtgagccaccacacccggcctgtactgtattctcaatattaattttgacataaggaaacagaaaatggaaagatcaattaaattgcacagtttcacagagactaggctgtatattggatcaaggcaatctagtacagagtttgtgtttctatccattatttacagaatgtcaactacatgaaatgttgcatgtaagtaggatgaggactgataactgacttaccgcttttgcactggagactttgatgagagctctttcagtgaagtagttgctatgataacttgattggaatctgtacaaaagagaatgagagggaggaattacagagagagatgtacaatttgtatgtgtcaattaaaaaaagagatagcaaatataggcaggtctttctaggagtgttactaacatagttacactccactatctttagttcttttattggttaactttgtacctttatataatggaataacatctttatttctttttcaatcacctgtagagtatcttttggtattcgattttgtaaaacctggatattaaaactacggtttggttctcctccatccactaacaatttccaatctctgttatcggcacttttatttttttgttaccaatgttcatatgattaatctattttgtacaggtagctgattcttccatgcttttagtataggttgattccaaaagttgaaaatcaataagagtgtttagataggagatatatatatacacacacacacacacacacgcgcacacacacacacacacacacacacacactctcttcagaatcaagtaatatactctgattcttccctagttaaggcctatctgaaaatctgaaagtctggtaaaagttgatacttgtttgaattgatgcataaaatagtagataatttgaattagggccagagctcattttatgatagtttggggagatcagtccaagtaaacaaaggatcactgtatgccagttacgtaaaaaatgccttttttacgggattatccagttattatagtttaaaatgctttttatgttcagatcgttggttttggtttagttttgtttgtaaaaaaaaaattcttagttttacttttcttaactaagtcagaatcagttaaacttgattttctaggtataaaataaaaacgtcataattgtcttttatctttccaaaagaactgtgagaatataaatacatttgaaagtatgagattaactcttaatttaagaacttaagacacactttttgccataaatatgtagataacaacaatggtgagccattatttgtcctatgaaatattttttaagatgtgaagtgttattataatacagctgtgactcatgataactaatttgtgattaatttatttaaaattttataacaggacattttgacggcctagttagatattttctatcaaacactagaaatttgattctaaccacaggtactacgtatttgacatgtatgagccactttcttctcaaatagagcactgattatatatgtaattatttcatttgccattttatactatatgaaattatttattaatcttttctactaaagactaacatcaaaaagttaacatttattaaaaattttcaaaaattttcaaaacttattaaagtcaatagctattgaatttattcatctgttttctactaaaaactaacctcatctcaattttttgaggttagtctttataaaaaagcagattaataaagtcaatatttataattttgaataaatttttaaaattataattaataaagtcagtaactattaacttttcataatcccttttctatgcttctacttctgaccatcccaaatgcccctgtctttctgattgatctctcagtctaataagatataaaacaaaataacgattgactgtattcattacaattttcaatatggagtaaaattacatctcaatacattcagagcttcagcctcaaaatgttgaggttagttttcactagaaaacatattaataattatggaccttttttccattataagtcagtaatttttcaaattacttataatttttcaaatttcaaatttgaaaaattactgacataataaaaactgcaactgtctcaaaaatcataattgtctgggcatgatagctcatgcctgtaatcccagaactttgagaggccaaggcaggagatcacctgaggtcaggagttccagaccagcctggtcaacactgtgagacctactctctacaaaaaatacaatacaaaaaaaaaaaaaaaaagttagccagaagtggtggtgtgtgcctgctgtcctggttacttgggaggttgaggtgggaggatggcttgaaactaagacgtcaaggctgcagtgagccataattgcaccactacattccagcctggtcacagagattcctcctctgaaatatatatatagaaaaaaatacactaaaaataaaaaagctataatgattatgtcagaatgatcattagattatttttctgtagccaagtctacatggaaaatcaggagataacttggtgagcatggaattagatttaggggatttgcatgtttcagtaacttatcttgcttatgagactttaaccattagtcaagggcacactttcaacatacacctctttatgtgcccttttctatgcttctacttctgaccaccccaagtgcctccctctttctgactgatctctcagtctcataagatgtgaaacgaaaaaaaaaaaagaaaaaaaaaaaaaagccttctctttctgctgtgtggcaggctctagaacaacgctcacccatcagagatgttttgtgaccccagtcactgcttactaatattgttactgaaatgccagagatttggtctaggtcctgctgtgtgctacacagaaagccacttactgagagaacgagtattgccagagaaaaaggctttaactgggtgctgcagctgaggagaagggataccagtctcaaatccaactaaaattaggggtttatatggcaaggaagaaatgtaactatgtgtgggaaaacaggaatgagggagggataaggaagaggaattggtcaacaggaagcaggtggtcagttaagcaatcatgacagatgaggggcttggcgtcttattgtccagatataattatctgataagtttcagttccttgacactatttgggttgcctgatggttggtttcccaagaaaaaaacccagataagacaaccgtaagtttctcaagttttaagactggaggggtcaatttctatgtttattcaaaagaaaccataaacgtcagttctatgggacaattgggctggtttgattatgattgtattgatgattatattttctttgcattaaatggagagcagcccaattataaggacttgatagactagattttctcacaaatcttcacatactttatagatattcatcttttaaatgtaataaaagttattttcctgaatatatgtattaagaaataatttaacatattttatgatgactacaatgctttttaagtatttagaagtattaaataatctgatttttcactgatctgtgtggtctttgcctaagttggtttaaatttttagtttgacaaaataactttttctaccagtattcaagttccaatttttttaaggtggttgcattcaaatgaacttttggaatgaagctctgaatgtattgagatgtaattttactccaaactaaaaattgaaaatgggaaacatccacagaacagcattgtagcgtagtactttgagctatgtgtaagtaacagcattgtggaaaatctaatttatggtgatattgtaaaagaaatatgagcctcatttcctgaattctcctttatcttgaagtttgacattcctaaaagagcaagagactttgatgctgtaatatcttacacaggcctctccctctttagttactgttttgagatcccacaaaagcagaccatgcaggtggccttattaactgcctgtggaaatttaagataagacagaggttataacatattttcataccgtatttcactaaaaggataagttatcacagtaacctgtcccaaatgcaattcagatgatatttcagccacccggttactaaaaagaaacacatgtggataaaagctgtttctgacttatttatggattaggcaataactgttttcagtgaactcttagcaaaaggagaacgtattttatgatatactctgcagtgaggacactttttgcaaaatgcctttaatattttttaaggaccacatatagttttgaggtactaaagatatatttgcagaagtggctaaatatctctctctttcttagtgctaatagcatgttagttatcattttatagcagttcacaaggatcctgcagaagtctttatactaaagaaagaatttggtttaaggagctctttaaatcttaattctgaatatatggtttcatttctatcccaagcaatcataggacacataaagaaatttatttccatctatctcagtcttaaaaacccttagtgaatgtatttaactgtctttaaagtttgttcttttgtctaaaattccttagcattaaactttaaaaaatatatttaattatagtatatcttgggtactttattcccgattttttttctcaagccattttcagtgaatttgaaaggaaataatttctgtctttttaacataatactgtattatagaagaaaaaattgggaggtaaaaattgcctactaaaactcaaacccaagaaatgccttattttatactctgagttttgtttctttatattcctctttgtttccttgtgaatggtgcttttagaagaaacaaatgtgatatcataattaggcatgcttttttctttctttgggaatcaagagtactacatgtctcactatatacggattctgaatagggatttcttctcttgtgatatgtttatgtgactccaagactgagggtaaatagatagggccagaaacaaggatgattctaaaatgattttctataaaatttcttaatatagatgaagagttataaaaactgatgtaatgtcaaagattgtctttacattctgttttgctttgataaatatagtttattcaactacttttatatcaaatacatctatttaaaaattactgttttctacttgatttttatgttttgatgaaccagccactgtctacttgggcagagtcaatgcataacatatggcttaatgaaagatgatttgttgctattgatcctttatatgttacattagagccgtgtgttcttttccactggtgatttgaaagttcatatgtgacctttccacaaataaattggccctcaccatgagccaagagatacatcagatatgtggctaagataaagtgatgttcctcttcaaatcacccacaatcttatagagtacctaaatatttaagcagatggcttaatagacatgttaattaattcaacaaagcacaagttgctcagtgatcaaagttagagggaagggcacatatgaagggactgacgaaggaaatgccatttcacattcaggaaatgagttatttggctgaggagaaagttaaagtagaaatgggttctgggtatctattgctgctttacaaaagcatcccacaatctaatggcacaaaacagtaaccattttacgatgctcatggattttgtaagccaaagaatcagacgaggcataaagagaatggcttgtccttgttccactatgtccagggcaggcaatggagaaggatggaatggcggggatgtcacaaactggtgagagacagaatatctgtggttaaagaatccacttccaagatgacttcttcactcacaggtctagcagcttaactgaaattcacacggccactccagcatggcagccttagtggtatcatacttctcacatggtagctctagtggttaaagcagcttcaagcccactcagactctaagagatgggtggatagcacaaagatctcacttctcaatggaaggatgatcaatgaatttatcgtatccctgtgttaaaattgtcatagcatataatgagagagaagactggagaaataggcagaggtcagtttgtggaagttgtgaactctatgcctaggagctgggacttatttgctaaatgtaaagtaaaattgctttgagaaatttttaccagaggaaaaatgagactatttataacttagaaatattgccctggtgacagggtagagaaagatgtgctttgggcaggggaatagggatggaccctgctctggtggcaagagaatgaacagtttaatgcttgcagatctgaaagttggactggaacaatgaatttggtgactgattggaagtaagggtaaaagacaatcatcacgtctctactttcattgatgaattgaaatatcatgtatttcagtaagacagaaaatataatatgatagtggaaacagatgggaggaaggaggcagagagaaaaaaagtttagctttggccttcgtaggtttaagattttaatggaactttggtgactagtatgtggctccggagcctaggagagaagccagagccagagatatggacctgggaacattagcttagctatgttttattgattgaaacaatagaaatggaagaaatagctcaggaaaaaagtataaaagtaggggaaagaaaggagagctcaacacaaaactctggggaccacaaacaattacaggtgaagtgaggaaacaaggagaatgagagaatgttctttttgttttgcaatgtactgagttatggtaactttttgctaagttcttaagtgtaaattgtttttctattgagaagtacttcgtcttctgagacattttgttcttgtctttcaaattattcctggaatctagatacaaatgaaatacaaaactctggttgaaatattaaattaactatattgaacatatattcatctaatcactgcaacacaaaacaaaacactaagtcctgaacttaagacacttttggattctgtgcagtgttgagatttatgttttgaaaggctcaccctgtgtgtgttgttttgggaatgctggttctttggtgtcttattgggacagtttctaatgatttcttactgggctaagtcctgtgggacttatgttgttgactttgggaaacaagaataatgaataatatccataaaattttgaaggagaataagacctaattgtatttgatttcaaggaatcacagtcccaaagtaattttaaactgagagaccaagagccacagttaaaagctcagccattgtcctgaaagagccatgcttatgtgctttcaagtaagaataacgtaacatcaaaagtggtaagtgagaaccaagggatgtggtattaggaagacttccaagtgcaggtgtgcagggtaatagcggctaaaattcacacaggattcattagaatatttacagtgcctccagagactgtcaagtatgcatttttttttttttttacctgttatagcacttatctttaccagacacccttctaagtgatctgcaatttggtcctcataaaagcctttaggtagatgtcatcctcatttaacagatgagaaactaggcacagaaagcagttgagctgagatgtgggtagggcagctggctgtagattccttgctattaaccaatgtattcgatgtttactactggcatttcaacatattaattcacagaagataaataatgtcatctatcatttcttcacatctgcaaaatgcttttgtttctctttccaaacttgaatttgatttccattaaatataaaattataggttttttgttttttttttcgagacggagtctcgctctgtcacccatgctggagtgcagaggtgtgatctcagctcactgcaactcccacctcctgggttcaagcgattctcctgcctcagcctcccaagtagctgggattactggcacatgccaccacgttcagctaattttttgtatttttagtacagacagggtttcaacgtgttagccaggatggtcttaatctcctgacctcgtgatccagccacctaggcctcccaaagtgctgggattacaggcgtgagccaccgcgcccagcctatactttttatgaagaatattagttagtatacatggttttaggggttataattctccgaatgaaacagtaacctctgtgggctttaaccaaatttttccaaattaaatctttctgacacagtgccagtacatcggaggtggtcaataaaagtcttttcaatgattaattaattggacaattgcataaatcaatcttcatgtttgtcagaataacgagaacactgaactaagtttagtttctcaatatctatgtctatgtgccactttgaaaaccttaggaatgtgaagctgctttcttatttattcattaattcagtatccaaaagtatttatatactttataagttaatctttagaataacatcagtgatggctcttcactgtcaatactctaaaggtgggattagtcacttctgaatatccattttcccagggtttctatttctttctctactttttttttttgtatgtagacataattgaattggaattttcttttcatacactacacgagcgatgttcaacctcattttcccacactcctttctatgtaactttattgtacgtagaacaactcaaattagaggcccaggatttgtcttagattcttccctttctttcaattcctgtgtccactattttaacttattttaatcatttacttctatttcctgtgcctctgtcttcattcaggcctatataaaatcctgcctgaattttagccatgatttcctatttgatctgttttcagccttgttaacatctcccaacctcatttcttcctcactcttacatatctaaggaaagatctatctaatctgagaaattagtatttcttccgaaattaaatttttttggtagtctcccatgcaatcagaataaataccaaattccttagcaaattgttgtggctttctagattctcacttggaaaaaaactagatgttaaaatattatttttagggctgggcgcggtggctcatgcctgtaatcccagcactttgggaggccaaggcgggtggatcacttgaggtcaggagtttgagactagtctagccaacatggtaaaaccccatctctactaaaaatacaaaagtcagccaggtgtggtggcacgcacccgtaatctaagctacttgggaggctgaggcaggagaatcgcttgaacctgagaggtggaggttgcagtgagccgagatcgtgccactgcactcctgcctgggcgacagagcaaaactccatctcaaataataataataatatttgtagaatgaataagaaaattaaaaatatttataattaccacaataaataagcataagttgaaacaattcaaataccaacttcctcagctgagattttttgtaagaagcttgatagaatccaaagagctaaagtcgatacattatatgaggttgaggtattaggttttggtgatttatagaattctgtatgtgtattatgttgaagcaaatttgattcttgaggttgaaaactaaaactaaggaatgaggtcatatatacatatatatgaccacattttgcatggaagtctgctgttaaaataactataacataaatagaatagtctacaaacatcttacatgaaattattaaaattttcttagctgtgtattgatgaaggcatagagaggagatacaaatacattttaactctcattctaattcctgttgaacaataagggctgtttgaatcctttgcaaggattatgaggctaccataggaattagtagaaaaaaaatgttccatgattgattagtgatgtctgtaatggatgtgggagtggctaattataaattatgttccacatttattagccctgaataaaacattgctaaaaattttaaatgataatatttgcttgtaagactatgagaatagttgcttaaatactataattattttaacctttaaaattgttttgtttactcttgatttctatgtaaagtagattgaagtttttaaatattatttctctgtcaaatggtatattttgaaattagatttgtttgatacttgaagagatcatattctgtatacagattctataatatcttggaaatcttcacaaatctatggagcaataaaaatacttcaattgatatttgatacagacaatatggtacaagagaacggagtacagcttatggaatgttaacaaatttaagttcaaatttcagcactttaatttacaaaatgtataaaatgcacatgagttaacattaaaagacttaattttcatatttgtcagttggttgtatagtataacctttgcaggactgttgtgaggattgagtaagataaattgctgccagttattaaggatgtaataatgactagtgtctttctgttccctcctttaacatacttctgataattctattcttggaacaatttcccttgtttagaaggtagagatataacatgccatcatttgaaaatgccacccagtaaatgtcaatcaattgtttagttactgaacacataccagccccattataggaactaagaatgaaaaaaaaaattaacataacataattcctgccctggagaacaacgcagtctgtttaggagacagatacttaacctgattaattactgcaccatcaagatacagtattcaagacatatcgagatattcagagaggggattctgaagtttaggattgagattggggtttgaaatatacatttgctatacaagaaggaaggagtcgattatatctgggattataatttttagaatatttatggtaacagcgtaaaattttgtgggtggtgacagtgagtgaacctgtatttgggaagcagtagtaatagctgcagatgtggctgttgtgtcaggaacgctaaaatgatgaagtctgtaagaaggaggctgctgacatctaaagaggcatggcttgagattttggaatatgctgtttgactttagaaactgtgagtattctccttccaaggagacatctgtggatattctgtagcacacagtatctccaatgttattatgcataggaatcacctgcggattctgtttaaatgaagattcaaattcagtaagtctgagatgggatctgaggttctatatttctaacaagccccaggtgatgtcagtgttgttggtctacagaccacattttgagtagtgaggctgtagtgattagtaaaaatgtgtaaccacagattcggccctgtttaccttaaaaagctttctttccttacaataaatggattttataactccacatgaggatttacactgaagctgaaataggaagctctggcagtttggatcctgctgtgttttgatcaccagatgaattccatactttaaaaatagttgactgtgtatagttttctcttcttcccttccatgcttgagaaaaataaaaagcagccccttgatattccagtttactagaaagatgatcacatacttcttttagtaggatccacaatgagcctcaaaatgtttacttcttttgtgcttctgtttctgacatcttttgcccaccataaacagtaggagcctgatcatacaggatttcagaaaaaaatgcactcttcaattcagacatctaaaaacccttattttactgcttttctgactcagtttattttcccccattgcctgagagctgtgtctacatgtcacctgtgtctgttttactaggactcggcaagttggctgtgcttactcacctggtttgttactaatatgttataaacttgaaacctgggaaatggtattacaagcactgtggaggataaaatgcttttctgctgtccagtgaggcatagacaataatgttaagaaaaataaaggagctattgagaaagattttgagttacatcaaacaagtaatgagagaaatggggagagattgatcatgtgaaaatttgaaagaaaaataatgagagaaaagtagaggcatattgaaccacaagatttgatatttctgtcctccctctattactagtgatttttaagattacagtaatagcttattttttagataacattgcaaacgttcaactaagcctttcttgctctcttttagacctcttttcaggtgaaaagacaaaaacaaggagaggcaacagacgtttaagagtagtagaaggacataaaaacgggatggcagtaatactataattagaaccagcaattaacaaatgtctcactaacttacacatacatacgtgtgtacagtgcctttacctttgcatggtatttcataaacattaggtattaggccaaaccaaactgtttgcccattgggcttcctatggaagctaaagagctagctaaaaccaaccaaccaaccaaccaaacaaacaaacaaaaataaattggtcttccaaggagtccaagttcttgatctataaacatctgagagtggtagacacttatgtagcaacaggccagtgacttttgactaggtgcctcttagaaatgcagctggtacaatgtattctgttagtagttgagatcatgaaaaataaaggacaaaaatcatgaaattgataagaccagtgggttaattggtgaaataacatttattctctatactggaaaatagatccatggaatggtgaagttgccttataaataaatcaaacataaagaatattctttttgacatactaagcatttgtggcagttatacttggcagataaattactttctaaagggtaatataaataagaatagttcttattctgcttttttaaaacatactaaattccatttaaatttctcatggacccatcaatctgacttaagcattatcacctcacaatttaccttttttaaaatgagtatccaaccattccaagctcctaattccactattgattatttcaaatcagctattcacctcaatttatttaaaacaaattaagtatatatctgtgaaagatagagtttatttttaatatgcttccaatgttattcaaacaccaggggtttagtctaggtcctgctctctgttgcacagaaagccaatcactaaaataacaagaattgcctagggagaaggctttactcagttgctgcagctgacaagaatgggagatcagtctcaaattcacctccccaattaactaaaactgggggtttatatagtggggaaggcatgtggctacatgcagaaaagcaggaattagggaaaggtaaggaagaaaagttggtcaacaggaaataggtcatctgttaggaaaacaggaattagcaatgagtaagaaagtaatcctgacaaatgaaggacctggcatctcattgtctagttgtggcaatctggtaagtttcagttcattgatactatctaagaggcctgatggtcagtttcctgagaaaaggaactcagataaaacaaatgtaagtttctcagattttaaaactgtgaggatcaatttctatgtttattcaaaagaaactataacatcagttttatgggacatttaggccagtttcaacaattcaaaataattatcacactttaaaaattaatattaattgcttagtttcatttaacatccttgtgttaaaattttctcattttctcataaagtttaacagttgtttatttgagtcagaattcaaataagcttctgtacattacaattggttttaagttcttataagactctataggttttcccttcataatttttcttgcaatttatttgttaaagaaattgggtcatttgtcctattgagtgctccactgtctgtttttattattgtatttctgtaatatagatctttgaaaaattgtctctattaattgtgttaataatacacttgctgttacaacacttatggtgctggtttggtgacacatgacatattacattttcaaaatgtattagttttattgtttatttatttttttattttttctgagagagtctcactctgtcgcccaggctggagtgcaatggtgctatcttggctcactgcaacctccgcctcctgggttcaagcaattctcctgcctcagcctccaaagtagctgggattacaggcacgcaccaccaggtctggctaatttttgtatttttagtagagatggggtttcaccatgttggccaggctggtctcaaaatcctgaccacgtgatctacctgcctcagactcccaaagtgctgtgattaccgatgtgagccactgcgcccagcctagttttattttttaagagacaagagtaggcaaatttccaatatctatgatagtattggtacatttgatgaagagattgctttgaagaaatttcattatgtttatacatttaaataactaaagttaaattaaatgttttcattacataaaaagggtacaaagcatagttatgaaagcttagagatttaatatgtgtctagaaggtgataaaatgttgcatagacttggtgtaatttaaggtgatacttgaaaaatggttagaatttggtataatagacacaggtagggggtattcccataggagttatagcatgagtaaaggcacagaaaaatagaaaagtacaagtgagataaaaacccctcttgtcttttatcctgtgacaaagatagtagaacagaaacacagaaacataagaatattttataaggcttggtgcagtgtctcacacttgtaatcccagcactttgggaggccgaggtgagcggatcaagaggtcaggagtttgagaccatcttggccaacatggcgaaacactgcctctactaaaaatacaaaaagtagccagatgtggtggcgggtgcctgtaatcccagctacttgggaggctgaggcaagagaactgcttgaacccaggaggtggaggttgcagtgagccgagattacgccactgcactgggtgacagcaagactccatctcaaaaaaaaaaacgaatattttataaaggatcttgaatatcaaaatttactttgagtcttcactaatcagctgcatgttttagaaaatttattgtatgtctttgacctttgcttccttcacctataatttcacttatctatttgagaataatatcaagacacaagcctagatacattcatttcaattcaaatattcgattctgaagtatgaattagataagcaatacaacatttgaatttctctaggtcagaggtatcgtgggaagtattcaaggcttgagttagcatgataaacatcggaattgatggaaaacataggtacaaatggaattatagatatttaattagtatgactaggtattgatttctcctctgtaataattgaaagggaaatggaaagagtcagctgttgagattttcagcctatattattaggaaaattgtggtcctctggatagaaataaagaaatttaagtaaggagtttattgagagctggagaataaaagaaggagaatggagagtttgatgtggtgagtttgaagctcacgtaaatggacaagtctttcattcagttggtgccgatggatgggaatatgaacagaggttaatttaaggagtagaatattagtttaaatcttagtagcaagtgaattactaagtaaacaatgcataaaatatttgaggaaagaggatatactcttgagggaaaaataccatgcctttaagagatgtggaaacaagcaccccaaaaaggaaagagaaaatgggacaaaaatgatggtgaactaattgggtcagcttactggaatgccataatgcctggtctatgaataggagaggctcaaaaagaggcagggaccaacatggtcaaatacaaagactttagaacacagtgagcattgaagaaaacaagatagcagcttcaccagtgcaagaaagcagaacagaagctgcctttcaagggattacagtgagagggtttggtgtaagaattcaggttcaaagtacagtatccttatataataattcagaaaacacacatggaccataaaatgaaattgattttggccaaatcattcaaactttatggactttgttgtttatccagttctgtgctaagatttatattatggcacgtctttaaaataatgaggtggggggaccagtaaggtggcttcaactcactaaaagaaaatatattgtttcattgtcatctattttgctaatatttgtgttcaatttagagaaagtagggtagacatagtggtaaacagttctcttactcttgaattgacaagtagactgagaatttcacaaaaggcttttcctcactttgagtgtttttattctttaattttcaaaatgctatttcactgaattgagacagtttggtttttatttctgaattactttctgatattattattactgaggtagtttagctagttgtggccagttgttttggtgctcagtgtagttagaatacagattgcattatacacaaataacaatttatcacatgccaaatgtgctctgtgaatctgaaaagctccctctatatgagggtatatttccctcaagccaggcaattttaaggacctgcaagctcccaccaccaactagctcagtgtagtaaaagttaatttagtaaacacatcatcatcctaagtaatcctttccttgactaaaataccctctgcttggcagagaagcaattggatcaactacatcaggactccaagtgatcccaccctgattccaacacccccatgttgttcttgtttccttggaggccttgaaaactgtgcatgcacagcaaccggattcatgtcgagccattccaattcatctgagaagcgattctccacttaggcatcaacccatgaccatcacagggtgtgtgcacatgtcctgggtttatcaggtctaactatatctttcagaatactgattccagaactcttaggtaacgcagagatcagttgaacttaatgtataaatgtgcattttatatataaaatattgctcttcaaaatttggcttaaatcatgctttcttgtgtgcctttgaacaaagattttgatttaaaaaatcattgagaaatgtaattcaagaatgcccagaaattgtcattagtatttgttaagttgtttatgaagaacttaagcccactttaatttctgtttttatatagatcttccccaagacaaaacatcttttattgacttccttgaaaacaatttagtactagagatcagcaataacttattagacagaaaccagattatttaatcatttggctttcgaaataatatttagattgaaaaaagcaaattagaagagtttactaaaggaactaatgactgtcatctcatactcttcttttacattttaaactttttaagaaagtgatctttcatcatgtcagtgaaactttagtttccctgaagtttcacagtcatttacaaggttgaatttttttatatgatgaaataatagtatttttaaaatattaataatattacatggccataattgtaaagtcagtgataacacattttatgacaaggtgtgcactgcattatttcatagtacattcataatcaaaggtcatgttggacatacaacattaccataattttctaattaatttgttctttatacatgtttatacgtgttccaattgcatttcattaattcatagttttcttgtaagtttgtgctttccttccatgttcaaagaatctctttaattcaatttctctgtttctcctcatacagtctggcagccagatatgcaactcagtctaatcacagtggaattgcaaccagtcaaaaaaagcctactaggtcagttaatattctctaatttattgcttattagtgatatgcaaataaatacccagtgatattttgtcctatcttttttttttaatgatgcacttctgaatgagaagtttagagcactaaatttttccaggaagattttcacacatagcctcagggatgagcatgtttgtactagataattaaatgggttttggcatcttttttagttttgtgatatgtagtgctataactgggcttaagtctaggttctaggtttagaatcaatcaaggaaaccattactttgaatgcccaattccttccaagtcacataatctggaagttatacaacaaaattgtaattgctttttgagatgggcatgcattaattattgcacattttaatggagatttgaaaaacattggcagattttagtggggaagttagtaccaggtcagtctggactgttcttctatctataatagtttaatttttttgcttctttatgacacaggtataataaagacagcctgttatagtaaatgatagtgcgttatatactgtttggaaaataatgacctataaaaatgttttgaaagagtttgattttttaaaagtgttaagttgctgaaggcatgatggtagcatggaacagctgaataaaaccacagcaaaagagttttatacctctgattagtatgtgatcctttgtgtcatctcactcactggggaagtatccagcagtggtttattcattactgttccattgatgaatcatattatgcagtgtttgaccacaaagactgcgtctgatgctttgacttgaggtaggtgtctttccccttgccttggctttctaagttatattcatttccagagtagccaaaataattctcgaaagacaaattttaaaaggtatttaattaaaaactagaataaatgatataaattatgatgggtaaggaacagtcacctgccatgcacaatgagcatttttattactccttctaagacttgggcatgtaaaatatttttaagtactgtattttgatagatctctctccctctctctctctcctctctgcttcatctcatttccctttttattactttgatgaataatctgaaggcctgctctgcctgcctgtcaaattagggtaatgagaagagcaaatgtatttttacatttgttttaatttgttcttctaaggactgaagatcatttgacttcatgggttgcagtaaagattaaaatgtattttaattattttctgaaacaggtcaatttgcattacaagcagggcaagttttgtgataaaatttgtttatgtgtgtgagtttggaatgaactttctaagtctatgcctatgtctacagaaatagttctcagatttattatgattaggacacttggccaaattcattagttgggttccttcaacagagtgcaatcactggtcctgtaaattcctagcatctgtcgttattatgctgtacttacaaacccttgtagattctcttaagcaaaagttaaatgctggaatcatttggaaaatattctaatactttgtatgacacaatgtccaattagcaaaatagctaaagggaccaattatcagccatatatatttaaacattaaaatataattcacattttgaagctattaaccgttctaagaaatcaacagttttgtttttaagttagtatttgttttttttcctgatattcactctattttataatgactgttactattataaaagcacttatatttcctgaaggtggtttgattttctaatattctgtgaaaatgatatagtctagtagtattataaaggtgaattaaatgttgagcatgtaacaactggattgtgaaattttggtatatcggatactaatatgagagacattaataatctttgctttaaaattttataagatgattataaaaaatagtgctatatttgtagattttgaattcttgttttcctttcaaataaaaaatttcagagtagtacacagtgacattcacatggtggcagcaaatactaaacaaaactttcaatatcatattttctaaatagatcttagactgtcagtattagttcttggccagacacggtggctcacgcctgtaatcccaacactttgggaggctgaggtgggatcacttgaggtcaggagttcaagaccagcctagccaacacagggaaaccccgtctctatcaaaatacaaagatgagccgggcatgatagcaagtgcctgtaattgtagctactcagaggctgaggcaggagaatcgcttgaaccctggaggcaaaggttgcagtgggctgagattgtgccactgcactctagcctgggcgacagagtgacaccctgtctcaaaaaaaaaaaaaaaaaaaaaaaagaatgtcaatattagttcttcacttctagttcttaatttatagattaaatatacctatagaatatatgtcagtagtataaaatcaaaatctagtaattgcacattttaggcacaatccattacataatcggtcattgaaattttaaagtggaaattgtttaagagtgaaatgaatgatcgaaactgatattttagttcaaataaagcagcagtaagttactacctccagtcaaaccacctctaattataagatagtctgttcatatttcctcatatcctgtccttcatacacaaagagtagctaaagctattgtcactacatgtaagcatattttaaattgtcatccagctaacagtgattttcttctgagatctgcatcctttcttgtcacgtctcctctgtgatcagttggccaaacttgtgagacaaccagctaagtctggatgcttatttttggcaagaaaatgaaaaaggttttttgtggggcagaccagtgaaatataatttaactcatgacctgggtcttggtaccatgttttcattagtgtagctaagtaacttagatactcagtgagcattagctattccttcttgttcagtaactttcttgtgattaatatccaagcaaacttactatataactacctacaataaaaacaaatgccttacacattgaaaagaacagcttaataactgaaatagctgaggaatatgctgagaacataaagttaagtgttattgtttcctttacttttcacataattgttacagtacttttaaggcaaagttttattcatcagggatggggtgagtatgacttttttagttaagatttattttaattattgtatattattacaattttggagggacatgttcattgaaaagggaaacaagatttttctgaagatctgcaacattgtgcttagctatttatttgtcacatctatcaccattttctgctaaatagattttagaacatcatatgttgtaaatttctgactttcagcacctcctgcttcttacctttttgtaatgtacaataatgatgtaatttttcttatactatttcaggcttccagggccctctagggtgcctgctgcaggaagcagcagcaaggtccagggagcctctaatttaaataggagaagtcagagctttaacagcattgacaaaaacaagcctccaaattatgcaaatggaaacgaaaaaggtaagtgtttgttacatcattatgacacaagtccaacatgagtcttgtgaattgcatgctaaatctaatatttgagcagcgtaacaactttgggcctagagatgttatcagtggagtttctttatgtttcctaactgtcccctcctgactgccagctttcttatctgaagaacattttaaacaaataaactcattcattttaaagtagttagttatatatgcaagtacaaatactgtttctcaaaaacaggtccttccaaatgcatgtaaatcacattttcttatgtctttttatgtttttgaaaatgtatcctgaaatcataaagccatattgaatttatctgaatccttaacttcagttaaggtaagagccataagtgtttttgacaattaaggttggagcatcaaaatttgaaacataattacagtaggtttttatctttgcaagcagcagatcccagagatattatgacctcagttttccccaaaagacaaattattcatatttgttttgttttcttgaattagtgcataatataaatatcaaatcacaaaatcaaggacattaaatgaaagtgtctgttaaaggcatattataaatgaatcataagccacacagttctctgtgatgtacgaagtgggcatttaaagaggtgctgatttgatgcttgtcactgagtagcagagaggacggggatgagtatgtgtagtttacacctcaatcatgaggaagtgaagaacttgtgctgttataagtagtatggctgtgtgaggaactagggtgttctgctggattttgaggaagtattttcaaatcaatagaacttcaaacttttcttcagagtgttgggctctacatggaaaaacacatgaaattaaaaagtggcacaaatgtttagttagtagaacatctggctaattgggatcaaataattcaaccatgtgggaacgtttttgctcaaaatagataattgtgaattgtttcatataggcaaatgattagacaacttcctcttcctcaaatgtgaacggacagatgtgatctagaagcaagacactcttttgtgtaaatattccctttggcctaaagcaaaagtggacagactttaaacacctgagagcagagcagtgtgtgttaagattgcaatatcttaagctcttgagttaaatggaaaatgaaaaacaaaagtgtatatttggaagttaggaatgttttctttaaaatataaaataaaattttagatttaagatcacaagaaatattactgaagacttatactcttcctggggctaagggaggtgacagtcgctcatcagaaaaaaaaaaatgccctcatttcctaacttttctaaaaaatattatacaagttcaggctaatacttcctgtatatgtgggaaatttctaggggaagctaacaggcttagaaataaagatgtgttaaatagactaccaaagtgtccaattaagcaacacgataccaccgttattgatattctagcaagaaattactagcaatgtttgtaaatagacttagaaatgcatttgatgaattaacacttttatatcttaatttatctgaatttttctgtaatgtgaaaatgttttatttaacttatttctggcatctattagtaaaattctgatgatatacaagcattaatatttttccatggccactcaattcatacataccttccctatctatgcttagaaggcagtgcaaaattagatagtagcaatattgattataaccacaaggtggagacagatgtcgtgtaatatgcagtctgctcatataaagcacattttcttagacaagagttttcatacgatataataaagacatctggaatttgtcttgtatgcaatatgaaatttgctattaaacgtggagttaaaactttatgtcaatagatccaataacaatgttcataaattaatcattatgtcatgctgtatttccaaaatactatcttaaattataagagcaaacgaggtaataatatattacacttaaaacattttttttttttttttttttttgagacggagtctcactctgtcgcccaggctggagtgcagtggcgcgatctcggctcactgcaagctccgcctcccgggttcacgccattcacctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaaaacattttataaaaatacaaaaaattagcctggcatggtggcgggcgcctgtagtcccagctactcaggaggctgaggcaggagaatggcgtgaacctgggaggcggagcttgcagtgagccaagatcgcgccactgcactccagcctgggcgacagagcgagactgggtctaaaaaaaaaaaaaaaattataagttattctatatccaaatggtacattttttaataaagatgtttgttttaactttttgaatatgaagatttctagttctagaataatgtttataaaaatatacaaatccatctggtgatgagttgacctctatcacaactagtttgcatatataacttgggtgtgaccaagcaaggtgagagttaagaacttttaaaacttactgtattatattgatagaactcagaaagtactaacttgaatattattattctaattgcttttcccttttagttattaaaaataagaatacttaaattaataacaagatcttttactggcaggattaaccaaattatctgtaatgtgttcctcgaatgcttttaagtggaaatatactttatacattctttaacaactctgagaggatgagttacataaatcagttcaggaatctatagaatctgtaatacatagtaaaggtttattcacaattaaaacaatttcacttctatattaaaaaaacaaattgttgaaagtacagtggcttttcatatgtatgatttgtaaaacaaattagcttttttaaagtgatgtgacgcttaatgagaagaaatcagtagagaattacaaactgcacttcaaaagatacatctaatatcattttaataatgaaatttgaaaaaatagtgtgctcgttttacagtctcattaaatgaattaaaatatcagcacacattgtagtaggttatcattggcagagaaggctgaaatagaaacgttacaatgggatgcactgccatctgaacattatgtcgaagtggaacgcggaaacatatttctcagaacaagtggtaaaatgaaaacagcatcatttgtaaagcatttcttttgagagtgcttcagtttcttctcctgatgacctgccattcagaaactgacaatgaataatacactctgacaccagcatttgtcaatttgcccagaaccatatgagagtactctagacagatatatgttccgaagtaaaccaaatacctgttaactgtaaatcaaatcttgtagaaaccatgccatggttcctttggacatatactttgcatgcctgaagcaagttaccttaagaaatcattcttttgttttacaaaacttgtattaaaaaattaaaaatgcaaaaaagcttaatattattaggaatttatccatagctttatttggaatccagtttctttattatgatctataaacatgcatcatttgatggagttccttagtggagaggtgtttttccatgttgctaagaaacatgccccagcaccagaagggatactacctaccatctttttgccatttctcaccgtgattcttacattgtacctgtttactcactgaacagggcttccttctctttgtctagattctaatcaggtgtcttctggtgtggaagctttggcttttatttacacacaacacagaattaataagatagatgccaaggatttagcaacattttaattcaacattatacaggtatcagagttaatgagaattatgcattagtctttaaatttgggcagcttattcagctaaaacatagatgtctagctcttaaacactttgtttttttaattactctgaaattacaataaagtcaaagaactgaactgttttcttttcaagccagtgcaaatgtgctttagttattattttactggtgatctaattatgcattttaatgctttattacttaatacttatataagcctaaaatacgttgttaatgtcataatttcagggattttagtattctttccatgagttaccataactaggtgcatatgtgtaaatatatgtatatatctatatctatatatttatatctatgtatatatcaatttataagactaaatagacttggccatatgtgttgttggtttatgcatacatgcacaaatattgaggtgtccacaaagtatatatgcctgtacataaattacatactggctggtgagtgaatgtaagcttctctaaattgtacaactctccacagagtggcactctaatattgcaaaggtacaatataagcatgtgcagaatgaacagctcttctaggatccctataaaactccaccccatgtttcttttgagtcactataaaattgatgactgaggcaatacacgagcaattatttatgcaaagcagtgtgaggaggtgcatgaggatccacttaataccaagacatatttagatttgactgccacttttcttcaacttaatttttttaaagcatttggtatgttgttgtggaattaaagtcctaattatttatcaaaataagtggcatagccacattgtttaatcattttcctctttccaccacgatctgtgatgcttaaagtatcctatattcagcagggaccatctatatcaatgagcacaatgcctgccatgcaggaaatacttcagaaatgaatggtgcttttgtcatcatttttgttgtcacttattatatttcagagttggaacctagtttacttttgtcaaagcaacgcactattcagtgaggaaaaagagataagcgattaagaatcatctctatgtcctttctcagactgataccactcttggtaacatggtgctaactctacagctaactgaggttccagagagaaatgtcccactataaactttccatatgcctgttgtgactgccacatttacatccatgtattaattttagaacttggttggcattgttcccaagtcatcaatattgtttatttacaagatgagataactagacattagttctgtgaatttagatgttttgcaagtgtgaacgaatatctattctcacatcaactcagaggaacaggtgcaagtaagatgctaaagaagaaggtatataatacctgaataaagtgtcttgtgtgatgttctccccatttatatcctgctcaccaaggaagaaggaaaacaaggagttacccaattaacttgactgtgcgataaatgtggcttgctggagagccatttcagcagaatttctggcatgcagtaaacatgtggaaagaagagacagtgaaaatcttccaaatgtttgagtcagataaaaatgagttccaatttagattttgttttttctaagttttgccatatgtatgattgaaaacaaattatctttctaagttttcattttctcatttttaacaagagagatcataagcatattgtagattattatgggtttaaatgagataccatgtatgaagtacttattatgtacttggaataaagtaagcagtagatgaataatattatttggttatggtggagttggcaatggtgagtgtaggtgaggtataagaagaggaagcagaagacagggagtggaagcaaattgctatttggggaccatagacaagaggtaaggctgtaagcagagatagcccataaaaatgcaagatacaaatccatttttggaatgcctttaaatatgtgcattagaaatctgttattttccccatgctgagattcattcatagtcagaagttgagtaatcaacattcagaaatatgtcattgagaccaggctacttattcctgaatatataaatggcaacgattataatttgtgactacattcattctgtagaaactacaggtgctgccatttcagctgctgttgtgcaatctttactgtgaggagtccagagagactcttattattccagtgccttcctgatgcacaacaacctatgatttgccctcttaatgaaatctgaagcatctcattgcctctgtatagggacaggctgtggacagatttagagcggagcttcaggaagtatcttatatgtgtgtactcgcctgagaatgatgttacagctgctgttatgactattactgtgggttggatgtggatgtcataattcagagtccctcttgtttcagttttgggtgcagtgatgttgaaattcctcttctgtacttgaacttctatagcagtcttctagctaatgtcttcaacttgtttctcttttctaaggaaagagcaccttctcttatgtcccttgttcatcagccagttaaaaaagcatcctgactggttcttttctaccctctccgatcaaccccaccgaagctcccaggcacactcttacttcttaacctagttgtagatgcacagaagatacataacaagtatgtggacaaagagatgagaaaaaatgacattaggggaacctgaagagtttattttggttttagagattatttgaagcaaactgctaaacatccaggtgaactcagagctagccaaggttctgaaagttcagtaaaaaatgttaatattgcatagctatgaaacatttaatgaatttagcaatttgggggactgtgttaagaaacagccctttaaaactgaaaaggccaacagttttcagaatttgtgagtctactcaacccttgctactcaaagtatgacttgtgtgtgagcagcaacggcatcattcagaagattgttggcaatgcagaacctcagggcccactgcagacctgctgtatcacatgtgcatttaacaggatccccaagtatcatgtgtgcacattaaagttttgagaatgactgtggtaaacacttagaatgtttgacattccaagaaaattatagagcttgggctgtagagtgacaagatgtggggtcaaagcctagctccaccatacactcctcattagatacctaaatcattgaatgaagcttactaagctctggtttctacaaatgggaattaggaatatgagcccttcccacttcaatgggctgttgtgaaataatgcagttagagaaccttcaataaaatgtcagttagcataattatatttgtaataattattcatattatattcattatagaataaagcgaaatatcataaataacttttttttttgagagagagtcttgctctgtcatccaggctggagggcagcagtgagatctcagctcactgcaacctctgcttcccgagttcaagcattatacaacatatttttatagggcaaggtggaatatccatttactagcatgggctacagtggtggttggaaaataacaaagagaattgcttagaggagggatagtgttttgttcatctttggatatctgtgactagcaaatttatttgggtaagagtaatttcagaggggaaaataaacacgtccccccacagcccccaccccagaatcaatgcctctcaaacactctgcatttttgaaatatggtaaaaaaaaatcacatcagagaagtgattgatgctgcagtctcttttcagttcagaggagagagacttctatccatcaatagtttggaagttctcaattatgtaatataaatgatcaagattaatcgccttttctttatttttcttctaaacaatgtccagattcctccaaaggacctcaatcgtcttcaggtgtaaatggtaacgtgcagcctcccagtactgctgggcagcctcctgcctctgccatcccttctccaagtgccagcaagccctggcgcagcaagtccatgaatgtcaaacacagtgccacctccaccatgttgactgtaaagcagtcaagtacagccacctcccccacaccatcttcagacagactgaagccacctgtctcagaaggggtcaaaactgctccctcaggacagaaatccatgcttgagaaattcaagctagtcaatgcccggactgctttacgccccccgcagcctcccagttcaggacctagtgatggtgggaaggatgatgatgccttttctgaatctggtgaaatggaaggttttaacagtggtctgaatagtggtggctcaacaaatagcagtcccaaagtgtcacctaagttggcccctccaaaagctggaagcaaaaatctcagcaataaaaagtctttgctacagccaaaggaaaaagaagaaaagaacagggacaaaaataaagtttgcactgaaaaaccagtcaaagaagagaaggatcaggtgacagagatggctccaaaaaagacctccaaaattgcaagcttgatccctaagggcagcaagacaacagcagctaagaaggaaagcttaattccgtcttccagtggtattccaaaaccaggctctaaagttccaacagtaaagcaaaccatttcacctggcagcacagcaagcaaagagtctgagaaattcaggactaccaaggggagcccttcccagtccttatctaagcctataaccatggagaaagcaagtgcttctagttgtcctgcccctttggaaggaagggaagctggccaagcttctccttctggttcctgtaccatgacagtggcacaaagcagtgggcagagcacaggaaatggtgctgtccaactccctcaacagcagcaacatagccacccgaataccgcgacagtggcaccattcatttacaggtaaggtggcctctgtttatccacagttgtaaatatatttacaggcctacatactcagagtgtaatagggaaggctgataaagtggtgctttatgtcgtcattttggagtaaagtttcatgctaaagatagaggcctagaattcagtgcggaatcttagtctggaaaaagacttccagtaggatctagttttattccctctctcattccctgtcagcaattgagaccttcaaaaattgaattacttgttatcaaaagccagctagaaaccagatgccacaactttctcttgtgtttattcatattattgctactactatactgcttctattactagcggcagacttttaaaataattctcacttttacatcgtttacggttatttttgttgtcatctttgggagaaagtataccataatggttaaagaggcagcctctgaaatgataaagttgcggatttcattcctagttctgccacttttcagctataagacattgggaaagttacttaacattctttagtctcattttcttcagctgtcaaataggaaccatgcactactttgtagagttgagactattaacagaggtcatgcatataacatgtttactgtatatcctgatgtgttgcaaatgttcttcaaatgttatttataagatattactttctcagtgtaaattttatattaatttcccacagcaaggcataggtttctaggtaaaaggggttacatatataatttgtattacttatttgggttgtattactgatttgttttttttttaccttttatttatttattgtttattttactttgcattcttattttgtaggcattgaaatacacaatataaaatttttaaatgcattattatgcattttaaaatatgcatcctaccatccaaatggtaaagacaacactttgcttgttgttctgtgatttgttttaatcgattagagatatgtcagtaactgctgtgtccccagtttattcactgcttggttggtaaggagatggcctggggagcaataatgtctgctttgtccctctttcgggcaggttggcaatttaactacagaaagaaaattttatgaataggaagcaggacccactataattaagaaagggtcaaaactatatagtttaaaattttattaaattttttgaatgtaaaagtttttaaaataaagcagtttatactgatttatttttttgctcaatgaggaatgtaagtgctttttttctgaggttttttatacactcagcaaaacaaaattattataattattacatttaagctcttgggacattacaattgaatgttgctattctgacttcaatagtactaactcatttaaaatacttgtatttggatcagatgggagtctgcagctccttctgactccagggtccctgtttgacaaagcagaatttaagatgtcaaaatcatgatccacatttcaaaaacgtgagaaaaaaaatcatgaagttttaaatatgtcatactcagcacacttttggattacaaatatattctgtaaaaacatcaatcctttcaaaaaatcacaagtgaatttcataggaaagtgtaaatctagaactgctaatttagtaggcttctttctataagtagcaacaagcttttaaaaaaattgtttgcaataaaatatccagtggaaacaaatttagtggtttccatttgaaaatgtaacttttaaatatcaaaaacaggaagcagcacagcagcacagcttagaagttacagtgtggatccgctgtgtgaacctgatgagttctttgagaaactctttgagtttctgtttgacctctttaacaacaagactataaaagtgaggcagtgtagccaagtagctaagaaaagaggcattagagaggctgaagcaggaggagaatcgcttgaacccaggaggtggcagaggttgcagtgagctgagatcgtgcatttgcactgcagcctgggtaacaagagggaaactcaaaaaaaaaaaaaaaaaaaaaaaaaagagaaaaaaagggcgatagaatatgtcttactctaccattgttcagaaacagcatcttgtggtggtggttgcctaggtgggaatctcaatgccaccactgatcagttgtgttactttgggtcatatatgtaaagattctgacccacaatttcctaatctgtgaaataggtatgataattgtagaagctacctcattagcctattttgaagattgagttgatatttatctgtagaacagtatctgccacatagtaaacagccttccctaaacttcactttctaatcctataaagtatgattgataaaggatgcctacctcgattgattgtatgaaagattaaagaaaataatcccatgtaaaatttttagcacacagccagattttgagcaaattacatgaatatcagtaattatttttattattatcaacaatataagatagctaaaaataaatgaaactatggttggcatggtggctcatgcctgtaatcccagcattttgggaggccaaggtgggaggatgacttgaggccaggactttgagaccagcctgtacaccagagcaagaccctgtttctacaataaataaataaattaaaactgtctcataaaatttcacattgaagtctatatataaagtaatattcattcaaagtttttaaatcaatgcagaacaattttacaaataatatgtaaatcctcaaaaggcagagtggttaatattcattcttttcagctttcagtaaaagcttgtttatagagtcatgacatttggattatgtaaccttttatgttctttctgactttcactgttctatccccatgtaagaatccctcctataaaatccctgacaattatttttggagttgctaatcatttgatgagataagactaataatttactttttgatgttggtattatcatttgttgagtgcttacttagtgaaaatctttgtgtcacaaaatatatgtgaattttctcatttaaacttcatcatgaactcatgagaaaaaatgtcatcccccattttccagaaatgaagaagcagagatattaagtcagaatagtaataatctcttcagatcataaagctagtagaaatttgctttgcttatcagttctatctatgtgacagaaataagaggtattgttactgagaaaattctggttaggaaaatgccaatagtacacttgcaaaattctcaatcagaactcatttataattgaaaatggtaattgctgttaattagtataaattatataaatgtatacagatacatatatatatgatatgtaaatataattaaataacttttatataatgggaagattgatggctgatggtgactttttttctcaattctaggtcagtacttattccttctgagacttcaataaatgcttcatagtactctttgtcacacactgggtgttcagagttctataaatataatgtggattctggaagttaatagatttcctattagcctaacttcctatctaatataaattattctgtacatagtttcagtaattcaattatctctacagagtgataaagtagtttcaaatttgctgttattcttattcatttatcaaatagatataactaagacaaaatgtcaagaattaaagaaaatattttattttggtttaagaagttcctgataactagagctacctgaaattggaataggctgctttttatagtgttaagatggccatctgaagtatttaaaaagtggcaaagtgaccagttattacagtttaagcaaagggaaattgctgcatactttttcatttatgtactcatccctcattctacaaatactgtgtaacagaagatacaaagattttttaaaaaaatctctgccttctgggagctcagtctactaagggtagtaagaacaatatcatcaaaaatattaaaccattactgttatggaagtgtatgcaacatacacaattaatgtagaaaaaaagagggttttttacaaatctggcaaaatggagtaaactaatgcatcaccaagaagttaagataagggtaaggcataaaagatgagttacagtttgtcacaaggaggtaagaatgttgtgctatcatccgaatttgatattctacaattttataatccaggcatgatgggaaaaataataggtaaattgtgagctgctatgcaaatactagtaactggaactgctatagacactaatggttaggatttgtaattatatgaatgagagactatattagtcagttttcacactgctataaagaaattcctgagactggataatttataaagaaaagaggtttaattggctcacagttttgcatggctggggaggcctcaggaaactaacaattaaggtggaagacgaagaggaagcaaggcacgtcttacatggcagcaggtgagaaagagaggacatgggaaactgccatacacttttaaagcatcagatctcatgagaactcactcactatcaggagaacagcatgggggaaactgctcccttggtcccatcacttcccaccaggtccctccctctacacatggggattacaattcagatcacaatttgagatgagatttgtgtagggacacagagccaaaccatataagatactaaagaagaaaagaaatggaaataatttagattttgtttttctctttcaatgaccccttctccatacatcaaattttcagctagtcttcctaacccttcttctgaaacataccctcaatcagactttctttccatttccagcccttgtctcctagtccaagccacaacaccaccaattctcatctagtttccaatgagtctcccagcttccactctgggctctttgcagtaacatccttcacacagatggcattttgaccttctaaaagcgtaaatcatatatcttattctaattaatgaagccatctattaggtttccattacattaaaaaaataaaactcaaacattgcaccatgaccctccaggttctaagtaatctaataccctgttcacaattgatccccacagccacatgcagtcccaccttcccccagcacgttgtatctcagccttcatcctccttctcaacaaaccaacctatattgctttagaacatatctttggcatatatgttcatttatgactgtaacaactgtcttctagatcactgcaggcctgtcttgttattagagctctgctaatctccagccatctccaaccacctactccaggggaatatatattatgcgccttctcagaattctatttaatcatcctcttgtattttctttacacagtttattactatctgttcttttcttgtttacttattaactagtgtgatttcagccacctcctaatgtaatgtaagttcattgaaattaagagtcttgtctttctcatttagtagcataattgcccagtacagaggccacctacagtagataccaaataaaaattgttgaatgaaacactatcatcctgtgttagaatcacttgctatagaagaattttcaaacctgccaaaaatgtacactggaacaaaaaaaaattctgaagtctctcacttcctataaatgggagggtttaactgaaatacaaagagctttaaaatatttaaagaattaaaccataccttctcttcagcacattcattcacttattttttatcttctttcaacaactacctactaaatatctcttatgcatgagacatcaagaattgagtgaaaaaatcatacgtcctatgtcgttttcttttcatcatccacaatgtggtagacaaggggcaagctcaaagagaacaacaaaatgcagctggaagtgtaaagctccccaggagtgaaatagatttgttatactgaggcttcaaaaaagtgaaaagttacttttagctattggaatcagggaaagtggcacttgaactgagtccagaaagataagtaggatttggtaatgcagagatgagggggacagggagggaaacataaggctgaaggaaccacataaacaaagtcaataaaagatacgtaggctggtcggcaagtaggtcagtttctcttgaacattgaagattgattggagcctggttgtagtagaaattcttgaatgtcagaaacttggactttatgtatgtatatgtgtgtgtgcatacatgtgttcatgcatgcacatgagcatgtgtgtggaaagcatgatcagaaaagttattctttcttcagtatgtaaaatggattgtttgtgggagaggtcagagtaggatgaaccaggttaaatgtatagatgaaggagcaatttactgaatttcttaggtttgttaaatctcgaaggaggttccagttattggaagaaaagagaaaggagaaccacatagttttttcattctgtttttttaaaactcctttttttattgttcctcttctttcttggtgtccatcctgagctatataatttgaacctgtttttcctgcctggagttcaaatattgttaccttacatccttcagactttcaaaaaatacctccctttttcccatatgtcatttttcttccattgcttttgtgttaattacatcacaactatattctacatgctttcaaggacatgtgaaataaaataatataataattggttaattacagagaaaagggagacctgtgtgttttccctaaacctgtctctttagaagcctccaacaaagttttgaaataatgcttacccagagttatgctgttttgaagtctacattctttcttttctgaccatttgtagtaaataccaaggaaacaatgcattggacataaagcaaacatgaagaggcaaagagagcagaatcagggttttgagcagttctcaaaaaagaaaaatacctaacccttagataaggcaaggcactattcataaggagaaaagtatcatgcttcttaagcccattaattaaatataagcagagaccctctattaacacttgacttgtaaaattaggtcaagaaaatctgaatttagagtttttccttcttttgatataatatgctgtactttatacaaccacaccatggattctcagaagagatttttattataaaatatttctgtgggactatagatttgcctaggatgtgacagggaaattgacattttaatatgctattttccaaaaggtggagaatgcaaaacattagttttgaaaatgcttactcacaaggttttaagtttggcttatttgtcgagctagtataatgaagaggaggaggaactgtgagtttacaaagattgaaatgtgaagcctttaaccatcattcaggtaatgcttttgtaagccctgaagctacttctacataatataccacagtaatggttttatgtgaactgggcataattgactatcagtaaaaactaaagcttattgaatgcttggcttgcaagctcgtcttttgctaggtttgatatgtatctgcacatcaggtagtgatttgcatttcctcgcacagcggtatttttaggatggaatatgaacacactgctagaagaggcacttttgtgtagaatactaccacgagtcggcattttcccagcagagccagcagagaggttcacaaactaccttttctgtgcttgattacgaggttcatggcaagattgcctaaccaaaccattgttatttcttctcttcatattttatgttatgtttttggaaaccattttaatcttacagaaaatttgcaagaattgtgcaaatgactctcatgtacacttctcccagagcactcagagaacttattcatatttcaccaagtttcaccaaagatggtcacttttagtaattcaggataaatattgcacctagtagctgtcacatcttctgaatatccctcaatctggaacaactgtttagcctttccctgactttcatgatattgatatattgatggctaggcattttacataatgtttctaatttgggtttgtcatatagttcctcattattagatacatattaaatgtattttttttgtcaggaatgtcatcgaaatgatactgtgtttttcctgttgcatttcattgggtgtttcatgatatgaatatcaatatcttccattttggttgtgttgaatttgattgcctgattaagataatatctgccacaattttatattctaagtgaatttgtctccagttgtatgtaataggtatttttgtgggaagatattttgagactgtgtgtaaaaacgcaattttgtatctactttgacccacaagttttagcatccgttgagctttgttgcctgaattaataatgtgcaaaaaatgtcaataattaatgacaactggttttctaattccatcctgtcttctgcattttctctctggcattctactttaagaaagagatgtattttctccccatgatctttctatctatttaaattgtatggacaaatagatttctactgtatttgttataattcattactatcacaacttactttgatgcttaattttccaagatttggccactgggagccccttcaaactggctgtgtctcctttccaactgccctatcactctttgagaattttctttctttatggctcaaggtgttctaggctcatcttgcacattccctaacttggctttagatcctattcttttctttaaggaacttgtatgtctttttgtatagggtgattttagaaaccaagatctcattgctcctaggttttcttggtggacaaaaccaagaaatttatgtatgcatacacacacatacatacatacacatacattgaagcattatttattttgatattatatatatgccttattataattcaatgtgattattcacatatacatacattcataatacctccaattccaactcaacaccacagtttatttttctttccatacttgtgcctctttttgtcaaccatgagaaacttggctctcattattctcaatatgttttcttatttactcaactcccctgaatcgagtaaatcttccatccacactagacttctgttcaacccaacagtttcctggccttggccctgtctgtcacctgtctgcctttccagaatgaagaaaataggaaagcaagcacattagtggtttttgaaagatatgtgcttttctttcctttttgttggggttataaacaggaattacaataccattagttaatgtttctgactcaaatcagttctacttgtgtctacatttgtgaccatatctatatcaagatggatccacagggggaaatatttcttgaatacaaatcagtatgcaaacattcatgtttatgacattaaagattagaggtttgatagtgtctaggatttattactgagttccttttaatgatcagtacataaagaataacatttaggttagaccagtggaagtgtcacatttaacgaccgagtgactgagctgtctgttagctaagggaacctcaaatgcagtaaaatacttagttcagaggcattttcatggagttaaactgcagggtagtagttaatagagcaacatttacaggtagccagattcaagtactggttaagcatctactagattgttacctagggcaacttatttgacctctagatgtcttaatttctttatctgcagcacctacattgcaagattattgtgaattttgagtgataggctctaggaaaatactaagcaccacacttggcacatattaagtgcacaaaaacaggtaatagctctcatggtaatcactggtatcatgacttttaattactacaactctcagtaacagatgaaggacctggcttattagaattctaaataaattatactctggaggctgaggtgagagcatctcttgaaccaggaaggtcaaagcggaagtgagctatggttgctttagtgcgctccagccggggtgacagagtgagaccctatctcagaaagtaaataaataaaagaaatccagataaactgtttttgcaatgctgtatcttatagtttcaatagttactcataacatgatgaccatgttgtaaatgcacagtaagattgtctacataggaccatgttgctgaatattttgaaggaatattatgatacatattttttctttttccagttaataggaagagaatgcattatcagtttatggggaaacagtgaatgtgccactgcattattcactatatctgtcaaaatgtactttctgattagaaaacactcttgattctaaagtctttataaattatttcatgaatcaacccaaatatttttatttaactggtacaaatcatgcataaaaatagagggtatgttgtgcgtcttcagagatttaactcaacttctttgatcatttgcataaaaggtacatctttaccagttggcattgattgatcctctatagactggagttaaaatctaattttgccataacaaattatgaggtggaaatactagagaaacggatggcttgtaacatcagtagacatttctggtcccatttccatgtgaatataaagcaaggatgacttctaagtcctttttacagtgatttgaagtttaccttcaccatgttcctttctttcatcgatcaatctatttccttattaatgctaagttagatcactcatgtagggaatttgatgagaaatacaccagagaacttaaggtaaataagagtctcttgtgacttaaactaaaagacataaaagagtgagtctgccaaaaatatgcactgctacattaacaaaaattttaaaaaggcttccaagacaagactgagctgtcacaagtaggaatacatttttttaaaaagcatgtctcagacagggggaatgggaacttaaccaatggaattaagtcttacatattgaggaagatagctgtaagtcagcttctgaagaattctttttaagagctgtttgcttttagtagagcaaaaactatacggctaaaatacattccaagttttcttttactccagactttcttagatggagatagaatcttttttaactaacatggccagaaacattcttgctcctgtgacagctgttggtcttgttctcataggaaccaattagcggtgggctttagacaaatatttcagtgaaatgcttaatgtgactcagcttctaaaagataaatctgtgaatacaaagtctgcaggactagaggtcaaccctggctcccagccagttcaacaaggtgctgtgtctctgtgacacttctttgcaggcagccagtcagctttccctggggtccacagtttcactacatactctccatttaaacttcttcagcaagtaataaaaatccttagaacacttcagaggattgtttttcccttcgttcagagacaataggttaggcaagaggtcagcgaggggtagagtggcccacaatagatgaagccaggtggaagaacagactttagtagactttagaaacgaatggggagggactgtcagtagatgggggatatgtgagaaattggggtccagaagagaaagaaacagcctacacaaagagcagatatatttgctcttttaatattgaccagaatttcacaagagagaatgtatttccggtccttttgtaataacagttgatttcacaattattttgcaaggcaggcattttttcttatttttacagatgaacaaacaagttcagagaggtgaagtaactagccaacatcacatgagttagtaactgattagtgatggggtcaagttttacacccaaacccagtatatttacacatatgctactctttcttgcatatgttttacccaccaataattttgttttaccgttgtggctaatattatttattcatatatttataaaagatttgttgactgaaacttatattctgatacaagactggacactggggatacaatggtgagttcaaacatggagaatagcgtctagtctgggagttaaacattaatcaattaattacattaatctcatatcacaagagtatgaagttctgaaaacataggtccagggaatactaagtatgaagtgcttataattggagactttgcctgatgagcgaaattagggaggaattttttaaaaatagtcacttgagctaagacttggagggaaggaatcaactggatgaagttgggaggaaaataatcaagtgtaaagaccctgttttggcaggaagctgtggaaagtgggtagaagactctggtggccacagtagagagaggagagaggagtcttgtgtgagatgatgctggagaccatcatcccataggttgcgtgggacccaaccatgcaagaccttgtaagttccgtaaagttttcaccagagggctccatgaatcaggaccaggtttgttaataaaatattatgactttagttctataaatgatgggtttgaagtatttttgtgacagccaagaagaaatgtcaattagacagtctttatatacattgggaattcagagtaaagtgctgggttagagttagaattttagaattcaggcataaataaataataaccaatacaatgaatatgattgagatcatttagagagactatagacaaaaactggaagaagaatagaatattcctttgctgaactcccgcttctgctctctgtatccccacttctttttctactacccagaaccacaacatttaatgattatgtagaggaaaacaatagaataaagtagaatccagagaaaatgggaaacacactggagaatttttgccataaaagccaaggtagtacagtttgataaaggaaggaatgggctgctgttctaaatgctgccgagataccaaatgattggaagactaaaatatcttttaaatttagctactttgaggtctttttttctggccttaatggtatatatcctatcatttaaatagtacattttctttctaaatttgtttatgctctttatattcagttttaagctagaataaaataggaacagtctgtcagaaattattggagtccaaggcacaactttgtataggaaagtttctttcttgtatagttctttctttcatatattaattcacatatataacacatatatcaatacagacaacatgtagttttccatactttattaaaacctaagtgaacttttaagtttctaggactgtcagttaaatattgactatttctaatatcaatgattactttttttctcttgaaactcaaatttagattaaaagcaaaatgttaattaagcattgattcaaaaatataatacatttttattcatatatgaacattatttgtaaatattcttaaagtagtaaatattgaaagatcacttgtcatggcccagacctactaccagaaaaaaaaagggtagaagtaaggcaaatgagatgtctctaaagaacacagtccagtgtgcaatcctatattacctcgcctccttctgtgtcttagtagttcatgccgtgaacatttaaaatgtgtgttagtttgtgtcaaatatacgtcgattttgaagctgcatcaaatagaaagcatatcttaaaatatttacccatgcataaagggaagaaacatgcatgaagtatgattagaatatcaaaagtattcaggacctttgttgagtgcttttcttttaattagacacactctttacaagttaaccacacacacaaatacatacccatgtacatacatagacaaatgtgaaacagatgatatgaaaggtaattgtaagaatgagaatttgtttctggttgactttaattgctctgaaatctttggtaattaagtcatcataatgatgtataaagtctagaacaaaattattttttatttttacacatattttaaaatatattttatagaatttttgttttaaaaaagaattttaggtgtgattttaatactttcactattctcacaaaaaatgtaatttggccatatttcctctaaaatagcaaaagaagttggatcttttaaaatattttgctcccaaattataatcaactattggtagttataagcttccaaatttagacaagcctaagaaatctaattccacatctcactcccacttaggttgtgtatgaaaaataacacagttctcctatacatagacagctctggaacattccagtcataaagaaatacttaccttgatggaaaatttgtaattaatatttcttgtagaacttccactttgatgagtgactagtgactataactgctatttctttctattttcatggttaatttcagggcacattcagaaaatgaaggtaccgctttaccatcggctgactcctgtaccagtcctacaaagatggacttatcatatagtaagactgctaagcagtgcctggaggagatatctggtaagtgacctcatcgatgcataggtcaaacctaggaatttccgtattctctccataagactttttattaaatcatatatgtggtatactgtttttagtgcaaaaatggactatatacatctcatgcttcaaagatcattaactatttggctattctgcttaggatgatctctttgttactataaaaggaatggtagtcctttcagaagtgaagactttaagtcattttgccctcagtcaagtagttgaataaaatcagagaaaacctggataatacatttggagattgaaaataaactaatgattggccatgtatattctccatggctaatgcagcctgctctgtcatcaattctgtatgatttaaaacatctctacagggtggcttcaaatgaccattctaaaaaactctgaaaaggaaaatattttattatatatagatgatgtaagaaaaaaaatacatatcccagacacagttatcatgtttttggtgtgtatcaaatgggatgctcagcttgagcacaatgttttctctagggtccaggtaagcctaagcatatatggaaggcatttagtttaatttcattacatatagatctatattcgtgaggaatcaagtaacctcctagcaaaatatattgcccctaaagggtgagagagtacagagtactttatctgctcctaagtataataatgcatgaaagtaggggtgtgtctgttgttccaggaaatctctggtccaagcctgtgtattcacagctaagttcaaatgaagaaaactaaataaattatttaattttaaaaaattactgtgtactccaaagactcaaagtataagtattgctatgaagctcaagcgactctatcacaaatttgggggttaagaaacttccccacttcggcagacctgaaaaatatttggcaagcattagacatgactacagcatcctgcagtggatactgacaacaattacagaacaacatcccaagggtacattttggaatcagcattagttgataacattaggcgtcagaggtttcatatggagattacaacaaaggccagttctaggtaggggtagaaatggtaatgccaagacacagatatagggctaataattgtagatttttcaaatacatgggggatgtgttgactttccattaactctgggtagtaccacggtcaaaataatgctatgtgtctattatgaccagatgttttataaaattagcatggcatgaagatgtgtatgcctcatatatttatacataaatgtcctcaaattgcatgttttagcactagagctcaaatctttaggataaatgaatttagtagagtttgaattgcaatttttttgtgaatttcacaaaggaacactgttttcagaaactaatatatcacggtatatctgattgaatagtctgtatttgatgtttttctccacttccttattgtctaccctttgatcactttttcatttttccagttgatatttccttttaacattctgatttttaatagaatacctgaaagtgaatataaactggcaattaatgtaataatttaatgggtttatcagagagcataatatcattttgcagcaataatcaattatttacataaaatcatagttttcagtctaggattttgataagaattcagtaaaagaaagaaaacagaaaataaatggtacagtgagacttgtctaattatgtcaatctcactatcatctgtttaaatgcagcctatagtgggatagtgaaaatgtctctcgttgcttgagatttcctggaagaattgtgatattatttgcagttagtaagttataaattgagtactataattgaagaaatttagatgaggaaatatgagcaggccagtgataagatgactatcacagagaaattagattacatatcttcatcattttaagattttggtttatgggtcactattactctcttaccatttctgccttaatttttagtgattttagtatctacacgggtgttctttctaacaccttggcctctcctcccataattttgtgttgcagtccctcctgagcttcttattctcatcatcataccctagatctaggcaccatcagaaactactacttctctatgacctcactttcatgcactgcactctcactgattatatactcctatcatttcagtattcttccttttgttccctaactccagcaatgattccactaggatttccaattcattgatcctaccactttttaccgttcttcaccaacctccgcatatttttcttctctccttagctgaattcctgtaatgagtgaatgtatttttatttttatatatcctaactccattgcctctctctcacttaattgtactcatttgatgaaatcatgacctggttacatttaaatctccacctattctataccaacaatgaatgaaccaggagaaaacacaccgcatgtcaatgcaactcactttacatatatgacctccaacctcaagtgactatgtaatgctcctggcagtcagtctattttttatacctttttttctcaaatgtccgacatcaccagtcccatcctttctcttaactgacaacctggatatgtacttcacttaaaaaagtgaagcacaaagaaaagttcatgaaccactgtcatcacatctacccaagtaaaacatatatacccacttaatacctatttactctgcttttacttagattactctctcttctctttaatagctccctcccaaccaaatcacttattttaggccatagcatactatcatttctccaaccttaatttaaaaaacacaacttcctggccgggtgcggtgtctcacacctgtaatcccagcactttgggaggccaaggtgggcagatcacgaggtcaggagatcgagaccatcctggctaacggtgagatgccgtctctactaaaaatacaaaaaaatagccaggcatggtggcgggcgcctgtagtcccagctactcgggaggctgagacaggagaatggcatgaacctgggaggcagagcttgcagtgagccgagatagcgccactgcactccagactgggagacagagcaagactctgtctcaagaaaaagggggaaaaaaaaagccacaacttcccttgaccccaaatttgtcctcaagtactgttgtgatttatctccttctcttatggcatgctgtaaaaagagtacggttcaatcacagtctcttaggcttttagccccacttctccactggaactgctcttattgaagtcaccactaatgtcaacatggccaaatccaaggatcaagtctcagggcttatcttatttcacctcacagcagctatttgtcctcttctaagaaggtttcttccttggtgctatagtttggatacagtttatttggtctcaccaattctcatgttgaaatttgatttccttggccaggcatggtggctcacgcttgtaattctagcactttgggaggccgagggggtcaggtaatgagatcaggagttcgaaaccagcctggccaacacagtgaaacctcatctttactaaaagtacaaacattagccggctgcggtggcagacacctgtagtcccagatacttgggaggctgaggcaggagaatcacttgaacctgggaggcagagattgcagtgagtcaagatcgcaccactgcactccagcctgggtgacagagctagactccatctcaaaaaaaaaaaaaaaaaaaaaaaaaaaagaaatttgatccccaatgttgtaggtggggcctcatgggaggtgtttggatcccaggggcagattcctcatgaatggcttggtgccattctcctgggagtgagtgaattttcactgttaggtcccacacaaactggttgttaaaagtaacctggcaccttcactttttcttgtttatgctctcaccatatgatctctgcacaacagctcccctttgcctttcactgtgagtggaagcagtctgaagccctcaccagaagcagatgctggaagcagcttcttgtacagcctaaagaacagtgagccaaataaacctcttttcttcataaatcacccagataatcctttatagcgtcacaaatggactaagatacttgattttcagagtcatgtatcccctctgttttcctcaaaccttactgttcctttttggtttccttttctagttatactttttttcttgatgatttcttatgatttaaatgatccaggtctctgcttctaggtttctctacctataaatgtgatttaatatcgatattatctcatggctttaaatttcatctatattctgatggcttacaaatgtctctctctgcactagttctctccccggaactctggactcaaatatccaactgccaacacaatctttccgcttgaatatctcacagacacttcaaacataatatatcccaaactgaacctctgatattaacctagcaaattgtacccctcgaaaactctttacccaagtcttctccattttgattaataagaatttcatccttccagttgcccaagcctgaaaccttagagttattcatggctcctttttaatgcctcacacctgatgtcctgatattctattcattatagtatatttttggctccagaagtattgttttctatttgtactcagaaacaaatggtgtatatgaatcaactttttaggatatttctcagtacttgaactcttgttattttctcagaaattcagaaactgaaaaaatttagatgacacaatattgaactaactataagaaataaggtactaagataccctagaataattgcattttaaaatatatccagaatttgccagttcttcttttttctacttttatctattaagtggcatcaccaatggatggttagtatatagatagcattcaataaacgcatgtaaaatgaaattaatataatggatgtagcattaaaatgagaactacgctaaaaaaggaacctaataattttcagaggaaaacagtaaacagaaaagataggacttatatctttggctttggaaggcactcaggaaataatcacagtgaacttatgaccaattatactcaactgaaggggttgatataaatggaaaataaaaatttacttttgattatgccatcactgaataatcaaagaatatgaggaagaaaatgtttagttattctacagaagtaatgttagagttcagaagctctccccgttgagctgggattttaagacagcacattagaaaatggaagaaagccaagaatggtggctcatacctggaatagcagcactttaggagaccaaggcaggacgactgcctgaagccaggagttcaagaccagcctggacaacatagtgagaccctgtctctaaaaaaaaaaaaaattcaaattgttcaggcatggtgctgtgtagcacatgtgtagtccaatctactcaggaggctgaagagagaagactgcttaagctcagaagttcaaagctgcaggagtcatgatcatgccactgcactcaagcctgggtgacagagcaagaccttgtctccaaaaaaaaagggtggggggccgggggagaagaataaatttgtaacacaggttgaacatccataatttaaaaatccaaaattcagaaggtcccaaagtcataagtttttgtgtggtgacataatgccactagtggaaaattccaaacctgacctcctgtgacaaattgcagtcaaaatgcaggtgcacaacacagtttattcagcattctcaggggaaaaaatagtctgtcagcccctttagctgctatgtatcttttccatgcacacccacaaagggtaatacaatggcatgtgtgcagaatggacatgccaatggcaggttccccacagtgccccacattgggtcaagacctatacgcattactctgtggtttttgttttgtttttgtttttgtttgtttgcttatttttcattgtgtggcataaagatattgttgaaaatgtcaaaaaggcctgaagatacccctatgggtaacagtgataagaaaaaaaggaagcgtttttttttgttttgttttgttttgttttgttttttttatagcacagaaagtcaagctgttggagagactagactgtggtgtaagtgggaaacatcttccagaagagaatggtgttggaatgaccaccatatatgacctgaagcaaccaaaggataaattgttgaaggtctccattgaaagtgatgaacagaattaatgaaaaacagaaaaacactgcataaagctgaaaatgaagatctcaattgtgtattgaaagagtggatccatcagtgtcacggtgtacacatgccacttaatggtatgctgatggttaaataagcaaagatctttcacaatgaactggcaattgaaggaaactaaatattcaataggctggttgtggaaatttaagaaaatatatgacattaaatttttaaagatttgtggtgataaatagtgaaaacatacattgactagttttccaagatcattgccgatgaaaaactgactctggaaaaaatctttgatgctgaaacaacacaagttttgatgcctcagaaagatactgacacagaagataagacagcccctacaggaagtaaggatgccaaggacggagtaactgagattggatgtacttatacagcaggaacccataaatgaaaacttgctgtgataaccaaaagcttgcatccctgctgttttcagggagtgaatttcttaccagtttattattatgctaacaaaaaggcttggatcaccagggacatattttctgttggttttgcaaacattttgcatcagcaattcttgctcactgccaggaagctggactgaatgactgcaagaatttatttgattatatttattctactcattgtctagctgaaattattatcaaaaacaatgtttatgccatgtactttccccgaaatgtgacttgttaatttagcccagtgacgaggtgatccttcaatcgaaaaagaataaatataaaaacacttccttaaatagcatgccagcagcagtgaacagaggtatatgtgtggaaaattttcaaaaggagtttagcatgaaggatgtcatatatgctgttgtcaagccttggaatgcagtgactaaagacatggttgtacctgcctggcacagcctctggtctgcatctatgttcaatgatgatgatgaaccaggtggtgactttgaaggattccatatgtcaaatgagaaaaacaatggtgtctgaccctacctattccaaaaaaaaaaaaaaaaatactttcagagtccataagtaggctagaaaaagtggatatcaaagaaatttttaacattgataatgaggctccagttgttcattcattgaacattgataacatagccaaaatggtgctgaattcaggtgactgtgataatagcaatgatgaagataacaatgttaacactgcagaaaaagtgcctagagacaacatgatagaaatgcatgatgatcttagtgaagaactagagcagtgtacattcattacagaacaataaattatgccagttgataaaaatcagagagatttctaagacaaaaactgttgttaatgaagcagatgactctggggtaaacattttaaaaagctacacagcagaatgccacctcatccctaaggggcccacttcccagtccctcaactgcttctgatgtttcttctcacctaaaaaaaaaatacagtgtacagtaaccttttaatccaaatacagcattgaatgtagagatggaaagcttgtggttgtttgtggttgctgttgtttcatagctgatacaggtattctggcaatgctactgtgctgcttagtgaccttgaacacattattttttcactgcattaatgctatgtcatattttttattggtaagtacttatgtataaataattgcaataaaataattgcctattagtagcatataaattcagtcaggaatgatggtgatgccacaaaaccacagattgtacaatcctgttaggtgactgagatagagacacctttgatttctgatggttcaatgcacataaactttgtttcatgcaaaaaatttttaaaaatgtatagaattaccttcaggctatgtgtataagatgcatatgaaacataggtgaattttgacttgggtcccatccccaagatatctcattatgtataggcaaatattccaaaatctgaaaaaattcaacatgcaaaacacttctggtcccaagcatttctgataagggatattaagcctgtaatagaataaccctataaaagaatgaacctctcagaattctaaagctcatgagatgttttctatattaatgatgcctctctttctcagaatctccatcctttattggctttcatctttctgagttctggatgctagtgaaaccacaaagcactaagcacctgaatttattgccaggtcctagctcagactggcccacagaataccccttccaagactgtttgaaatgtggaaagagaaatgttctaggaattggaaaaaataaattttggcttcagcactgcaattatttagcgattatttggcctctgcactgtgaattgctccctggttcccttttctgtgtggtgaatatgatgatacttaataaactcagaagattgttgtgaggtatggtattattcctccatcagtcttttcagtaattatcacctggcatcttacacatgccagacatctcaaaatttgggaaaacaaatgtgactaagaagtgagctctcctttgaaaaagtaagaaacaaatagataaaatttaacaccacaaataaatgaataaataggcacatggaaacaactaacttagctgtaaagagtcatgcagaacttaaaagaagatcagacatgcatattgtagaattctaatgaacaatgaaattgtggaataacatgaaaataatgggaaacaaattcttcttaacttactcttttcattagtttctttttgtaaaattgggcatttctcctaaacttactgaggtttcgatagttctctgattttctgcaaccccaagcttcaacactattgttattgttgaacttttattgctcatggttgctgtaggggcctcagtgaggaataattctgcttcccaagtgaagtggccttcatgatacagaattctgaggaagttagtcttgccagggtaagatgcaggctttataaatttgtgaagtctatataacattcagagtcctgaaaatagtacagaaaataaaatgtatagtgtctagaaaggggtttaggtgagttaggagttctatagcttaagctctattgctgtgtattaagcctacctggaagtactggtgtcgttttgtgtgtctggtatccattgccccatcttctgataacagcaccttgattttctttggggagaattctctgctcatgtgatctaactgaaattgatataagtggagccaatgagaacaatctattcattgactgcagtgactgtttgaggactggatgtgtgacccaatcaagtttgatcagaacaaataagactcaatctcaggacttttcctgaggttgttataagagaaaatgtggcacatatacaccatggaatactatgcagccataaaaaatgatgagttcatgtcctttgtagggacatggatgaaattggaaatcatcattctcagtaaactattgcaagaacaaaaaaccaagcaccgcatattctcactcataggtgggaattgaacaatgagatcacatggacacaggaaggggaatatcacactctggcgactgtggtggggtggggggaggggggagggatagcaatgggagatatacctaatgctagatgacgagttagtgggtgcagcgcaccagcatggcacatgtatacatatgtaactaacctgcacaatgtgcacatgtaccctaaaacttaaagtataataaaaaaataataataataaaaaaaaagagaagtggtctctttttccactacacctaaaactaacaaaagagaagcttagacctgctaacagtgacctccaccctcaaatgaaacaaacatagaggaaacagaacctaaatcaggagagaccaaattcaaggccattgtcggaaataactgagcccctgaaaaatccatgtctgaaactatttctcctctacttttgagttatgtaacccagaaaaaagtctttttgtgcttacacaaatgtgaaaatcatccctattgcatgacccacaggatgtatgacatgtaaagatttgccatactattaaagagcaaacttgagtggttcacattgcaatgcagatgtgttagagggatttgctaagttagttggagagcttagctgtttaaattttcaccaatgcagtaactcacttgacattataaaaacattgtctttgccattaaatggtaatgaaagtttaaaaaggtaataaattatggtttgaagataaatatcagaaatgcatgacactcaataaagtagaatactggataaatgactttttcaatttgaatattcttcataagtcttcagtgcacctctccaaaatttttaagtacgtcacttaaatttgcttttgcttattatgttctttgtgaagaaacctagttgtatttacccaatctgatgatggtagctccaataattattatagtcaggtgaaatgtattatataatttctgccattgaagaagtagcttattgcttcctgcctttcctctaagattcatatcatgacctcaatattacagtgctggctgaattaatggtacagattttactgctttggcttgagttttattctcacattcattgacagaaagaatttgtcctcagaggccatccctttcatcatcttccaagtgattctgccaaatgtaaagcgagcccaaattttcatcccactggtactcaaggaagtttttcaatttttcttctataggttcacacttgccctttttttttgcataagactatccaccaacatgtaacacatttgtttaattcacttcttaacctttatctggaatttatattcaactgaaaaatgttcataggtgctggactggctcaatatcaataaagctggcatgtcatttgtaaaaaagtaatattaaaattattggttgaattcaggaaaccattttagaaatagaagaatttaggttaaccagaaggataagcgaatggttacatgtgcttttactgactaccagactttgtattaaaagtgggaaatatctgacatttacaatctctgtaaatgatcactgaaattgcccttttttttttgaatgtttataaagatcaagaagatcaagctcagataattcaaatcagtttaggtcttttacttaaatagccacattataattatgtttactaaagagctgaaaagcattcctttccagcacattataatagctataacttattttaggtcttggcgtaattagaatgattcacatttttcctactgactgggtgtatttgtctcctttgcactgcaccttcctcctcttccttgtataacatacatctatatgtgtgaatacaaacaaatataaaaacattcatatatgaatgtacccccaaagcaagcaggatggcgctctccagagaaggaataagtgggttccccactgtcgctcagagtaaatgtggactgatgtagttctgggacaaacctactgtaaccacaagttaataacaatatctttgaacaaagagacagaaacccccttttgataagccttctctacaatcccctccttgctggctccattggactgagcccatcctttccagggttcacccctccagaaggattaaatttcctgtctcattgaatcaggaagaaccatgtgatttaatctgacaaatgaaatacaagtggaaaaatgacatgggatgttcctgagcagaaacttaagagccattgcttggatctctcacctctcttttcctttggtcataaaatcaacatgtcccagactaggattgctcttgtagcatggttgttagaataaagaatacctgagagagagctgtaacaaacagagtggacattaatgtcagcaaaatacatctttgtattgaatgccactgaagtttctaaaccatttgtaaatgcaatataacaatctaattcaggatttcccaacttcggcactgtggacgttgtgaaatgcagaattcttttttgcatgggggtggtttatcattgtaggatgtttagcaacatcactggccacttccccttagatgtcaccaccacacccacagttgtgataacgaaaaatgtttccagatattgccaaatgtcccttgggggaaaaaccatccccagttgaaaaccactaatctcagcatagtagttctcaaagggggttttcagagccagcagtatctggaaatatgttagaaatacaaagtcccaggaccctccgagtccaactgaatgagcagttatgtggctggggcacagcgaactgtgttttgataagccctccgagtggttctgaacatatgaagcttgagaaccacaggtttaaactgattggtatatgtataagcagtcttgaataaggaaagggcataaatattgcttttatttacagatgaataaggtcaactcatttgatatataaagcattagaattgcattttttgtgaatctgtaaggctttagggtatattagcatatatactagtgtaacaaatgttaaatacattgaaatttcataatttgaacaaatttcactatggtctcaggacttggaaattcactgtgtcacaataactcaaaatgaaagaaaaaagattttctacttaggaattctaaggggagtgtcattttggtcttccaaaaaatactttacaaaattgtgtttttaggagcataactgtcagtttcaattatctgatatttgtactgtaattttatttagcacattttatataaacgagtagtatttaaaaagtatagaattgagaatgagtatcaataattcacagatttctttattgcagaattttgtcacaaataattgctgttctttccagctaatttccttttcatatctataaaatgggtctaagtctgatctaccttgaaaggtggggcataaggaataattaactttacaaagtaagtggttattatgtgtaaagttataggcaatgcatattataatgctaatatatatagttatgagattgggtatttcctctattgagattggcaataggaggtagaaaatcacaattaattttgccacattagctctgaaaatgatgaagataatatctctgcatatttctccattttccctcatttgataaaggagaaatccctatttttctgtttgtgagcagaaaatcttcagaagttaaatactgaaaggtcgatagtcttcttaactgtcaatggtacccatgatttctgctatactatatatttgttttttaaagttgtcctaaaatcagaattttgtggtggtatagtgtacgtaccagtacaaggtaaatacaagaaaattatctttaggttttctgtttttatgaaaacattaagaaataagagctgattatgctgtgataggcttatgaaatagacctggaaaaatgcaatatcaaaagacacaatgtgcattttgtgttatctgtaacattattatgttccacacacttgaccataaactttcaattttaagctttgagtcaaaatatcaagggaaaacccttttgagttatttttttctttctatttcctttttgtttttacaaaaaggctgtaagaaatctttatcatcacattaggattttaggattcaaaataagaaggctttgactttgttctttaaaagattagggaagtctttccctttaaagcattatctcctagcgggtggagagtgtcatgcttcattttttaggtcctttacactcttgaatttgatttgtgcttttacagcacaaatcccaacattcagaagggagatctgcctgcttcagctgcctgcagctacagagaattagtctgtcattctcggcatcggggagtgtgtgttgtgtatgtgagggtgtgagtgtgtgtccgtgtttgagattgggtggctgagagtcatttaaatgtgcataaggttaatagtggaagatctcgtacaggcttggctcagaaacctgtggcattctacgctggacagccgttcccgtgcctctgttttaatttggcaggatgtttgctgccatggcagccagcagcatccactgcagcagcaaggaagagccatagatctgagaatgcaggtggaatactaaaatgtaagaggcttgtgcagggctgggcgtcagtgcttaattcctgctcttcctgggctcctatgagcaggctgtacttgctgcactgtgtcagctcgttagagtaaagggttacagacctaggtcagttaagggctggtgaaaggcaggggaaagaaaaaaaaaagcaaaaagcaagagacctcagctcgtgcttcacctcctggcgtttcgggacacagaagcaacagagggaaatgtggacccatcctcctgctgagacatgtgattggatgaagacgggcaaacgtagttggcttcctggactacttttcagctggaggagagtctttggtgaactcttttctgcttcagatatattcgagcaaaatatttgtaagtactgctgattagtaaagtgatgtgtcaagctaaattgggggcaaataattatatatactatatctctagaatcttctgtgaatgtgtgagcttgagcttttattgaagtgcatgtgataatcaaaatcaaatggatcagttacaatcacagtgtaacaagacaatatgaagtccaattgaaaggaaggagccactggaagaatcatgcagcggcctgctgaactctctgtgttccggagcaaagaagtaaggagaaagggagcttgccttcagaaacaaaagtctctgaccaatctttccctcaccagtgatggggagaggagacccacggtgcgcatttccaactggtttggaaatgctgccaaggccagccagagagaagccaactatgcagagcggcgctcactgtccaagtttctctcgcggtctgtgcagtccctgtatcacaccagcagctcagcctggaacctcctgcctgctgggggcagccagtcagacagtgaagacttagaggaattgtctgcaagaagaggcttggaaggtgagagtgatgaagatagtaggtctgaagatgaaaacgtgtcctccaagccaagcagcatcagcagaagctgggctgaagaggagggagaaagctgtttgcgggaagggacagctcatctggatgaggaggtgatccttaccatgctgggtgatctagaacaggcactttacactgacttattaggtaagtccaatttgctcctaaaaacgtgtatgggatcttaagaaatttcatagtctcttatgaaattatttgcatttgccaaatagctttcatgtttttagactgatttttaaaaatacatagttacattttaaattcctgtttcttgaagtgatttttttttttaattttttggtaaaactgagctatgagcaccactggtaaggttcatttggagaaaataaattccggaaatctgccatgggcattattagcctcacctagtgtccagtaccttctagacatccataaataagttaacattttaaaactccaaacatgtttttcacctactcattaaaggggcctatttgttcaacttccctcaaggtgacctcatcacagataagggatgaataatgaagggcctcctgggtaaattttctgtagagttaagtttcttctgctgcctccgtgctacctgaatagaaggcttcttctatacctcagtgacaagccctttttattgtagtaacactttcagaaatacaggggccgctgctggcttctaccttttttcttttctcttttgtttcagtgtttgacaaaaactagttctgcatgtgcacattataagtatttaagctactatgtagatgactatgaactgttttcatactttagaaactaggcctttttgataacatgagtttcagtagtaacttctggcataatctttaactaaataagaagaggtcaagtgattctatagtttgtgactaaactttaaatgtcaactgtgccacctacctaaacagctaacatgtgaacattttaattgttatttctgaattcagtcttgtatcaaaatatatttacatcacacagtcccttcttccataagtattaaattcctggccatatcatattttatgtcaatgtgtatttccacaaagggcttcatattggcctccttaagttgaaaggaattaaacctgggaagtgatctctttgtttctgattcaagaaactaatgctaaatgcaggcttgcttttactcttaatgtagaccctcctgttacaagatgttttatgaggttttctggattcttttagtgaaccagttttagaagaagaaagcttatagagatagcagaggcaaatattgttcaatttttcatgtcagtttggttttagaagagtaatctttccacagttgtcagaatagtgatttctgaatctgaatacaccaggtgctccaacactgaagatttacttttgcaccattgtgtgatttctgtgatgaactgcttctcataaagggctatgtgcagcacaaaggcgagagaaagtcttaatctttatgaagctttttcttttttggatcctctgaaactgtagaatcagataatattcctcttttgcttttgaagtggtattatttatcttgttctcagtatctcttaagtatttacaaagatatgaacagagtgcagtcccctgacagcatttgatgcttactcagttaaattatagcatgctgtgggtgggtgtatatatgacatgtgcctttttgtgcataaataacttgaagcattttggtcagagggtaacctctcaaaagaagccggtatgccttggtttttcaagagcatctgcttattgtatttatatgattattctgtttaagtattttttttcctacttatgccagtattcaaaaatgcaagtgaaaaagtaaggggaagtttattcaaatagctgtgatatgaataatcatatctccagataatgaagcattctgatgcaattccctaaataatgatccatgttaagttgttgaatatatctacgcccacagcacacaggaattccagaatttctaccacgtgcttcaataggttctgtttacgactcaaaatggcctcttccaagttagtttttaggtggggttccttgaggttaattctttactcttagatatcctcctaaatcagacagattaaggtttgtcctataaccgtataggagcacattttaaaagtaactataaagcttttggccatattttgctatttttctccaaagtgtcaagattaaccagaggagtttaaaaattttcatccaaatcactactagggccatccacaaaactagagttacttcacacaataaatcaggaagctgtactctacataacatttgtaatatggatggggtagagggcataattctctgagaataagatttattcatacagatttgatttcctattgaaagatggcaatgctggcagtgttaattacaatgtgtataattaaagcctaaaaattaagagcaagatcacagattaaatggtctgtctgccaccaaatagtaacgtaggagtaccaaattgatgctgttattttttttttctctactaagaacaccttatgagcagtgagaaagcactttgcaccaatgttaaaaactctagtagatttcagaatataccattctggaagatgtgtggaagccattccattgtgtttgacacataggaagcctctttcaggaataatggttgactttgagattatgcaagcaggaggagacacaacattgctgtgattaaatgcatttctcacgtgcatttttctggtaacttgtattgttgctaaacatttaattttatttttgcttttatatttagactttgcaattgtgtttttcccccaaagcctctggacctcactcagatacaaatttataggatatttaagaccatgcaatcagtccttagggggtttgtaagtacatttagttttatcttgccttttgtgggtcattgaaaacatttactgcaataaattttctttggttattatctttcatgacatgaataaggcagcagttatgttttgctcaataagcgttggaaagaaaaggtccatttgtctgtcatgaggagggcagtgtcataagtgaatgtcatgatgaaaaaaacctaaggaatgagggaggctttggttctaaaacatgagagaaaccagataaacaatgaattcagttagaagaatccaaggatctaagatacctgttggattggaaaaaagaaattgaaaaggaaatgaagtagatgtgaaaatatatttagtgaaacagcatgtctgaaaatacaacgttcttaaaattaatatgaaaagatggaacataattgagatattaattttaatattccagttggcaaatgattgagatgcagctggattacaacttaaaagttttcctgggggaagggggaaagggataggaacatgtaatgatgcgttctaggaatctgtgtgaggtcaattacttgtacctcccccaccaagtaaaaaaaaggacatctcaatatactccttctttcatgactttttatctttcacctacaatctaagatgccaataactgtatgaaatctttcatattgaatcttaggtttagtgcttctccaattttgtccccttcactacttattttgacccagtttgaataaatttcttctttgtatgtctcttccttgtctgtaataattttatttccagtctgtaagattttctctacaaaacttctttttcttcatagttctctcagattatttggaagtgaaagatagaattctttatagccatctctgaaatactctatattatatgtatgaggagaagtatgggaagaatttccaggaagaatgtgatcagtctcaagggttattaacagttctgagttctaaaagaataatgttaatctataggattagtgattgtgtgaacttagtgtagagaaagtttgtcatgtgcatgagatcccaacaagtgttttattattctttaaaaatatttacttcaggaaagtttcttagtacgttatgtttgaaataatgatcttattattaagtatactttaattgttcaaatgatttgtaaattcaagggaagaaatttacaggctggcagcacaatggtggctgtttcgtcaaccacccaaagtgaggaataatgaacaaagtagtaatgtttgcctgaaaaatatagtaaaggaattagccgttgtgttgcaatatttgagtgactgccttggtaaagacagtgtaaatttgttcatttggtttcagatccactggaaccacagggtgaaagtttaagggagacaaatttttgcttatcccccataaatattttacattttgacctgctactggaaggagccatctcttactggtgaggtggaggcctttccaatgttggagttttcaggcagaggcagatggccttgtcccatgtgagacagatgaatgctatggccaagagataaggcaagacaatctctgaaatccaccaactgtatgattgtgatgataggtgttaaaggggcacatttgttatagatttttaaaaatctggcctgagtattaaggaagtaaattaacagattaaatagttagctatattcctaaaacagattatagatacgcatcttgacttccctatgtgacaattttcatagtgtaatttaatacatgctattttttgcttttctttttgttccctttctttttcttccatcctgtttccattccattcccttcccagccgtcccatctacttcctttttctctgtctcctctccttccctgtccctctcttaatctatccattccaattccctcctcctttctgttttcacttttattgaaagtgcccatcattagacatcctcttcagtccagattgaacagaataaaaactgtgcttccactactctcttttcatgttctttctattatctagactcactggctttagaaggtcactagcttggggaagtattgtatgactatcaacaaaatggcttaaggacacttctgcccccagttgataggtggtgattgtatcaggccagcgttagtcatacttgcagagctatttgtttcatgctcattagatacaaacattttgggtttagatgcctaggaatttacttgaactctagtatcattggtagaactgtagaaactggagaagtaattaaaaataaaaccattcaatgtttgtcagtctttgtccatgagtctaataaaagacttcaaaagctattgcttccataagaaaagacctcagccgggcatggtggctcacgcctgaaatcccagcactttgggaggccaaggcaggtggatcatttgaggtcaggagttcaagagcattatgaccaacatggtgaaaccccatctctactaaatacaaaaattagccgggcatggtggcgagggcctgatatcagctacttgagaggccgaagcaggggaatcgcttgaattccagaggtggagtttgcagtgatccaagatggtgccattgaactccagcctgagcaaaagagtgagactctgtctaaaaatgaaaatgaaataaaaaaataaaaggcctctagtttattccccagattccaaatgtgtcctttctacataaggcaaatttacctcaagtattctgagtacacccagaacaccttgaaataattaggatcctaatgatcatagtttttttttttattttactttaagttctgggatacatgtgcagaatgtgcaggtttgttacatagatgtatacatgctgtggtcgtttgctgcacccatcaacccgtcatctacattaggtatttcccctaatgctatccctccccttgatccccccacccaccaacaggccccggtgtgtgatgttccccttcctgtgtccatgtgttctcattgttcaactcccacttgtgagtgagaacatgtggtgttcagttttctgttcctgtgttagtttgcagagaatggtttctagtttcatccatgtccctgcaaaggacatgaactcatccatttttatggttgcatagtattccatggtgtatatgtgccacattttctttatgcagtctatcattgatgggcatttgggttggttccaagtctttgctattgtgaacagtgctgcaataaacatacgtgtgcatgtgtctttataatagaatgatttataatcctttggttgtatactcattaatgggattgctggatcaaatggtatttctggttctagatccttgaggaattgccacactgtcttccacagtggttgaactaatatatactcccaccgacagtgtaaaggcgttcctatttctccacaacctctctagcatctgttgtttcttgactttttaatgatcgccattctaaccggcgtgagatggtatctcattgtggttttgatttgcatttctctaatgaccagtggatgatgagctttctttcatatgtttgttggctgcataaaatgtcttcttttgagaggtgtctgttcatatacttcacccactttttgatggggttgtttttttcttgtaaatttgtttaagttccttgtagattctgaatattagccctttgtcagatggatagattgcaaaaattgtctcccattctgtaggttgcctgttcactctgatgatagtttcttttgctgtgcagaatttccttagtttaattagatcccatttgtcaactttggcttttgttgccattgcttttggtgttttactcatgaagtctttgcccatgcctatgtcctgaatggtattgcctaggttttcttctagggtttttatggttttaggtctttggtttaagtctttaatccatcttgagttaatttttgtgtaaagtgtaaggaagggatccagtttcagttatatgcatgtggctagccagttttcccagcaccatttgttaaatagggaatcctttccccattgcttgtgtgtgtcaggtttgtcaaagatcagatgattgtagatgtgtggtgttatttctgagggctctgttctgtttcattggtctatatatctgttttggtaccagtaccatgctgttttgattactatggccctggagtatactttgaagtcaggtagcatgatgcttccagctttgttctttttctttaggattatcttggctatacgggctcttttttggttccatatgaaatttaaagtagttttttctaactctatgaataaagtcaatggtagctttatggggatagcattgaatctctaaattactttgggcagtatgaccattttcatgatattgattcttcctatccatgagcatggaatgttttttcgtttgtttgtgtcctctcttatttcctggagcagtggtttgtagttctttttgaagaggtccttcacatacctttaagttgtattcctaagtattttattctctttgtagcaattgtgaatgggagtttattcatgatttggctctctgtttgtctgttattggtgtataggaatgcttgtgattttcgcatgttgattttgtatcctgagacgttgctaaattcgcttatcagcttaaggagtttttggctgagaagatggggttttctaaatataaaatcatgtcatctgcaaacagagacaatttgacttcctctcttcctatctaaatgcactttatttctttctcttgcctgattacccttgccaaaacttccaatactatgttgaataggagtggtgatggagggcacccttgtgttgtgcaggttttcaaagggaatgcttccagcttttgcccattcagtatgatattggctgtgtgtctgtcataaatagcccttatgattttgagatacattccataaatatctagtaattgagagttcttagcatgaaggggtgttgaattttatcgaaggccttttctgcatctattgagataatcatgtggtttttgcaattggttctctttatgtgatggattacatttattgatttgcatatgttgaaccagccttgtatcccagcaatgaacccaacttgatcgtggtggataagctttttttttgttgaggcagagtcttgctccatcacaccggctggagtgcaatggcacaatctcagctcactgcaacctccgcctcctaagtacaagcgattctcctgcctcagcctcccgagtagctggggctgcaggtgtgtgccaccatacccggctaattttgtatttttagtagagatggggtttcaccatgttggccaggattgtctcaaactcctgacctcgtgatctgcccacctcagcctcccaaagtgctgggattacaggcatgagccactgcacctggccagtggataagctttttgatgtgctgctggattcagtttgccagtatgtgattgtggatttttacatcgatgttcatcaggggtattggcctggaattttctttttctgttgtgtctttgccacgttttggtatcaggatgatgctggcctcataaaatgagttagggaggtgtccctctttttctattgattggaatagtctcagaaggaatggtaccagctcctcttcgtagttctgttagaattcgactgtgaatctgtctggtcctgggcatttttttggttggtaggctattaattactgcctcaatttcagaacttgttattggtctattcagggattcgacttcttcctggtttagtcttgggagggtgtatgtgtccaggaatttatccatttcttctagattttctagtttatttgcatagtagtgtttatagtattttttgacgatagtttgtatttctgtgggatcagtggtgatatcccctttatcattttttattacatctatttgattcttctctattttcttctttattagtctggctagcagtctatctattttgttaatcttttcaaaaaccagctatggatttattgattttttgaagggtttttgtgtctctatctccttcagttctgctctgatcttagttatttcttgccttctgctagcttttgaatttgtttgctcttgcttctctagttcttttaattgtgatgttaaggtgttgatctttagatatttcctgctttcttctgtgggcatttagtgctatgaatttccctctaaacacagctttagctgtgtcccagacattctggtatgtagtttctttattctcattggtttcaaataacttattgatttctgccttaatttccttatttaccccgtggtcattcaggagcaggttgttcagtttctatgtagttgtgaagttttaagtcagtttcttaaccctaagttctaatttgattgcactctggtctgagagactatttgttaggatttccattcttttgcatttgctgaggagtgttttacttccaattatgtgatcagttttagaataagtgtgatgtggttctgagaagaatgtatattctgtttatttggggtggagagttctgtagatgtctattaggtccacttggtccagagttgagttcaagtcctgaatatctttgttaattttctgtctcattgatctgtctcatactgacagtggggtgttaaagtctcccactattattgtgtgggagtccaagtctctttgtaggtctctaagaacttgctttatgaatctgggtgcttctgttttgggtgcatatatatttaggatagttagcttttcttgttgcattgatccccttaccattatgcaatgtccttctttgtctttttttatatttgctggtttaaagtctgttttatcagagtctagaattgtaacccctgcttttatttgctttccatttgcttggtaaatattcctccatccctttattttgagcctatgtgagtctttgcacgtgaagcttatgaagcttagtttggctggatatgaaattctgggttgaaaatcctctgctttaagaatgttgaggccaggtgcggtggctcacgcttgtaatcccagcactttgagaggccgaggcaggcggatcatgaggtcaggagatcgagaccatcctggctaacacggtgaaaccccatctctactaaaaatacaaaaaattagccaggcctggcaacgggtgcctgtagtcccagctactcaggaggctgaggcaggagaatggtgtgaacccgggaggcggagcttgcagtgagccaagattgtgccactgcactccagcctgggtgacagagcaagactctgtctcaagcaaaacaaaacaaaacaaaacaaaaaaatgaacgttgaatattggccctcactccctctggcttttagggtttctgcagagagatccactgttagtctgatgggcttccctttgtgggtaatcagcctttctctctggctgcccttaacattttttcctgcatttcaactttggtgaatctgacaattacgtgtcttggggttgctcttctcaaagagtatctttgtggtggtccctgtatttcctgaatttgaatgttggcctgtcttgctaggctgggcaagttctcctggataatatcctgaagagtgttttccaacttggttccattctttctgtcactttcaggtataccagtcaaacctaggtttggtcttttcacatagtcccatatttcttggaggctttgtttgttccttttcattcttttttctctaatcttgtctttatgctttatttcagtaagttcatcttcaatctcggatatccttccttcccctctatctatttggctatttctacttatgtatgcttcacgaagaatttcgtgctatgtttttcagctccatcaggtcatttgtgttcttctccactaaactggttattctagttaataattcctctaaccttttttcaaggttcttagcttcctttcattgggttagaacgttctcctttagcttggaggagtttgttattacccaccttctaaagtctacttctgtaaattcgtcaaactcatactctgtccagttctgttcccttgctggtgaagagttgtgatcctttggaggagaagaggcattctggtttttggaattttcagcctttttgcactgttttttttctcatctttgtggacttacctacctttggtctctgatgtttgtgaccttcaaacggggtttttgtgtggatgtcttttttgtggacattgatgctattcctttttgtttgttagttttccttttaacagtcaggcccctctgctgcaggtcttctggagtttgctggaggttcactccagatcctatttgcctgggtgtcaccagcaaaggctgcagaacagcaaagattgctgcctcttccttcctctggaagcttcatcccagaggggcacttgccagatgcctgctagagctctcctgtatgaggagtctatcaacacctgctgggaggtgtctcctcgtcaggaggcacgggggtcagggacccacttgaggaggctgtctgtcccttagcggagctagaacactgtgctcggagatccgctgctctcttcagagctggcaggcaagagtgttttagtctgctgagcctgcgcccacagccgccccttcccccaggtgctctgtcccagggagatgagagttttatctgtaagcccctgactggggctgctacctttctttcagatatgccccgcccagagaggaggaatctagagaggcagtctggctacagcagctttgccaagctgcagtgggctctgcccagtccaaaattcccagcgggtttgtttacattgtgaggggaaaagcacctactcaagcctcagttatggcagttgcccctccccccaccaagctccagggtcccaggtgtccttcagactgctgtgctggcaatgagaatttcaagccagtggatcttagcttgctgggctccacaggggtgggatccactgagctagaccacttagctccctggcttcagccccctttccaggtgagtggatggttctgtctcactggcattccaggtgctactggggtatgaaaaaaaaaactcctgcagctagcttggtgtctgcccagttttgtgcttgaaactcaggcccttggtggtgtggacacccaatggaatctcctggtgtgcatgttgtgaagactgtgggaaaagcatagtatctgggctggatagctccgtccttcaaggcacagtccctcatgacttcccttggctaggggagggagttccccaaccctttgcacttcccaggtgaggcaacaccccaccctgcttctgctcaccctctgtgggctgcacccactgtctaatcagtcactgtgagatgagcctggtacctcagttggaaatgcagaaatcacctgccttctgtgttgatctcactgggagcagcagactggagctgttcctattcagccatctttctcaggtcataatcatagatttttaattgatcccagcaacatggattagtaaacagcatatttccaagtgatttttttttattttaaggtcaaatctacaaaatattatagtgttatcaccacttaaaattattactggtgatactatgtttgtctctattcacattttattgctagaaagaattataatttgtagataataatagttatttgaaatgtattacatatccttttacttttaagaagaggtgacttaattatctaggtatacaattattttgaggatactaaatgtcatgaatagcaaatttatcatattgctttcctaggtgaagaccctgaaacaagaagaatgagaacagttaaaaacatagcagacttgaggcagaatttagaagagactatgtccagtcttcgtgggactcagataagccacaggtttttttcaattttgcatatatttgagccaataaagaaaaaataattacaaacaaacatttaacttttcttataatgacagagatgggatttcagtttccccttactattttctcccttgttttatatcaaattgattggtaattatccttaaactgagaattcacagtatatacctatttatcttttatctctatctctatctgctatttatgtctttttcagtataatttccagtactgcaactaccaccatcactgttaagtggatttgtaatacctgtcctagaaaacagtggcacaagttgcacttgaaatgcatctgggcagggtagtagggagacattcaaacataattgtagttaactttcagaataggtctgggaaggttacagtgagttaaggatttgttgaaaatgtaaaacaatatgttgttttacccaaggtgtactgatggcctttcttttgaaaacaaacgaaaagctataaaatgtatgcccctttccacaatttgacctcaaaatgaatatagagtttagctttcgggaagatgacgtgtttataagagatgaccctcaactccagccttttctgtcttcatgcattctagattatggccctaagtgaaccagagtatagttatttctccattttatttgacagcaccctggagacaacatttgacagcactgtgacaacagaagttaatggaaggaccatacccaacttgacaagtcgacccacccccatgacctggaggttgggccaggcatgtccgcgacttcaggcgggagatgctccctccctgggtgctggctatcctcgcagtggtaccagtcgattcatccacacagacccctcgaggttcatgtataccacgcctctccgtcgagctgctgtctctaggctgggaaacatgtcacagattgacatgagtgagaaagcaagcagtgacctggacatgtcttctgaggtcgatgtgggtggatatatgagtgatggtgatatccttgggaaaagtctcaggactgatgacatcaacagtgggtaagtaaccctgttctccgtcagcattgtgtgaagaggggaggtggtctactataatgcattcactataaacaaatgtgtaagtttgcccagaaagtcatgagaacatatgagatatctgaggttattcagagtgttgaagggcccttcctctgctcattcatggagagtaaagaatccaagatttctataaattcattataagccgctaagtttttctgttgttgagagaaacacatgtggcttctgtttttcagagtgattttcacatgcttcttaagtaacagattttgtagttaaggacgtgggaaggagacaggaggagttttgctgatttgcttgattttttttttcttttttagcttgttagaagctgcctgtaactgctttgagaaacaaatattttcttactgtcttcaattatgcatccccaatttaacttgagggaaaaatcactttggagttgaaagtttcactctattcattttcttttgatggtatcagatttcaatacatctcagaccctgtttttcttctgtgtcctattacattccaaaacatgttgtgattgtaaaactcttagagtatattaacaatttgggatatttggcataatcagagaataggtccaaaaggaggcaataggatattctattaataattgtaattgccatttttagcatttcctgttatgtactatgctcttgtcaagtgctttgaagatattgttttacttttccttcccaccaccagcaatgtttatgaggtagatgtttttatacatgttctatggataaggaaactgagtctaattggccccggctgggaactaacgctagggaaacggcagacctgcattagaactcagctatgtctgacttcaaacacaggctcagtaatatgtggaaaagcttcccaattaactttgtctataaactttgtgtgagtctggattttgacttactctttgtctttacgcatctgagaggacccatgtaggaaataattcttctatataagtgacccttcctgacttcattcatgaaaagcttatgtttgaagggtgacacgacctaaaaaagagtacaaaatagcttttgattacatttatagctttgctctgatatcccaatacctactagtccattcctggtatccaccctacctgactttctaaaaatttagaattatagagactaattatgattaattaagataggttgttgttcagttgccactggattcagagtgcctagtttgaatctctcccattcactatctgtggaccccttcggaacctaacgtatccaaattagtttttgtcatctagaataaggataaaattgtaccatcttcatgaagttgttaggatcatccacaaattttagtttgcgcaatgcttggcatgatacaagcactcaataaatttatcatcttcctctttatcatcactattacatttattatcattaataaccataccaatttttggttgttgttagttataattatcatttttgtatgtatttaacatagcctaggaggcaatgcccagttcagaaaacataatggcaaagcaagagtgtctaaggcacactctttctcccatctctctcttctttcttctccattctttccactctatcccctcttctcttttttttctcaatctccttagatgtggacatatgtgtgaattcaattttataatcactattcaaatatatttatatggctaattatatacataagtatacccatataatatatataaagatatatataccaaggctgggcacggtggctcatgcctgtaatcccagcactttgggaagccaaggcagatggatcgcctgaggtcaggagttcaagaccagcctgcccaacatggcaaaaacccatctctactaaaaaagttagccaggcatggtggcttgtgcctgtattcccagctacttgggaggctgaggcaggagaaccacctgaaaccgggaggcagaagttgcagtgagctgagattgcaccactgcaccactccagcctgggtgacagagtgagactccgtctaaaaatatatatatatataatatatatatgtatgtatgtatgtatatgtatgtgtatgtatgtatatatacctatgtgcactcaatatcattattcatggtacttctcttctatgaagtcaccacaaacactgcattagtgaatcctgaactattgcccctagtagagatataggttttggttcctgtgagcatttggccacaatatttttgtcaactgatcaatacataaacttgctttacgtaagtctctctttaaagacaccttatttaatacatactattgattcattcacgtggaactcccagccaacagcactataactaaggccggaatgaagcttatctagtgcatattttctctgtgagatgcattgaagactgcttgcaattaggaacataatatgacacttcagcaccaagtttgggggccactttaaacagcacaattctcagcataaaaacacaaaaaatgtggaaaacatggcactaaataggccatagaagaacatttgttgtgatattagagctgatacaagaacacagagtatcactttatttagccttagctggaaacgtctgagactcattttttttcacggttctgttcatatccatgaatggctgtgaaagtgctacgagtttagattttgtggctacatataaattttagcaagtaggcaacttcacgaatatagaatttgtgaataatgatgattgacaatatatactcacactcatgtagaatgtttatctgtagagtgacagcatatcttgggagcagtttgaataagaaatcaagggacatctacagtgcaatatgttgggaatttcaaaaggcttatagggataaaaattgagctaagagttcagaatgaggagaaagtactaaaccctcacatgaaatagaaagcagtgaataagaaaaagaaacattttagttattttttctgatttaagagctatagacaaaggaaatatatttaaaatacatatataagaaaagtacaaacatagaaggtataaattattcagtaaacttgcataaaatgtaattttcagaatcaaagggacagtggattagatgatattgatgatttttctcttaactgagagtcatggaacatgaatatttaaagataatgtcttagagataggcactattttgacagaccttaacatcattatgctaagaagtttaaactacattataagctatgtaaaatactatatcttagagattactaaacagtcatagaacatggcatgaggatggtgatggcttttgaaggccactttatgggaaggaaatatgcaaagtgaattcaggggagaaactcgggggttcaatttcaggaactagtgcaagagctctggctcaagctcataagattagaaatatggtagtggcatttgtagggataaaattaggaaagtaattgatatgggaagcactgcaaaggaaaagtttatagaaccagagatggactacccatgaaggcataaggcagacaagaattaagatacctacatcataagcacaggagatggaaaatagtaccgttagagaaaatcggcagagagagaaagagagagagcgagagagagaggattttttgatgagaaagcagagagagagatgatgaatttagagttagagatgtagagctggagacggtgagatatgaagattgtttgtccaggatagagatctattgtatttcatctcaataaaagagagcaggaattgtgggaggcattaaggctcctgggaaaagaatatggaaagaacagggatcataaactgaattatgtatatatgtatgtatacatgtatatgtctattaaaaatatttatcgagttcatcctatgtgtcaagcaacattccaggcactgtgcattcagtagtgaataatatagacatagtacgtgcccacatgtgactcacatgatggtgttttcatatttttgtagcagtccagttattcagtaaattaattgtaatatgcacacatatgtgtatatatacatatatatgcacacatatgtgtatatatacatatatatacacacagagaagtattcttaaacagatagttgttttaaacgttttttaacaactgaattctgcatataataatatatgttacaggcatattgtactcaggagcactttatattttgcaagaatacatgcaatatatgcaagaatacatgcataatatgttaactatattagttaacattgatttcgaaaacagagaaatctcaaaatctcagtaacttaacacaaagaagctaatttgttcttcacataaaaccctcgctgatgtttctgatcttcacctggggaatgcactccatgtagtcattcagagaataagatggatggtaattctgttgttacccagccagatttccagtgttaccctaggcattgatattcaacaggcaaatggcaaaagaggggaagacccagggtgtgagaagattttgtatgtatcaggcctggaagtcatgcatatgagttctgcctgcattcatttgtctagaacagctgcatgaccacatctgactgtaaaagagactaggttatatggttcagctgtgtgcccaggaggagagggaaattggtttgatgacatctggctagtctctgctgaactcactaattttttaaaaaatgctgttatagactttgtccttcttatttgtttctgcttcatttaaaacatgattcagacttcttgtttcctctatttttgttccctaacatctttcaaaaaagtcttggatagtctcacaaatgagtccatttaaatatgcattgatggtctacatgtcttatgttgacaagtaaaaatacctcaaatcctacatgaaacttcccctgtttactcacatacatttgttctttcctatgttagagtacaagacactgaaatttaagtcatgactcagttctcttacctgtgcggaagatgctaagatctgatcagcagatgatgaggctggtcttagctcaaggatgattgtgcgaggatacccaggatgtgctggacttattgctcatcagcttatgcagtgtgcccttgttggcttacgtaggaggcagccccaaaatctcagcctagaattaaaacgtgagaagacaagagggctggagatacccaggaaaagtttaatttgatggtgtttctttaagaaaagggggcttagaagtatttatgctggccgggtatggtggctcatgcctgtaatcccagcactttgggaggctgaggcagatagatcaccttaagtcaggagttcgagaccatcttggccaacatggtgaaacctcatctctactaaaaatacaaaaattagctgggcatggtggtgcacaccagtaatctcagctacttggtaagctgaggcaggagaattgcttgaacccaggaagcagaggttgcagtgagccgagatctcaccactgcaccccagcctgggtaacggagtgagactctatctcaaaaaaaacgtatttatgctacgagtcatgaaaaagttgaatcataaatttaactctcttttcaaaatgtttaaaaatatgttttaaagattaaaggaacaaaaggctcaataaggtagtaatgaatgaagatgtttaatttaggattttctcatgtaaccacgaagaacgtcatgaagtcatttaaatgggaataaagtttcatttttttccatgtactctaggtgtaactcagaaagttagttaatcagcattctgagaattcaaaatttcttgaagcatgcgaaggcttatctctttctcctctttttgaatttactttaaacactgggggatatgaatctgtcagtaattaggaattagtcagagaaaggcctcttactcataatgaacctctttgaaaagtctctatttatgaagttaaaaacaccctggaaaattgggataaaagttacatattttaattgagtggaaattgaagttatcttcaggtgtcacagtaataaatagttgggccaagaatataacctaaaattctactttaagtcacgtgaccaaacacaaactaatctaagaattctgtggagtaaaaattaaaaataaggcacagaagtgaggggtagatatactttaatcctgcttctgccttgatcctccctcaattctcatttagtaaactttgtgatgactgaagtatgcataacagtgtgcaaaaggtcagagttacttgagctgtgttaaaaagatccatcttttgcaccacagattcctaatcttaatgcttcctctaatttcactttcaggatatgagctattttagtgactctagaaactctaatgcataaaatagctagtatttttaaagatagtatttatatgtcacttacaatgtgctagacaatgctgtatgcatgttatatatatattaactcactggtagctcaccatcactgcaagaagtgagcatatcattgctgtttccattttacagatgaagcaatttaaacatagcttgtttaagtgacttacctcagcccacacagctagtaagtagcagcactgtagttgaacctaagcagtctggctctggtctacactcaaccatccttacacactgaccttaggaaactgtctgcatgtctacatgtaagggtttctctcctaggtgcctgatttttttccaaacaatcatttaaaaaaggttcacagcaatcatttgttatcagcatggattttgtagctagcacatttaatgtaaggggcatttttaaatgttatctatgccactctaaaggaagatgctgaactggagtttctttaagggagtggtgaggatcactttagattctctgtgtgtgcatgcaattacaaattaactaattgtgacagatagcagctgatatgagatattaaatataaaaacatagaattctaggaagatggctctattagtgtgttctcactctgctaataaagacatatttgagactgggtgatttataagggaaagaggtttaattgactcacagtttcacatggctggggaggcttcacaatcatagtggaaagtcaagggacatattacatggcacaccgcaggcaagagagcttgtgcaagggaactcccatttataaaaccatcagatctcgtcagacttactaccaggagaacaatatggggaaaactatccccgttattcagttatctctatctgccccctcccttgacacatggggattattacaattcagggtgagagttgggtggggacacagctagttgtgacagtgcagtgacagcagctgatatgaggtattaaatataaaaacatagaattctaggaagatggcagatatggtggaagtttaggttttgatccattactcctatgacctcttcaaaaacagtatttcaaaaatgaaattttctttcttttaatttcttaagagttatattatctgcaagcctattcataatattaataacaaaagggaaaaataggttctatggtaggctagttacttgtcgcagtaactactactaggaaatattgatacaaatactaggaaatattgatttcctagtaaacttgaaaaaatattttaattatccctggtgagtagaatgtttatacagaataaaaaacaagataatagaatatatttgagtaattattgaaaattgtggacaccgtttgtttattaagttaaattgtacagttgagttgatttagttttctgtgaattaattagacatttcttttcaggtacatgacagatggaggacttaacctatatactagaagtctgaaccgaataccagacacagcaacttcccgggacatcatccagagaggggttcacgatgtgacagtggatgcagacaggtaatgctatcagcatatatgatggtgagacatgcatgaagtaattttataaataagaaaataacagaaaactcctattaaacagtgtaaatcaaaggactttttattttgataaataattattttattttgataaataattatttagggtttttttgtttgtttgtttgttttcgttttttttgtgtgtgtgagacagagtcttgctctgtcaccaggctggagtgcaatggtgcaatctcagctcactgcaacctctgcctcctgggttcaagtgattctcctgcctcagcctcctgagtagctgggactccaggcacgcaccaccatgcccagctaatttttgtatttttagtagagatggagttttaccatgttggtcaggatggtctccatctcttgaccttgtgatccacccgcctcggcctcccaaagtactgggattacaggcatgagcctctacgccccgcctatttggggatatttttaaaactaggatgattttctttacaaggccattttagctctgtaataccaaaaataaatgtatggctggggagatttttttttaatttcaggtaacatagttgcaaatgttaatatctataaaagcagaattataaacatagacttattttccttgttagaaagaaactctggttaataagtttcattcagttcagatatcctcagatttacctggaagctaatgatataaagattaaaatatatttcaaatcatctagtataataagcttgatgctttccttgaaggtgttgtaaacatagaaaaactcttactttaggcttatttttgcttctttattgcctcaaatttcttaaagatgtgtgtgtgtgtgtgtgtgtctgtgtgtgtgtgatgaactaattattttgctggaaattgctctgctgatttatcagaatcatcactgtttaagaacattgctttggtaagataatgttgtaatatacatttctggcctgattttgctccctcttcactcagaattttgactttgttgagcaggaagggattgcatattttcagaattattatatctaaatacctagagtagttgtttaattcagcatttatgaaaaagacaaaaggttaaggtgcaatgtactcacattctgaaataggaactgtatacaattcattgtgcatttttgtacagtcaactccaaaggctagatacccagggaattctaatattagtcttcagtttctccttacccacaggctgttgatatcctgactcatagtggttagaacagtctcagctcccaccctgtctgtatcctactctcctagcctatatactcttgtgtgtgggtgtgggtgtgaagcatgtgtatgtgtgtgtgtgaagcatctccccacctgtaatgtaagtccatgagtgcagaatttttgtcatattctttacgtgttgagttttaacaaatgtttgtggagtgaatgaacaaattaatgaatataggctatttattaattaggcaatatagtcacataggctggcaatcgcatctaattaaatagagtggtaaatgagttccagaaagaactaaggtactacaaggatgttatgaaagagaaaaatgagttatgtgaaaaataggagacagtgataagagggaaagaatcccaaagtgtgggccacattttgaaactaatgacctattattctattattgttagctgaaagtagaaaacgtcatgggagggaatatctgctagtttttggtaaaggatgttgtgatggcagaaccaagaaatgaacacaaggtgactttggtttggggacagtgggataatcaactctccttgctccatcagggccccagactgggctctggcagaggaactcagaacaacgtaaagacctagataggtatctaataaattgggacctgtgaaaacagtgcctcttaaagtgtggtacctggaccagcagcagcagcagcagcagccattgaaacttcatagaaagacagattctcagcttcatccaagacttactgaattagaatatctcaaggtaaggcctggtaatctgagctttaactagccctcaaggtgattcttaagttcaagcatcactatattaagttgaacaaatagatgccaggcctataaatacatgtaacgcctagcataaatatttcaacattaaaaatgacatttcatagttcttatttaccctattagctgtgttctgtcaagataatgagaatattgatatgttagaatacactgatggcactaatttttaaattagatcaaataatgacttgttatacctgaaataaattggttcagcttggtagatgcagtttttgagaattatataagtcatttttaaaagaataattttaacttgagctgcttgcataaattaaattgcaaaaaggtcatagtataaatcctcctattagcagagatagaaggtttttaaaaaaattacagataagtctgaaggtcttttaaaatcttatattcaggaagtgactcgggatgtatatcattttaaaatacatggtcttaaatgttgtagttgtatgactctttcagttaatttaaaatacttccttctatgaaaaattgtttcaaaaatttttctaaattctgttatccatttcaagtaggataggcaagaacagatataagatactacttttttgttcatgtttactaaaaaaaaaattactgtaattgagatcatgtaaaaacatgtttcctgtctatttgtcttaaccttttaatcctggcaccttaaatttgacatagtaggaattagaagacaattgcagaaaatgtcaactggggaaattttattctactaaaaactatgtccatacaacatagcaaatcacattttaaaggccaaaaagtctttcatagcaatttttcagattattttcaaagcatatcttctctctgctcctgcagcatgccgttgatttttctgttatgcagtcacataagtaattacatgtttacatgtctatttcactcatagaacacgaaacagttaaatgtagaataatatccaatccatctttttatcaccagtagctagcatactgtaggaactcaataaatatatcagataaattgtggaaataaccatatcagcttataacatatagaaatgtgagtttaaaaagaaaacaattatacatatgaaaaaatttttataccatttttttaaagacctttcagatgtcatacagtttggacttttccagtgtttcttgtatcatgagacaatagtagacattgtaaatcaaaaatagttttctggggttgtgtacatttgaaaaaactgaatatcatatctgttcttagagagtaatgatggatattaacatatcaaaggtacagagaagtcttaaagttcaaagtaacatctgcttaattgtatttaattcagtgctccatgagcttttttatcactgattccctcccttttttctcttatgataataattaacttgttcctgtagcattttaagaaatgttgatttagttgaatgccttcacttctccaatataatagcagaaactcagaaatatttatttacccagaatcatgcagctaatagtacaaggattcaggtcttttacttcctattttgtggttcccaactacttttgccaaaggtcttttaaataatatgaaacatattagtgattgattcattatagtaaatgggtaaatgataaggcttgcaataattcactgacaagaaagcttaaaagtcaaaagaaaaaaaaatccacagcatttttttttcttagttattctttctaaaagctgtgtaagtgcaaaagcagagtcatagcacaatggcagccagccagctacctagcatagcaatggacttgaattgtttgtattgttatagtgaaggctatagtttccctttgatcaacttctggttaaaatgtgatggacattagagaacaactgaattcctcttaccagcacattaaaaaggccccaaaggaaaaatgaggactttcagcagccatctgtagtatattttaaatattttattgcttaaagatattgcagttcatttactttccatatcaatccaacaccaaccccatttctgtatttacttgactaaaaaaaagattgcagaatgggtataatccttgcagatatgttggagactctccagcaacttcacagatacatttatagctggcagttaaatatgtgggttttatacattgtgttgggctatgtttaaagggtacatttttggggactgcaggatgattgtggttttgacctttattaactcctattattgttcttactctagattctatgctaacaatcacaaatattttataaacaaatatatgattacttcctaagtgcctgtcatcatagtagcaccttgggtaaaaataaaacaaaacagtatgggtgaaagttcctcagtttaatggtaagagagagtaatgtaaacaaaggcccctcttaatagatgtctatacaatgtgccttagaagcaccaaagagaaacagttactcctacctgggagtataaaggaaagacttcaaaacacagtagcatttaagcagggtcttaaagaaagcatacaactttttgacatccagcctgggagaaatcagaaggaatgtggggagtgagagcataaaggcatagaagagtttggtgtgaggaaccagtaatgggattctgaagtgcactgggaatgtggacaaggagacgagagacaaaggacctgggggccatactagggtgtttggacctataggtgataaggagctattttactaagtttaattagttttatttcatttcaaggcaaaagcacatgctataatcattgtattttaaaaggaactctcatagcaatgtaagaacattgaagagggatgagataaagacaggtagagtgcttagaaagtgactaaaataaattagatgagcacctaactaaagaatggcagtggggaagggggctggggacaccatctatttctagaggaacttgggttttgtctatgtgtatgataatccttggctgtcataactaaataccacagactgagtggcttaaacaatagacatttagtttttcacagttctggaggctagaagtttatgatcaaggtgtcagcaaatttgttttttgatgagaactcttcctgacttccagagagtgggtttcatgctgtattctcacatggcctttcctctgtgctcctggagacatctatctatctgtgtctgtctgtctgtctgtctgtctgtctgtctgcctgcctgcctgcctgcctgcctgcctgcctgcctgtctgtctatatagagagaggtctttggtgtccctctctcttcttataagggcaccagtgctattagattaggattccacccttatgtattaatttaacctgaattacctctgtaaaagtcctgtttccaaatacagtcacattgcaggttaaaaattcatataaattagggggtggagacataattcaattcataaccctgtgtaactcccaggtggatatgtccttggggatataaggtcagtcactatatatgtgctggattaaagtattagtatgtataataatcatatatataatctagatcatatatacgagtgtatacaaaattagctcgtatacaagctctagattgtatatatgcatatttatattgtaaattgctgcctttggaaatgcgtaaatgtggaaaagagagccagggattgccaaaccatttgattttgtttttcaagtgaagccaagagtctggactcttatgagaagtttcccaatttttaagtattagaactctcctaacagatacgtaagatcaatagatacagttaaagacaaaaaactttcttcagtgggagaaaaatctagaaattcacagacatggttatataaagcaggagagagtgaagattgcactcatggtcctgtaactgtcctagttccttgaagtttctcaccgagatagagctggtgatgataccacctgtgcagagtgaaaattccaccagtcatgagaagcctgcccagcaggtgaggtaactgtggcaaaactatctgagctctttttggagattttaatgcaagacagcacaaatctaaagtcagcttcccagccatagcatcactcagtagagctggcctcctgcctgcctgaggccgattatgacagtaatgaattaaattttgtttaaaccactctgtgactctgcactgtgcaagctaggaacatttgtatctcaaatgtacagtaagaaaacaagccctgagaatgaattcttagcattgaaagagtgaataaaggaagaacaaccattggagagacagagaaatcagctttaacacaaagatcaaaggacaaccagggttagctgatattttttgaaatggagagaagaggaaatatgcaatactatacaattccatggataagtgatgtttgacaactggcaactagtttcttatcagtggctttatcaaagttagtttcaatgaaatactgaaggagcatgctaggttatgaaaaggtgaagaagttaggaggttgaaacaataaagggagatcttcaggaaagttgcagggaaggtaaggagaaagatcagatagaagtcaacaaaagggacaggatgaagattattgctgatttgctctgttttgttttggggagaaaggaatttgatctggtacagagagtgaattcctagacaaaataaggtgataagtcttaaggaagatagaagaatctgggaaaagattactagaactgctgtagatttaacatttatctcctttccacaattcatgtgttaaaacctagtcccccttgtgatgatatttggaggtaaggtctttgggaagtgattggatcacaagagtggagctctcatgaatgctattagtgtccttagaaaagaaatcactagcaagtgccccttagcctctcctgccatatgaggttacatcaaaaagtcagctgcctatgaaccagcaatcaggccctcttcagacacaaatctgctggcaccttgataaaggcttctgaaaacattaccttgaagtccctgagcatgtttaatgaaaggaaggggatcaaagaggttgattagaaggtttttaccacaaaataaaataaaataataataaatttcacatttgagaggtagagatttactgactggttgaacaaattgcaagctataacctgggttactgaagtagaatgataatagaagtcaaaattaggttacgtagatgattcatccaggtagctattcagtcaatatgatggcaaaatgaatctcaaaggagagaaaggcaaagctccagataccatatattatattgaatatgaacaaaattctacaacttgtggtaacaaagatacctttcaagctatattttgggttgtctgtcacattgttatctaaactatattcctaaatatagtgattgctaattttaattataaactaatcaatataacttcacatttatactattttcatatataatcatgcttttattgaaagtataaaagcataatacatcatagaaattatttttgtattgtactacttgatggattgttttgatttgtgaaactataatccagatgctgaaatcacagtttccaaaaggcattaaagattgtcatgtttttatgtgactctgaggttgccattgtaactcatcatatattgaagcaggcctaagttcaaatctaaatacatagttaacactaaatatctaagtctgcaattgttagcaatgtgcagaaaattacattgccatgacaaagggcaccatgccagttctcatgaaatcatgggggcatcagttataagggtgggagacctttatgatttccaagccttttccaactaggaaaagtaaaggcaacagagatttttcctaagccgccaagcaaatatctctgggatcaggttcatgatgcttgtcactagtgtgtgtaaactaatcattcattttatccatgttgatttgttccagtacaatcacagaattagtatactcccatgtcttaactatttccttcattagcttactggctctccatagtaattaaaagcaaacacaataaagattaacaggctgagatggaaagagacaaagtaaatataattacttcattttataatcagatggcctgccttttctgcccacatttctttactctaagagaccaatgcaaaataatagggacgtggaaaaactgttattgatgccctctcaaattccctttgccattctgctcatgattgcaagaatatgaacaggttctggacttctcttcaaatcttaaaattaactgtgcccattgtgaataacctcagaggcttccagtacttttttataatgccccttaggaaattaattcataccacatccacatgttgagaacctactctctgccaatcactgtgctcaatcctgggctttttattcaagagtcttatattagaagagcattagaatagggattgttaaacctcaattgccattgaaattcaaaagatccttcaacactacaactggcccaagttgtagattgtagctctaaatgctattttttcataagactcaccttgacattaaacttgatcaatttttaactttaccattatagaatgattctcccaatacaagagatggttcccaggactcttattgatgtataatttttatcttatctgcttataatagaatttactaatgaatcttatgaggatggtaaacatattgagaagaagaaaagaggaagaagaaaaggaggaaaggaggagaaaagaggaggaggaagaggaggaatgaggaggaaaaggaggagaacgaagaggaggaagagtagtcaaatttgttataataacaatagctataatagacataagtattgaggacctagtgtgtgtagctaacataccatattacttaaatatattattttactttatctttacaatagccctataaagtaggttttattactaccattgaggcaaataattcttacatcaagtagcttacccatagatactttcttaataaataataattgcagaatttgaatttagatcttatgttttaagtattattcataaaattattaatttagataaaggtttttatcatgcctggatgaaatattttgacttcataaattatttaatttttccattttgacctaaacatatctatactataaatagtttttttaaaattcagcttcaaaaaagttggtaaattaattcaatgtataatggtatctatttccattgcagattgtcaatagatcttaaaacacaggtgacagaacagtcatttcacatgtgtgagagcgtctaaaaagctagttagcttgctgatatcaataaagcaatttaacagtgttttgttcttttatatatattatatataatatataattatatataattacatatatataatttataatacatatattttatatataatggatgtaatatatataaatctgtcattatcttgaaatctaattattactgaaatatctatttctaacaggctcaggaaatagaaaaatggaagagggagaaatatgtttggctcataaaatgaaaaatactaaaagagcacttatatgagggaaaaaggaattttggtccttttatattacatgatattacttttcatgatgagagatatcctagctaattaaatggttaattttatttaagaagttatatctatacatgaaacacttcgttattttgccttcaagaactaggcatgaattcttttttttttttaataggctaactaatgggttcagattttcaatttgggatcattaaattgaaggcattttggccggcagctgataaattctgcatcttcctcactccggctgcatagagtgggtggcatggacttatttattagaggcatatgggttccatttatatttttttcttgcttgacttaatttgcattttaaatagttaaagttatttgcaataagcttggttttttttaaagccttaccagagctcccatatgtttttttaggataagttgtaaatgacagtgttttcattataaaattattttctaaactaaatcgttttttattacaaaacttttctaggtttattaatgaaaattcacagagtatacaaaagtgtgaagaagaatctaaaaagaatctgtaatcctctcatcccaaagacaaccaagaatattgcattaagatatttccttctaggcttctttaccctttctatttacatagtttggttacatcatatatatagtatagtaccctgctttcttcactgtatttatataataaataatactgtgtaatattagatattatttttgaatatgatttttaatgattgcatgtccttctgttatgtggaataaattacatatctaaagagctagtgcaataaaccattaaatttaaggtattcatcacatttctgatttatatgcagaacaattagcagaatcctatctgatctggttgtatgactatattcatgaatttgttttctaaaaagatcaaattttgaacttactaggagatgcctcacatatcgtgtgtgtatgttagtgtgggtatatgtgtatgtatatatatacatacacatttggtatttttctatacttgtttgatgagataaagatttacaatttttagatttttaatttcaagtatgtatttgtaaactatcaggaattatagtttgttgcaattatgaaatattttgtcagttaggttttcctgctgacaagatagatgataaaacctttttactgaaactatgcttctttatgaaacttaattaaatatccaggagttccttactttttacagaacaaaactctatcatttgtttctctaagagtatattttactctaacgtcagacacgttggactagccacatctacctgactgttcaaatatttgctaggtaaaaataaaattatttataataatagttcccttcttgaatatttggttggtgccacatatattgctgagtacttcacatgtgcgaattaatttaattcccataacaaccttctaggtttgatactataatcaatgcctttttgcaaatgaggcatgcaatgcacaagagactgaaaaactttctcaaggttacaccactagtaaatgccagatgctgggatttatactcaggtgaagttttttttttttttttaaagtgcataagaataatgacgtcaataatattttaattattttgaaattgtttccagcttcactcttgatcacaagctagtgactagaacaggttaatcatagtgaaaactaatagatatgctgtttaaatttcttttttttattattatactttaagttttagggtacatgtgcacattgtgcaggttagttacatatgtatacatgtgccatgctggtgcgctgcacccactaactagtcatctagcattaggtatatctcccgatgctatccctcctccctccccccaccccacaacagtccccagagtgtgatattccccttcctgtgtccatgtgatctcactgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctgttgtgaataatgccgcaataaacatacgtgtgcatgtgtctttatagcagcatgatttatagtcctttgggtatatacccagtaatgggatggctgggtcaaatggtatttccagttctaaatccctgaggaattgccacactgacttccacaatggttgaactagtttacagtcccaccaacagtgtaaaagtgttcctatttctccacatcatctccagcacctgctgtttcctgactttttaatgattgccattctaactggtgtgagatggtatctcactgtggttttgatttgcatttctctgatggccagtgatgatgagtatcttttcttgtgttttttggctgcataaatgtcttcttttgagaagtgtctgttcatgtccttcacccactttttgatggggttgtttgttttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaatctcgtcttttgttgccattgcttttggtgtttcagacatgacgtctttaatccatcttgaattgatttttgtataaggtgtaaggaagggatccagtttcagctttctacatatggctagccagttttcccagcgccatttattaaataaggaatcctttccccattgcttgtttttctcaggtttgtcaaagatcagatagttgtagatatgcggccctcagcaaatgtaaaagaacagaaattataacaaactatctctcagaccacagttcaatcaaactagaactcaggattaagaatctcactcaaaaccgctcaactacatggaaactgaacaacctgctcctgaatgactactgggtacataatgaaatgaaggcagaaataaagatgttctttgaaaccaaggagaacaaagacacaacataccagaatctctgggacgcattcaaagcagtgtgtagtgggaaatttatagcactaaatgcccacaagagaaagcagaaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcacaaaattaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctggacacatacactctcccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacaccacaaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcactagatgcagaaaaagcctttgacaaaattcaacaacacttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctgtctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccagcaacagacaaacagagagccaaatcatgagtgaactcccattcacaattgcttcaaagagaataaaatacctaggaatccaacttaacaagggacgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagatttaatgccatccccatcaagctaccaatggctttcttcacagaattggaaaaaaaactactttaaagttcatatggaaccaaaaaagagcccgcatcgccaagtcaatcctaagccaaaaaaacaaagctggaggcatcacactacctgacttcaaactatactacaaggctacagtaaccaaaacagcatggtactggtaccaaaacagagatatagatcaatggaacagaacagagccctcagaaataaatttcaatttaatactaaatttgtggaatatgttggtacagttgatgattttatagcagagatatgttcatactcaaatattatactagctttgctgcttctgaaactgtacaaatatattattgaaaaaatgtcttaaatgtagaaatatgtaaagtccagaatgcaaaaggaaataaaagcaataaagctatgaaagtggcaacactgaagaagaattgtaactgatttagcaggcccacaaaagcactgagaacactgtgggaaaagtcaagaaggaggcagtttatactacaggaatcccaaaaaggcttgggaattttaggatcaaatagtagaacacagtgcctattcttggatattttatagacttctggaaaagacacacagagtcttcaaaaataatatcgcagattataagattgacatacaactaggacatagaggagggtcactgaacctgtgaagttttgaggagagtttacagaaaagacgacacctgaagtgagtcttggaggataaataaaagacatgatgtagccaggcgcagtgtctcatgcctgtaatcccagcactttgggaggccaaggcaggtggatcacttgagggtcaggagttcgagaccagcctggccaagatggtgaaacccccatctctactaaaaatacaaaaattagccaggcgtggtggctcgtgcctgtattcttagctactcgggaggctggggcaggagaatcacttaagcctgggaggtggaggttgcagtgagcagagatcgtgtcactatactccagcctgggtgacaagagcaaaactctgtctcaaaacaaacaaacaaatgaagatatgaagatatgacgcaagacagaattagtattccaatgccaattggcatttggtattctactaattctgatttgagatgtagggatgaatatgaagtaaaaacaggaggaactggatcagaagctttttaagaagtggtcagacctccagttgtccaacccaactcttgaaatagtagataactgtctcttttctatcttagcaaaagactagagagtttcctctgggaaaagaaaaaaagaaatgtaatctggatgggacacactgcacagttgagggctgaacacaggttaattaaatattgagaagaacttttttccctccttggatcctgtaatcctggcaacctggtgtgagtctacctgatcaggactatcactgatcctttactttccctgtatatctgacacgtgcttactgactgcaagtctgtacatcattgtaagcagtacagatatgaagaaaacatagtgttgtgagaaataatttaacataattaatcataaaaaggggatttagagtttagattcctggtttatgatcccatctaagccatcggttggttgtgtgggtctggaaagttagctgtcctggcctcatttttatatttataaaatgaatgaaactaacagttacaagaatagttctctttagattgtgacagaaaatcatactaaaaccgacttgagaaaaaaaaagtatgtattgtttgtataactgagaagtccatagttactatgaatttggatgtggctgaatagaacagtatttggttacctttatctcctggcctggctgtggtatttttcctagataggatttgggggttatggagtcttacatccaatgcaaagatggactagcacaggaattctaaagggtttttaaaattttagttttaagtgaaaagagagtatgagatttttagatataaagacttagatttatagcttaattacctgaaacggtttggggaaaactaatccacagtcatcagttttgaaagaaatgtgctttaagacaaagcataattattgcctacctccaaagttttattaacctgccattgatctattaattattttcatgactactaacatgaaatgtgaggccctcctctgattaaaacaatgcactctcagtcctatataattcagggttcaaatccagtgggagagaaacaagcttctgcaaggttcccaagagtcaagtggattgaacaggttaggacatcctgaaacaatcacggaagccaaagaagcatcttcatagcctaagtctttacttacctcttaacatgcttactctatggaattcccaatgcactttttctctactctctcccttcttgttttcccaatctgagcatcctggcgtctggcacacaggcttaccttatctcttggtttgcctggtgccacagtttacaatatgaaaatgtgtaactatttgttgatgtccaccaccatcctaaaaccagctattctgtggcgttgcttatgcctgaaatcccatactcaacctggaataccaattctggtttccttcgtatctcttatttatcctccaagactcacttcaggtgttgccttctctgtgaactctcctcaaaacctcatagactcagtgctctttctctgtgcgctagttgtgtgtcaatcttataattcgccatgttatattgaggactctgtgtctgtcttttccagaaacctatgacatacccaaagacagggactcccagaatcgaatgcagttcttatcacaaaatatacatgtgatgtatattttgccatcatatgcatcttaatgtttcccatattatttcgaaagtatttatttcatgtcttttctgactttatattcttcacatctagcactggacctgattcactattagtactcaataaacgtttatgtaaatgaatgaatgaatgacatgctttcttttgagagctttttaaaaaaaacacaggtatgaaaagcatgtagctagggtattatctcaaaagaaaaaatacatttgaaatcattgtggaggaaaatttattgagtatgaaattctatagaagccatataatccaaaatattgctacctgcttttacttgcttaagaaattcaaggctttctagcttgtggtaattttaaaatattttgaccaagatattaatatgtttaaatagcaaagtataatactaggatatctgatggtaatttactttagaaattctgcttaaagtatctttggattgtgtctaaaacatcaaagaattcatctctgagtttagaaaatgtgttgagtgaaatgatagacttctaatatttgttgtatatgtaatttatataaatattttctgaaaaaatacaattatatgtatggacctttccatatttcttaagtttcttcttaagtttttttcatattcttcatttgtttttactccttgatactaattctgtaaaataatgaaaatttttagaaagctctgttgtacaaataaaaatataaaagctcaataaagttaacccaaatttcaataactaaattaagttggatttcaactcagcttgattcttatctgggccagagtttacaatttttgttcataaaggaccagacaataaatattttaggctttacgggccaagaggcaaaatcaagatattgtgtatctgtttacacaatgagagaaaacaaattgtccccaatttttctaactatttagaaatgtaaaagacattcttaaataacagtgtacaatttgggttttttccatggccatagtttgctgactcccatggtggtgaaacaaatccaaatcttaactgttagactcttaagtttaacattgattctctgtattagtttgctaagactttataacaaagtactacagattgggtggcttaagcaacagaaacatattgtccaggcacagtggctcatgcctataatcccagcactttgggagactgaggcgggtagatcacctgaggtcaggagttcgagaccagcctgaccaacatggtgaaaccccgtctctactaaaaatacaaaaattatctgggcatggcagtgggtgcctgtaatcccagctacctggagggctgaggcaggagaatcgcttgaacctgggaggcggaggttgcagtgagccaagatcacgcctttgcactcccagcctgggcaacaagagcaaaactctgcctcaaaaacaaaaaacagaaacatattgtctcacccttctggaggctagacattagaaatccatgctttggtaggcttgttttctcttgagggccacgagtgagggatcctgtctccttgtcttgtagttagcttctgtgtcttcacattgtcttccctgtgtgtgtctgtgtccaaatttctcctttcagtaagaacatccatcatgttagattaggtcccactccaatgagctctctttaacttgattacctctgtaaagaccctatctccaagtaaggtcatattctgaggttctagggttagggtttcaacaaccaaatttttggaaggtacacaattcaaccgataacattctcattctctttgctctacatcagacctaatttctatgaacccaagtaacaagtatgagagttgcatttcactctttccactcttttttttttttttttttttttttttttttttttttttgagacggagtctcgctctgtcgcccaggctggagtgcagtggcgggatctcggctcaccgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccacctcggcctcccaaagtgctgggattataggcgtgagccaccgcgcccggcctctttccactcttttaaatttaaagccatagcttctctctcaataacctcacagcacaataatagacaactagaactgcattgagacaattctccatggaaagatgactctctgagatttggtttcccctcccttcaaaacacccagaagataatgtggcatagtgaaatcatctgaatacttaaccactttagcaagagagaagtatttagaaaaatcaaattataaagacaaatattaattttgatcatatttctaacaaataatgttgctggtttttaaccacttgacttggtgattccttaaatagatcaaaaggcttatacacaaataacatcctcctatgtcctagcagcactcagaattgactccaaaataaaactgttatttgaaaaccccagctgtgagtatgccttggtgttagaaagtgtcacaccttttgtagctagaactgtcacagcatgaagaactgatgtgccattgagtcctacatcctgcgcaaggatgggctagcacaagaattctaaagatgtcttttttttatttttaaatgaaaagacagtgtgagatttttagatataaagactcagatttatagcttagctagctggaaatgccttggaaaaaaatagaatcataaattttgaaagaaatttgctttaaaacaaagcatgattatttcttatctctgaagttttattagcctgctattgatgcgttcattattttcatgactgataacatttttatcagcaaaaaggctgtattttttgatattttttatttggtatttgatatctgtttcacaatcccaaacctactttaaaaggacgattataaagattacataagatagcacaccataagtatattatacagtgtcagtcacaatcctttttcttctcttcatagaaaaaattattagcagacatcagaaatcagttaatttttgaaaactctcacttctttacaaataagacaataaacaggaggcttttttatttagagaatggctggataccccagtgccctggttttatatctggaatagaaccatctccaaagagaacactgtacaaatgattaggcctaccctctaagtggagtttctactgattctatgcatgataaataatggttactctcttgcctacgtaggacagtaaagaaagtgaaggtcacttgtacgtgtttaaataataatatgacagatatgtgttaagccttgtgttcataatcgaagatattgtatcctgcattgtgtaaatgaggccactgaagcatggagagttaatatattaaccacaaaaatgtattttgtctatattttaatatgttatgaacctgttgccctcttccccacccattttgttgacaataaaatcttaaattatagccatctagacattcttaaacctggcattttagacaaaaataatttggggacagggtatagtttacactgtttctaacttagaagttttatctcttgcatagtaggtactcatgtggtctgattgagacacaaagtataaaagtaccaagggccagtagaaagtggaaaatgaaagtatcatgtccccttagcaagagaacagaaagactaggtcaagcattctctcgttttccaaagatcattaaaaacccttttgtaatattaagtagtctatgtgatacacagagtgagccttaaattaacttttaaaagttttctatcttgaaatatacttttaaaataaattttcacctgcataaatgttctctttggattaaagacttaatcaccacaatttccagagatacttttcctacccttttgattccattgttgttgtaatgacagaaactcattaacacagtgggtatcagtattgattatgacttttagactttactttttcccattatagtttaatttctgtctaaaatagatcataattctcaatctgctgctgctttggagtttttctaagatattggaccatttactcatggtgagataatagtgttcaaattgacactggcagtcacgaggtaccctggactcttttctcctatttgatgctctgttttgtggaatagaatagtatgtgtagccttccatgcagaattaatcatgaaaatgaactgcatactgcaggtacaatcagcaccatctaattacctcaaacttgcttgtcttatgactttatttagctgagcacatgcatttgataataacaagtaggataattcaaaatcctgtcaaccacaggcaatttagttatcataagtgaagtccggtgtgttttagagatcgtatccatttgacaagctagcaggtatgaacaggaaaggcataagacaggaaatagagaagtcagaatttgatttattaattttttaggagaaaagcctatcaggctatgtaagtcttttgagtctttctttaatgtatatattaaatattcagttaggtctattgttataacacctctagcatcttatgaactatagcgtgataatacgttaagagagagagaggttgattattttgactaccaggaatgttcttttcttgaaagaatctctgttggtcagagtcaacaggcactcttatgccttttatgattctccatgtgcaggtacaactaatgaacctggtagttcagtaccgtaaagctcatggagagcccggtgaaggctgagtatagatgaaggtcttggtgctcagcatggcttgagggccctggattgcaaccctttatagcacgtgaatgtcaagagatgagtcggggaggtgtgctgtgctgtggatgctcctccgagcttgagtcagctgtccatcttgctggcagtctcttgcaggctgtcaccatttcctctcactttctttcttgctgctttttctcctaaaattctgacctggatctatttacccatgtaaataggcaggggcaaatctggaagtgggagagaggctcatctgaggtgttatgctgttctttctctgtggaaacgaagtttctcccttttcaaagttaagggcctaaggctttggttatcttccctggagttaaggctcctcagtgctgagccttccacactcaagtgcccctttccccgggcagctcacactgtgtatttctgaatctacccacaccacaaagataaactttcaatatgaatgctaaacattcccaaaacaagacttttaagtagatcttttcctggatgttctttcattgatctcattccctggctaatatggtttagctgtctccccacccaaatctcatcttgtagttcccataattcccacctgtcgtgggatggacccagtgggagataattgaatcatggggacagggctttcccatgctgttcttctgctagtgaataagtctcatgagatctgatggttttataaaggggagttcccctacaaaagccctcttgcgtgccaccatgtaagatgtggctttgctcctccttgctttcttccatgattgtgaggcctccccagccatgtggaactgtgagtcaattaaacttctttcctttataaattacccagtctcaggtatgtctttatgagcagcatgagaacagactaatacatggcttaagggcacgtattaatacacaggcatatgcattatattttcaaatataaatattggctgatgaattattttgtgttattttgtcaatttatcacccgttttgaaaatatctgtgcacatatttttagaaaatcttgttgtttcagatcaattaaaaattgatttttctcggaagttttcccttgaaggtagtcagtgttgaatattttggtatttggttttaagcacgctgtgtatgatttctgttagtctattgttaaacaaaatcactgtgtgatatagccccccccaccattagcatttcaatagaacatacttaattgaaaaggtatgttttgacatatatcacctttttaggagaaaagattatccctgatacccataaccctacaaacttataaccctccaaattctctacttttaaaccatgtttttaatttcttcccaatagctgaaacccttttactatgctgcttagaattcataatccactgttggctgaattgcctctattagtaatttcttcttgaaacatgcccttccctttgttcttttcactgaaacctgcctctcccctgaagactccctgtagtccttgtacacattcttttcctcctgggcctgggggtgggttaaatgtctactttcatcatcacctctcctctgaaagaaatacctatgttgaagcctgtcttagtctatttcctatgacttataacaaaatatttgaaactgaataatttataaggaaaagaaattcacatcttagagttatgaaggctgagaagttcaaggttgagcactacatctgttaagagccttcttgctagtggggatgctctgtagagtcccaaggcagtgcagggcatcacatggtgaggggcagctgagagagagccaaactggcttttataacagacctactcacacactaacccactagtccattaacccactaatctatgagtaggttgatacattcatgagggctcagccctcatgacccggtgatctcataaaggtctcacttgtcaatacagctgcattgggggttaaattttaatgtgaatttggagggagcaaacattcaagccataacaaagttcctaccatcaatatagaccacctgctatccctcctagttatcatttcaagaaacttatgttactgtccctgagttattcaagattttaactctaatatttttgactttctaacactactgttattttaatttactgtgatatccacatccactgacccatagcctcacttctcagaagcttgacaccttatcctttaatgatcttgccttccattctacttgtacttcagtcacacactcccactgtcacaccctggaacttgtccttagtgaaaacttcaccttctccattcaaacagggttgagtatcatgctaacaactacccctatttttccagttcgcttcctttcttattctggctccaagaataatataatctgaccagtgcctgcaattcattgatacttaactcgtcagaatcctaaatacttgctgagttgtcatatatttctttgtacaagttaggttccatgatctattcaaaataaccagccaaacaaaaaaccttacttggatattttttctactccactgcccctttctcttttgcttatttgactagaaaaatctcaacttcagttaaaaccaacattttatctactctgctcctgtccagctgaatgtgattggataaaactataaatatcatgcagactgatttcatagtatgttcatgactagtaatctcaagtggactagtggtgtgcacagaaatcctacatttccctgctccactctttcattctcttaacaaataattcacaactattctttctcctcaaatttccagtctttctttccctttctcagttagcatgtttacagcttccctgagaaaatggaagaaatccaaatatcagtctcatcatcccagctacctccctactgatggtttacatttatatcagccttacctcctgttactgtgtatgaactgtctcagttaaatatccaaggctaaaccctccagttaggcactggatcccattccctctctgtgatcaaagtcatagctctagttatttctaaactgtcctgtatcaccaatttttttttgtctttactatatcattcccatcagcacaccaacattttgaagtttctctttcactataaacaaagtagacaaaataaaccccaaacacccctccattccatattgcccttgagccaccactctctctctctctttctctctctctctgctctcctttgcaataaatcccttgaaatattttttaaagttaccttgctatcatcaatttctctctgttgtctgttgaatccactccattcagtgttttaccccatcactcttctaaaactgtttttactaaactaatcaatgactttcttattaaggttagcaatggctttcattgatataaaatcgatgttgctaaattcattgtttaattttcgtgtctctcctgacttggcctatcagcactctttgatatgattgattacttagtcttctgtgagatcttttttttcctcttgtaaaattatttatgatgtttgaatagaagagtaaaatgataaaatttcacttcaagaagagtcatcttgataaaataaaaaaagagaaaaagacatataaaaagcattgccatcatcaaagggatgggtaataatcaacataattagattgtgttcctataaaaataaagtatagaagatatattttaaatatacaactaatgcaaattgcagctgatttgatattaaagtgagagtaaacaaaacctgtatttgcaataacaagtaaccctctaatgtcagtggcttacagtaacaaacatttattccttattcacaatacatggcacagctgtgaattacctgctgtggcttgactttacttgttttcttattactagactcagactgaagaagcaacccctgtttgggatgtcttttcttgagacagaggggaagagcaaaagaggcagcagaaacttacacagacccttaaaggttctggcatattccatgtatgttcatattccattggccaaaacacatcacatgcccaaggccaaaagtcaatgagatagataatgtataatccacaaaaagggaaagtagatggaatatttgtaaataatcatacaacttactatagtggcaattcacactagtttctttccttctaaagtgattgtgaaaatgatgagcagaaatagaagatgtagtagaagggatggatttgggaagggagaagatgaattcagtaagaaacatattgcgtgtgggctgaacattcaggaggagatgtcaggcaggcagtttgaaatggaaaactggcacttaggaaaaaggacaggctaaaaattttgagtacagccaagaacagattatttgggaacacagcattttggcaaaggaggatgaggagatataactacaagacagagagtagctggttagcaaactcaaatgttgagtaaaatgcatcttgataataatgccaattgatgatctacaactaagtcatccagactcattcagcagtgggttttgagttctgtaaatttgtcagagacaatgtgtcatagaaattaaaagtacaagctcaggaatgcaaacgctgggtttcccttcctgctcagccattttgtaaatcttagccaagattgggtaagttacttcacttctccaagcttgtatccttttctacaaaataattaacactggcgtttacccgtgcaggattgttgagaggattaaattagattatgcctataaaatgttcagatagttcctggttcattttaagcaattaattggtataagtagtattactaccaaaattgcataaaagaaaacactaaatctgcctttgtttacatttgttttaataggagtctcttcttcaagtatatgttttctatttactagttttgaaaattttattgacaacttaataagaaagtctgggatatgtattgttaggcaattatgtgaaaaatgcaaataatattaatttcaattataaaacatatgcagcattttaagtaataacatgtttattttttgattcattatgccaaaatgctcaggtcttgttccttgcaagagtatggctacacagtacacatacttattgctaccaatatttttatcacagtgaatttatgagagtcttgttggacaatgtggatactatttacctgcaacctcttaaatttgtatgcctaatgagaagtcttatggtaataaacattatttaagggaattaatcattgctgagggatcttttcactttgccaaccttggaagttggctagaattaaagacttggaaagatatagctattctactgctgacatttctgcagcaccccctgtggtacagattcactttgcattttattctttcctctatgatcacttctttcaatcattacatgtcctcatctatgtgttgggatcccagtggtttcactgggtttctttcatagtagtaaaaaataatctttcatgaagaagacaccctatatgacaccaacactttttcctatttttgaattaactgcctatgaagtctttaaaactgtcaatgaaacaataggttttctacagcctgtagcccatattgctcttttatgttatttttgtggttttcctgtcaaatagtttttggtgtttattttctttaagcatcactaggcatttgttaggctgcagagctgattaaaatccagacttccatatgagatttacagatgttgtagaattagagaaaattagcttcaggtctggcagtgattttctaaaagtggttccattgatctcactgaaatcaaggatttctttgctgagctgccaagatacataaatcttctatgagaactgattttgtaacagaccttgacatgtataatctaattctagaaaacaaacttctagctgaaaatcaacagcctaaaggaagattaaagattatgttggtatccacatgaatattttgtcctgtatagcacagaggagtagggaaaatcactggacacattcagaaggaaccccaaagcatctagatgttaccaaagtaaccaccctggaaattgcaatctacagcaagaaatgagtatttcagagatgaggtcgtaacctgagtgggatttaatgcttggttttatgtcatttgacttaaaaaaatatgacagcaatgttagtgtgttataatctagcaatggtcaaggagacaattataaaatgtaagctctaaccttcttgtctttctctagaaatagtggttcatgaaatgcaagttgtgaagtgaattttcttcttttgaaattttttctatacatattccttcagtgttttagaaataacatggccagctaattatttttatggttctatgtatactttagatttaattaggggtctatttatttgtcccagtttcacagataaattataataatagcaaattatagcagattaatttgaatattcacttatagatcaacataattaatatgaactattatgtttattgcaaaaggagtatcagagaacagtatcacagaaagcttttgctaaattaaaaacaacacacctctcttccaagcataattaatgctaccattttcttttcctttctagtgtttcttcatatatatatatatatgatatacatgatatatctcatatatattatgaatgacctcatataacttatgagggtcattcaattttatatacttcttatccacttaacataatggtttttataatttttgtgagcaagactttattgttttaagtatacaattaacataatatataaaatacattaaaatcaattagttgattgttctgaaatgcatgtgaagaaaaataagtgtataaatgacatagacaaatataacaggttaaaatataaaattcattcaattattgtcttttccttccaaatatgtttccaacaaagaattagacactattattatagaatgtgtgaatagattatcactgcaaacaatgttatctcaactgagtggacaagagggaagacccagtgatcacattggtcttgcaatttttcctttcactttcaccttcccttagtttgttgacatgcgctattgtaaaaaatcacagatgctgctaatagtgtcctcattctaaaggaaaaataaaaaaatcttcattctacttgtttcttctctctttgtcctcttaagagagatcaggaaataactaaataagcaaacctctaatccggaactctatataaatcctactgttcttgtgaccacagcagctctctaagtcttgcctatcttaggcagcaaatacatacttttacaggggtcctcagagaatttgaagatgggctgcttacccagaatccgagagtatgagctggaaaatcactgtgtgtcccacatcactgtataatgggaccaaaaatagacatgtcatactagcaaagacaggatccaagaaaacactgacacatgtaaacatttactgaaaccccaaacatcttctcttatcagcatttggattagtaattttagctttggacctttcactaggaactacacagtttattgctaatagttgctcattgatctcttagcatttgggattatgaagggattctattctccacatgtgaaatcaacataataggaatgtttgtgccttgcactgtctttgcaaatatcgcaggtcaggtaatttatatttgttatttagtcaatcactttaccatttttttccataccaccattcccttccccttttcccaaaaaaaagtcaatttatggaattcaaccaatttgtaagttcagatttcttttttctgaggttttaattcaagtagagaaaataagtgaatgcaggtggaagaaacaaggaaaaaatacatgataaaccataaagtaatgttagaattattatgaaagcattcagatgaccattttaacatattttttaaagccactattttagcatattaagagaaccacagcactttgctttgtttaaacaggcatactggtatttctgatttatcaaaaactaatctataaagcccctaaatacttaggcttatcaaaaatatactgtatttaactttgtagaggtttcttttctttatttttaagatgaaataaaccagttatttttattagtttggatgctgatttttagatttactattatgagtgatttttgtaatgtttattcagtttgaatgtatcagttggttacaggatcaagaatggaaattagaactcaaggtatgatgagatactagttgattcccctctgcctcctcaccatgtgtaagttgatacttgtgatagccagtatacatccatcctgttgacagtacttcctttgacactgcgtctaactcataaagaataatttgtcatcccaaaggatccaatgtatctatccaacttcatcttccattcctctttaacttaaaccttgatctccagatgggctaatatcctaaatctctaagcttttgctctcccttcagaatctactcagaattacgtacctctcaaatttggatttaagctctttctcttctactctggactgcctgacatttatatgatcttgtttgcatattttattaatttacctctattgccttgttgcaaaattagaatcattatctaagtttatctatgtctcttatctccagtatgccctgcatcaagcaattgctactatactttgtgtatggcttcctccccctgcccaaatacatacatatatatatgtgtaaatatatatgtgtgtatatatatatatatggttgaattatacatatataaagttgaattatatatatatatcaaattttatatatatataataaagttgaattaaattgaaagtgttcctatacacatgtttctttgattttagtactacaaatgattgtggatgatataatactaagcaataaaaaattcaaacatgttaagcagtttatccaaattctaatttaaacttgtttgaatttaaaaccttttctactaacattaaccatattgcctgaagatgcctgatgtcaccacagaaactttgtcttaaatgattccaagttcttagattaatgtaaagtatatgatgagctttttggaatattttctcaatgatcttggtgccatcaattctaaatagaaccttattgccagtattgtgtacctcattacagagtaaccctgggcacttcctttgtaggttctggttgtaattgacaccatatatattttttaaaaatattttaagtttttcaggaacaaaaactgttacggttgacacatcacaccactgtctttatgacctatctttaaagtgatacaaagagctactacaatagttgctttcatatttctaaaattcattgacttcaaagataaaagtcaaaaagatgtgaaaattccgtaacagtcttttcatgggatctattttttcactttcaaactcttaacagtaaaagtgaaagatgaatggtgttttgcaaggtgtcagaagtacttctgtgctgtgctgtattctgtgtgtgtgtgtgtgtgtgtgtgtgtgtgtgtgtgtgtgtgtgtgaatatgtccaaacagatataatttttagctttttactcaattataatactgggaaatgacataatataattccaaagtatgtagtttacgtttaaaaatgcatttttgaaatagacctgattgctaacctagctaactaatgcagactctacttataatgtgcgactaagggttcaagatcatagaaataatatctgtaatttctattgatgttttgggattgaaaagctcagtcgaatataacaatagtagtaactttacttttgtccttaatgttgacttcagaatagaattatgttggattccttgaaggtgcattattagccctatcttgctaaaaggcataactctttgattaatgttgataattttaatttgtagagcattaaaagttcaggaattgattctatgagaaatattcactactccggatgctcaattgaccaataatttaattcaaaacaaatgttaactgaaaacagtgtattaatcagagtccataaaattcacctgtggccgggcgcagtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaattcacctgttaattggctacatttcttgtgcaatttctccttttcttattttcatttttaaacaaagacagaatatacagaatcactatcctgcatagtacattcccaataaagcactcactcactctaaattaaagagttgtcataatggaaagaacgaaaatggtaatttaattttgctaatatttcttaccccagaattcattcattattcattcaccaaacatccacacctacggtattagcactgaggacacagtcgtgcacaagataaaccaggacacagatttcatataacctagaattttgcaaaatttcttgaatccttggaaagttgacattcaaattcagggttactttaacattgcaaacaggtatctgtggaaattgggggaaatgcgtgcgaagaaaaataaatctatgaatgacatattaaaaacaaagtataacaggtttaaatacaaactcattcaattactgtcttttcttatcaaacagaaaggacgttggaggggtgggaagaggcctgactcaggtaaaataatttgttgatattgagggagggccatagtgtataaaataatagatctttaaacatttgctcacacttagaatggtaatatttttctaataccagaaagaaactcatttcaccctttgaaagcgttagttattttcttttttttttttttttttttttttttgagatggagtctcgctctgtcgcccaggctgtagtgcagtggtgcgatcttggttcactgcaatctccgcctcccgggttcacgccattttcctggctcagcctcccgagtagctgggactacaggcgcctgccaccatgcccggctaattttttgtgtttttagtagagactggggtttcactgtgttagccaggatggtctcgatctcctgaccttgtgatctgccagccttggcctcccaaagtgctgggattacaggcgtgagccaccgcgcccggccgtgttaattattttctaaagtgtttcatccatattcgcttgggtcttcagtcaaattttaaggctatcttaggttaggaaatatagactttgtttctccctgctgcagagcacagaacaatgtatgtaacttggctttcatatgttaggtattagctggttggttgtttaaatcctctggggaaacacgccaaaccatgtctacttcttgcaataattttcatttggtcaaatcctggtgtacagattttgctctgttcatctttataagacctgtatgcacctagcaaattcctgaagtatgaatgaataaaagaagaatgagttaacaatatacaatgaatatgaatcattaacattttcaagtttctgtgacaaaatttgtgacagtctttactgtaagcaagcaaattcaggtgtaggttttacataatgcacttttatttatttgttataaatgggctaaaattaagaatctcagttacagataattactcatctatctttttctacatttcatatgttcactaaggacaaaagctaatttttacttacctttctgtaatcagcaattagtacagagccagaaatatagcaggtactaaataaatcaattatggagtacaagaacagagggaacattttgatctctggttaggaaatccaaagtgcccttcaatctcatagggcatgacgttgtaatggaagcaagtccagatattgtttttggaaataaaacacataacactatggtgtaaagatttgtacagcagtggaaaagctatagggaatagagactataaaccctctgttttagtttgccaagacaaagacactctgggggaaaaaaaaagtacagtattaagtagaaaatctaactattagaaaaaaataaaaatgaattatacaaacttatttaccaagtaaaattgtttcttaccccaaatcatctttaattttaaatttagaaaatatattaatcccaaaggactgttgtttacagagacaagacttaaaaataataattttatttacttttttttcttttttagagatagggcctcactttgtcacccaagctggaatactagagtacagtggtacaatcatagttcagtgcagcctcaaacacttgggctcaaacacttgggctcaaacagtcttctccagcatctggtactataggcacacaccatcacatctgactaaatttttaatttttttagagatgaagtctcgccatgtggcccaggctggtctcaaacttctggcctcaagcaatcgtcccactttagcttcccaaagtgctgggattacaggcatgcaccaccatgtctgacctattttgctttttaaggagaatttctaacatatcaattttgaatacaatccaaggattagatgtttatgctatatgtctattgatttaagagtttaactgaaagcactgtaacaaaaatggcttgtgaaatcttgagccagttgaaatcagcttgtcttttataccaaaagacacctagaaaatatttatttcaaatgcctgagatttaacctatggccaggttgttaaacagtggactgtttatttttaactgaaacaagtcaatggatataatggtgtaacattttaatgagaggaaagtaatttcccaagccaaaaaattgtactttgtaaaatgcaagaaattactaagatgattgcaaattgtgtaaactttgaagatgctaagactgtcatgtcaaccaagaatatcctaaagcatttaacctaattatgactttgtaaatatacaattataaatatgtactattttatttacttcagttattctttaaaatactaaggaatatgatgaacattgaggaaacggtgaagatatttttaattaccgggttataaatccaaaacaaataatatctaacattagttccttgtacatcaaaaatattaaaaatatttcttggcttggccaggcatggtggctcatgcctgtaatcccagcaatttgggtggcctaggcaggtggatcacgaggtcaggagattgagaccatcctggccaacatggtgaaaccccgtctctactaaaaatacaaaaattagctaggtgtggtggcacgtgcctgtagtcccagctacttgggaggctgaggcaggagaatcgcttgaacccaggaggcgagggttgcagtgagccgagatcatgccagtgcactccagcccggtgacagagactccatatcaaattatatatatatatatatatacacacacacacacacacacacacatatatatatacacatatatatatacacatacatatgtatatacatacgtatgtatatgtgacttgatagcatatttgttatgtttcatgtaatgcatttactttgtcagtatactaccacagcacagtgaataaaacctctgtaccagaatgtcttacaatttatgtaggcaccataatgagataactaatttctgaaattgacttctataaatgtcctcaatcaattcaaactcaactcttgaagagagagcaagagagagaaaaagagaaagaatatgaatataaacacaattaaagtgcaaacatatttgtacatgtttaacaagaaagagaacacttgaagaagtacagagtggctcaatgtgactattcgtaggtaaacaatgggaaacgaggctaaaccttaggcaaagatcagactttgaagagtgtttgtaccatgctaaagtttacagaatttattcctgctctttgagggtgcattgcaaatccaggctagagggagagataccagttaggagagtacagcaatactctactgggaaatggtgaggtgtttcgtgaagacaatggcaacacagatgaagacatgcagatggaggaaataaagatccagttgagcttgttggccagttggatagaggttgaggttatgcatgatggagcaatctaggtttttgtcttgggtaggtgtttccatgatagtactcagaatgaatcatatagttgtacaggttgaatcccacccatgtttgcacaatagagtgactgtctagctgaaatccagatgacactctgtatgctaagctatgcttcatggaactgtataaaggcacttgctacataggctagtggcagatctggaagtaacctatatggtatataggaaatgaggtggcttttgtataaatcctacagataaatttcatttcctgatcctattattttgactcatgttagcccaagaagagtattcagtacttcatatccctgaaggtaagacagagtagtattagattcactatttggcaaataaaagggatcaagtcctaagatcaagctgatgaatcaacacctcataggatatgtcccaaccaattatatggcttcccctataaataaaatctagttctcttctctggagaggaacagtgaagaatatcataacctatgctacaaactgcttgagtaggagctacttctctccaaggctttatatcattcattctggcaggcccctctgtttgttctcaccagctcctgggaaatttatttctcctctagtgatataaaagctctctgtttgagatgaagggctgcccagtttatcagatctgtattagtctgttctcaggctgctaataaagacatacctgagactgagtaatttatgaaggaaagaggtttaattgactcacagttccacatggctggggaggcctcacaatcatggcgaaagactaataaggagcaaagtcacatcttacatggctgcagacaagagagcatgtgcaggggaactgctctccataaaaccatcagatcttgtgagacttgttcactattacaagaacaacagacaggaaaacccgccccctcaattcaattacctgccactgggaccctcccacaacacatggggattatgagagctacaattcaagatgagatttgggtggggataccgccaaaccatatgaagttctttctttgttactgggtaccatatccattctgttgaggttctgagcctttccagttactgtaactcctctatctcctgtctgtgctaagactcagtgacctctctctgccttgcttctgctttgtcctgaccctttctgtgcatgcactcactctagtttgcccacctgaggtgagagatggtccagattagcaacaacaatctgtggactaaaatcctctttagggaggaagcaaaattcagatggatgttactaaacaaagctcagaaacagagaccagggtgtgggaagtaaggtagtagcctgagagcagctggcagtgttttagacctggagggaggttaggtcatcagcaatgaggagactgcctggaaaatcctagaaaattaagacatctggtcaggcaaggtcatatcaccagcacacttcccttttcaagttgaatccctttcctctgttaagaggattcaagtgtctttcttgcattttgtcttctcttctatatccatgcttgcaatataaggagacagcagttggctgtttgtgctagaaaatataaatggccattttgaaagcatgccagacaggatctgcggcaagttttcaatgttactgctgccatctgttgttcttcagtgctgggatgtgaatctcttggcaaacatctctctaattctgaactatctttcacccccatctagagatattcacttactgaagtgcctttttaaagcaatgttcctcaccaaggcgatgttctgaatgttttaaaatggaagaatctggaatgtttttattataatacattttgtatatcccaaagcaaaaatcaatttcttcatggttaatacttttgtaattttgtttttaataatattttccttttaaatataagaaatattttattgaattaatactttaatgtagctgtttcaagtaagataaaacagaacagattactgttttcaaccttgttcacagttagctctgtaactaagttgttgagctttatctaagcttttttatttttacataacgtttcccttttcacttaaccttgaaattatagtaatttgggaacttctattcctctgaaagagaaagctaatgccaaagatatttcaagggagaaagaaggtttttaaaaggagagacaatttagctcagacttaatagctgtgattgctatttattaagcagaacgcctataactaaattctcagatatccaaaaaacagcctgtacattctcaaaagtgaagattacacattttctaagttaaggtaaaagttttgtctctgtagcatcttactgatttctatcttctcattctgccttaataatgtcactaaataaatgtttgatgcactaatacatgaataaaactattcatggtaatgattctttagaaacacagctaagttttgtaattttgttttttaaaaattaaaaatttaaatataaaaatgtttttaaaaggcttgaatttcttgttaaatgtacacattttaagttgtaggctgtctttaaaaataatctctccacacactgtagtatttaaaacatcatgatattactataaaacatcaacaaatagggcagtggaaaacatggtaatcactaaaaatgctcacatgtcatatattaagacttgataagtaaaccacaataataaatagaaaagaaatagttgtctaaaaagggattctcacctttcaaaccttaccataaaaatggaatataaaagaaggaagaggaggagaaatcaaattatatcataaaattttctgggcaaaaatattacagaagaaaataagaaagatttatggagttgactgaaacatttttgaatcctatacataaaaatatcgttaattaaaaggaaaaacaaagaaacagatttgggaaatatttgaaactggtttttttttagcatttaaaaatgtaatacaaatggattatttaaactccattgcaaaaatacacaaaggacattgacaatgtctggaaataaaattagctaagtaagttatagaaaaactcagtctcacaatttgacaaatgtaactgaaaactattaatataattagtaactatttttacatgtcaaaatttttgaattactaaaggaaaccacaatgcctgaaagtatccagggttttttttttttttataatattggcactgtcatatgggtggcaggaattgaagtgatgttgtttcttcagttattaagttgcatctgcagtgtttcaaatgtccaaaacctgtgagtcagtaattctctttttgtatatttatcctaatacaataattctaaacataatctcaatatatatgtacaaagttattcactgcagtgttacttacaatagttagaaaattgtaaaatgctttatgcatcttaaaatataaattgttgaatatataatagtccatatgatataattatatcattattataaataatgaattagaaaataatttaagagcattaaaataattataaggtaatatgaagtgaatgaataatgtacagatactataatcagcagagtgttaactaggtaaatttttatgtgtgtatatactacttcctaaaaatgacttgacagaaatcatcaaaatgctaatggtggttacttctgggtgggaatacagatgatttactttgttccttttatgtatttctgcactgcccagtcttccacagtgagcatatattggtttttaaatttatataagatggaaaaagataccaaatggtcttcaatgaatcctggagttaactttcatgtgtgtcatatgttatattctaaacttatcacaaatagaagactttaaatcaacttgtacctatttcaactatataacagcatctttaaaatgagcattgaattaaactaccaaaaccaaccatcatgaggattattcaagtaatgtgtttaaacaaaagaatttgtaataaaattactttatctcctttgtgatttcagcccatttaaaaaaaatagatgtttctactctccttcagatatcattaaaacataaacttgtgcctgactgcataaatcccttttaaactaatatcacttattacgtttaactaagtctacctagggcttccttgtataaagaacaagagctttccattttttgtttacctagccctttctgatgccacgacagaatagctgtaaatcttcattatttatattctagagaaaataaaagcaaataaaaaggtcagtgtataaagtttattggttgttctctttactcaaaacccacatggtattaatgttagtctctatgaatatttcatggataaaatcagagcattaagtgcatactaaaaacaataagaatggaaagactttaaccttatgtttatatgaatttctaggttatcaagaagtttataggctataggctataaagtcttaggctatgatatagtaacctaatgtagacttcccttgatacatgaaaataatggtactaagtacaaacagaagatgagcttaaaattattctttgagtcctcttgatggattttttcccccacactttccccaaaattgttttatgcctatattgtaggagaccatgcaagagacctagagtctctttttctttcatcactttccaatcaacagcaaatcctatcatttttaccacaaaatatatcttgaaactcccttcttttgatttacttgtaactccccatcaaaaactgaagagtgtcacaatacttcattaagttccctacttgcactctacctttaatatatttgtagcactaaaatgtttttaaaacatatatctgcttatgtcattttactgctcaatactatctgattttctattgcacttctaagatactctaatttcttagcactctatataaaatcctttaagggcttccctgctcaccttttcagactcagaactatgtatttccttttgcctgctgtacttgtaccactggattcttgatttttgttacttccaggtttttacacttatttttacaataaatgtgaaataccctttttgacaatatctacaaatatttcttatttgtctttattgctctttcctgtaatgtttagtcttcattttcctgataatggctatctaaagttatctcctcaaagaagcagttatttattcacccaaatcttctagtccttctctggagttttcttctcacttcattcccttggtttttgccacaatttgtaataatttgcaatttggagtgttagaatgagggaataaatcacaggtaatgactatagtttgtgactatgtaagattggattcgttattgatttattccacaaacactgaggcactgcatttagccaaatgccaatcttgggcagtgagactctgaaagagaatctgcttcccccaccataaactacaaagtgaaacaactcagaatgtacataaattacagaatgaaagcacactagaagtaaacacagatgtggaagaggtaaagtgtccttgaaaatcatggaaagattcataaagggaatgacatttcaactggattctaaaccagttattcaagctccacaaggttgcacagtaaatgagcagtggcaggatgacataccttagaaagtaaaaggaatcttttttaaactgctataaaaatcattacatatacattttgtaggtcgagagtaaggtatttaacataaaatcattttagtatatcagtgtttatatagacttaggtttttctcatttaaaacctcttttaatgacttgtgcttttcttcatggtaataaaacattttcccaggaagtgctgaataaatctttcttgaaatacgttttattgctttctatcaatgaccctgaagtaatacagaatttacacttcagcggttgcaatgctcaaacttgacaggtaatgcactgtgtttgctgatataagaggtatgatgtagggctaagtggttttgtgctcatttagctttcaggagaaaataattgacttaacattttgatactaaaacccaaagcctaacagttaattcttggtattttaaattattattgcaaagattattgtgccgaataatatgaaaatattttatataatatttaaaaagtatatctctttcttggtattatttaaattaccataaaaatgtgcgaaaaagttatactgaaatgtgataggatcttttaaaagtggtgccttgattttgttaagtgttacctagttttcctctgaaaacaagaaacatacccagaagttttcacgaaatggtctcatgaatatctaaggttagtccatagtctcatctgagacaaggaaagtcccttccactatgagcctgtaaaatcacaagcaagctagttacttcctagatacaatgggagtactggtattgggtaaacacagctgtttcaaatgggagaaattggccaaaattaatgggttacagggcatgcaattccgaaatccatctgggcagtcaaattgtaaaactccaaaatgatctcttttgactccatgtctcacatccaggacatgctgatgcaagagataggttcccataatctttggcagctctgcccctgtggctttgcagggtatagcacccctcccagctgctttcacaggctggcattgagtgtctgtggctttcccaggaacaaggtgcaagctgttggtggatctaccattctggggtttggaggatgatggccctcttctcatagctccactaggccgtgctccagtagagactctgtgggggctctgaccccagatttccctcctgcactgccctagcagagattcttcatgagggccgtgcccctgcagaaaactctttcctgggcatccaggcatttccatacatctgaaatctaggtggaggttcccaaacctcgattcttaatttctgtgcacctgcaggctctctaccacgtggaagctgccaaggtttggggcttgcaccctctgaaaccacaggctgagctataccttggccccttttagcaatggctggagtgactgggacacagggcaccaagtctctaggctgcacacagtatgggcaccctgggcccagccctcaaaatcattttttcctcctaggcttctggatcagtgaagggtggggctgccatgaagacctatgacatgccctggagacattttccccattgtcttggggattaacactggctccttgttacttatgcagatttctgcagccagctgaatttctcctcaaaaaatgggtttttcttttctactgcattgtcaggctgcaaattttctgaacttttatgctgtttcccttttaaaatgcgatgctctaacaacacccgtcacctcttgaatgctttgctgcttagaaatttcttctgtcagataccctaaatcatctctctcaagttcagagttccacaaatctctagggcaggggcaaaatgccaccagtctctttgctaaaacataacaagagtcgcctttgctccagttctcagcaagttcctcatctccatccgagacaacctcagcctggtccttattgtttatatcactataaaaatttttgtcaaagccattcaacaagtctctactccaaactttcccacattttcctgtcttcttctgagccctccaaattgttccagcctctgcctgatacacagtcccaaagttacttccacatttttggatatcttttcagcaatgccccgctctactggtaccaacttactttgttagtccgttttcacactgttgataaagacatacccaagactggaaagaaaaaaaggtttaattggacttacagttccacatggctagggaggcttcacaatcatggcaggaggcaaaaggcatttcttacatgatggcagcaagagaaaatgaggaagatgcaaacgcagaaatccctgataaaaccatcggaccttgtaagacttattcactaccactaggacagtatgggtgataccacccccatgattcaaatgatctccaaccaggtgcctcccacaacacatgggaattatgggaatacaattcaagatgagatttgggtagggacacagagccaaactatatcacatggatttcttatacttttgcttttaataacacaaacaaaaaaatacatcattaaaaggttagaagtgagaaggtgtttttatggaaatcaaaaataatatcaccttagtgaacagtattcttatgattgtagttgaattagagagcagaatacatctagaagattcagtagtaagcatgtttcttcgattaatggaaaatttgaatagcctagctgattgagattgaggttactattaaatgcctgaagtataagagttggttgtttatgtaaacaaaatatctgttttacatgtacatgtgtaagtaggactgttgagccccagtaacatgaaatatcaaagagcatgactcgaatacctgccatatgaagtgctattacatcaaaaaagaggcgtgtgctgaaaaattacctacaaatggcattttcctcaaatcaattttaaatcttcagaatttcattttaataattgtttagttaatatttcagaatccctcatcataaaaagcaggcaaaaggcaaaagtccttgaatgtataacacatttgttttcaaacaagcctgcctctaactgtgaatccaggagtgaatccagaactacaaattaactaagattggccccatcgagttactgaacgttaaaaatctaaaaactaaaaggcatgcctcaacaattattttcttcttggaatcattaattaacctatgtgtatccaaacaataatcttccagcagtttcgctagctacatttttaattacttaatatcatgtaaaatttgttttattattgttcagttctgaattttgacatatgcatcaagccatgcaactgctaccacagtcttcctgatcactgatctgttctaaatctctatagcatttttccttttcttaaatgttgcataaataaaaccataccttatgtggccttttgaatctggcatctttaacttaatgcgcttgaaattaatctatgtcatttcatgtatcaatggctcaatctttttaattgttaagaaaaaatgtatgctgggataaatatctttctaaatgagtttttgttcacaatgctgagtgtttgtttaggatagattcctagaaatggtatcactaggtcaaacattcaaataattttaaaatatttgatacatattgccaaataatctcaaattttttaccaatatacatttatgacagtatgggataaatgtgtctttcttataccaactgacaacattaatgataatacataaaatattctttgctaatttgatgggacagaaatgttatatccttattagcattttattattgtggttgaatgactgtactgtacagccagagatatttggttcaaaatccatcttcattatttactgtatgtgaaaatttaggtgagctatttaatctcttgatgccttagtctcctaatctataaagtggggataattgtaccaatcatattaggttcctgtgagaattaactgaattactatagaaaatgcttagaatggtatctagtcaccaggaaggactctctctgtattacttgtttattatctaacacgtttaattattaatgaagctcagtttcgttatatgcttgggatatttgaaacttttcttagtgaattttccaataaaattatttgtctatttttctatggacaagttggtattattcttactggtttgtttcaggttcagttagtaagaattttaaggattttctatcacattttagcaaactttttctgcattttatcttttttctttcagataatgtttgcaaaatgtaaaaaaaacaaaaggtttcttcatcaagttggtatctttatcttttttattgctttgtgatttgaaaattcttgtcctgagaaccaaaatatatatttgatgaaatagttctcttcttttactcattctgaagtcattggaattgaatttggcatatgatataaatcctaattttatattttatgatattcaaaatttctaacaaatatttacttaataatctaatccaggtttctattgtttcttctgtttcctttataatgctttttctgaagttatttttcctagacttaaatattagtataatattatcatagaggaaaaaatatctgttagctatgaataaaaggctttcatcttattgttgcattaatatatttaaatgtagagagcatacagattagcaaagaaaaagtataattgcctttttttatagttgacatgaacatgtataaagaaaagccaaaaaaatcaataaaacaactagaacttattagtgaatttagcaagatcatagcatacaaagccaagattcaaaattccattttatttatctactaacaaaaactatttgaaatttgaaaatttaaatatgccatttacaataacatcaaaatattgaacaataaagtatttaggaatttataaaatgaaatctcctataccaggaattacagaccattgctgaaataaatgaaagaagaccaatatatgtgaagagatactcatttgtggattgagagacaatattgttaaagtatcagtatttcccaaattaatcaatagattcaatataatggtgaacagaacaccagaagatgttctgtcgaagctgacaagctatttctataattcaaatggaaatgcaaaaggcagtcactgccaacaccagcatggactgtctgggttccagtaggttacttcactactgcctcttctgtcagccacatcacgacagctgcccagaagccagagaaactcctcacacctggcccactgctgcagctaccagcatccaggcaagccaccatcagcccactggtaactgccaacagaggtaccactgtacactaccctggggaacaaagataggcatgtagtcagcccacctctgccaccactagggcctgaagcctggcccacctgacactgcagtcctcagcacagcttcatcacagcttctgttaataaccacaccctaacctaccaaggaaatcacaaatgtcactgacactgtttgtagccaaagaaatcatagagagactacattactgcacacacccataatcaaagccacagtaccctatccaaacaacatcacaggtatatctaaaggaaaaaattttcccatatgaaagcgaattcaaatataggaagaagcgactgttacaacagatatgcagataaagcttcaacaatatcctacattcaaccagaagaaagaatctcagaaggtaaagacaggtcttctgaaataatctagtcagacaaaattaaaagagaataatcaaatccttcctgacatttgggataacattaaagtgaccaaatatacgaattatagatacccctgagagtgaaaagacaaagaaaagattagaaaacccacttaattaaataatatatgaaaacttcctaagtctagcaagagttttagatatttgggatgcaggaggctcaatggtccccaggccgataaaacgcaaaaaggtcttatacacagcacattacaatcagactgtttaaagtcaaagataaggaataaattctaaaaacagcaagagaaagtgtatgataacctatgaagtaaaccttatcagactgacagcaaatttctggcagaaactttacaggccagaaagaataggacaatatattcaaagtgcttaaagaaaaaaaaaactatcagccttaaatactatagcccacaaaattatccttcataaatgaaggagaaataaaaggtttcccagacacgaaaatgctgaggtagtttgttactactagactggacctacaataaatgctcaagggaggtctggaaactagtagtgaaaggacgacatttatcatcatgaaaatacatgaaagtataaaactccctggtaagcaactaaagggaggtatcaaatgttaccaccagagaaatctaactaaccacaatgacaaacaataagggaaaaagaaaggaacaaaaatatataagacaacgaataaacaacaatataacaggaagcctcacatatcagtaatcactttgaatgtaaatgaattacattctccacctaaacgttatgaaatgcctgaatgataaaactatatgatccaaatatatgctgattacaagaaacttaccaggcagacatacataggctgaaagtaaaagaatggtaaaagatattccttgcaaatggaaagcaatagtgagcaggagtagctatacttaaattagatcatacagactttaagtcaaaaagagtaaaataaaaaagacaaaggatgttattatataatgatgagattaacccagcaataggaaataacaactctaaatgtatatgcattcaacactagagaactcagatccacaaagcaaatattagacctaaagagagaaatagactgcaatacagtaatagtggagaacttcaacactccactttcagtattagacagataatctaggcaaaaaatcaaccagtaaattttagatttaaactagattttagaccaaatggacctaacagacatttacaaaacattccatccaaccactgcaaaatgaaatttgtgtcatcagcacatgaaacaatgtccaagatagaccaccatatgttaggccacaaatcatgtctcagcaattttttaaaagttgaaatcatatcacatatcttctcagaccactgttgaataatgctagaaatcaatgccaagaataacgttggaaactatacaaatacatgcagattaaacaacatgttcctggttgatcactgggacaataaggaaattaagctgaaaatcaaaaaattcttgtaacaaataaagattgaaacataacatatcaaaaccagtggcatacagcaaaagcagtgctaagagggaagtttatagcaataaatgcttacactgaaaaagtagaaatattttaaaattagcaacctaacaatgtgcctgaagaaactaaaaaatcaagaacaaatcaaacccaaaatcagcagaagaaacacaataataaagatcagaaaagaactaaatcaaatagagactaaaaaaatacaaatgattaacaaaactaaaatttggttattcaacaagataaataaaattgataaaccactagatagactaaacaaggaaaaagaatatccaaataaacacaatcaaaaacgataaaggagacattacaacagatgccacagaaataaaaaggatcatcagagactattattaacaactatatgctgaaaaatggaaaatatagagaaatagataaattcctagaaacttacaacctaccaagctgttgcatcaggaagaaatagaaaacctgaacatatcagtaatgattagcaaaattgaatcagtaataaaaaacatctcccaactcttttaaagctttggaccaaatagcatcacagcctaattctaccaatcatgcaaagaagaataccagtcttcttgatgctattacaataaatcagaggaaggaattctctctggctcattctacatgaccagtgtcaccttgaaaccaaaacctgacaaggacaccacaaaaagaaaactacaggccaataaccatgatgaacacagatgcaaaaatcattaacaaaatactggcaaacggaatccaacagcacatcaaaaaaataatataccacaatccagagggtttgtatcaaggatacaagtatgactcaatgtaaataaatcaataaacatgataagcatcttcacagaatataagacaaatgaatatatgatcatctcaatagatgcagaaaaaaatttttgataaatttcaacatctcttcatgaaaaaaaactctaaaactcagcatagaagaaacatacctcaatataataaaggccatatgtgacaaactcagagctaatatcatacagaatggggcaaagtttaaagactttcctctaagaactggaacaagacaaggatgcaaactctcaccactcctatccacatagtactagaagtcctagccaaaacaatcagacaagcaaaagaaataaaaagtatctaaattgggaagagcaagtaacattgttcctctttgctgatgatatggttttgtatctggaaaatactaaaaactccagcaaaaacctcttagatttgattaattaatttagtaaagtttcaggatacaaaataaaaatacaaaagtcagtagcatttctatgccccaataataaaatagctaagaaagaaatcaagaaagtgatcccatttaaattagctacaaaaaattaaaatacctgggaataaatcaaggaagttaaagatctctgcacaaaactacaaaacactgatgaaagaaattaaggattaaacaaacaaattgagaaacatcccatgtttatggatcaaaagaattaatatcattaaaatgaccatacttcccaaagcaatttccacattcaatgcaatttctaccaaattaccaatgtcatatttcatagaattagaataatcctaaaattagtatggaatgagaacagagcccaaatagccaaagcaattctgaacataaagaacaaatctggtcctgacttaatcactatgcaatctatgcatgtaacaaaattgaacatggattttatcaatttgtacaaataaaaaaatgtaaaaaaagaacaaagctggagactatagtagccaaaacagcatggtatttttagacaaatggtatggaatagaaagctcagaaataaagccatatatatatatatatagtgtgtgtgtgtgtatacacacatacatgtatatataatgtgtatatataatgttttctacatgttctaatatttatattccattccattatacatattccatttctgtatataggttatatagaattggaagactatctgccattaaaaagaatgaaatcctgtcatttgcagcaacatggttgaaactggagttcattatcttaagtgaaataatctaggcacaaaaagataaatatcacatgttctcacttatatgtgggagctaataacttgattacatgaaggtggagaatggaaaggtaggtaggaaacagagactggaaaggatgaatggagggtaggagggaaggtgaagagaagagagttaaaaagtgtaaacatatagttaaaagaaataaattcaatgcttgatagcagagtacagtgactacagttaacaaaatgtattatactcaggtgatgaacacctaaatacttgatcactatgcaattatatacgtgtaacaaaatcactatgcactatatacgtgtaaaattaaatgcgtacaaataaaaataataaaatactaatccagtatcattcactgacaatgttaactcaggtggataggcattaagtcaatactactataagaaccacttcttgtttatgttaatgccatatagaatgaaataaaattcactaaaatccaaaaaattagaaaaactatcaaaactcaataatattaagacaacccaataaaaatgtggtcaaaggatttgaacatacatgtcaccaaaaaatatattcaaatttccaataaatacatgtaacaatgttcgacatcgttagtcatcagagaaatacaaaataaaatggtaatgaaatactactagataggcttttacagagactgacaataccaagtattgacaaggatatggagcaactgaaattctcattccttgtggtaagaatgtacaattatataaccacattgaaaaaacaagttttcagtttctttattcacccaaaatatatgtcttttggaaaaaattttttccagtctgtgggttgtcttctcattctcttgatatatgtcttttcaaagaggctgagctttactttagacagtggtcatcaaagtgtgtatatttgtgtttttataatttatatgcatatattcctgtgaaaagatactgtatgcattgttcaacatgtacaaatataagaaagatatagtaaagaaatatatatttctaaatttataaatgtatttattggtgttccacgttgcaaactaaataatctacgttggctaatttaaggaattaaactatagtagaaggttctcatttattgggatgattagaaccagcctttttgcaggctattagcgaatcatagcactagggcttcactgctacctccactgacacctctgacacttgaaacttgaggccagatatctgcccatgctgatagaaaacaactgaataatttaatttgctagataatagaaaagaatcaaatgactctgccacattgcttgccagaagattgtttttctcatttgtgacctcttgcctataaatgatagatagtccctgtgctgcatgctataggtgttcgtaagagagtctgggaatgtgagctttttatatcctatttttgggtggtaaaggtcattctattagtctgttcttaaactgctaatgaagacataccccaaattgggtactttatgaaagaaagaggtttaattgactcacagttcaacatgactggggaggcctaaggaaagttataatcatgggggaaggggaagcacacatgtccttcacatggtagcaggaaggataatgagtaaaagggggaaaaaccccttataaaactatcaaatcccatgagaactcactctcacaagaacacaattagagtaactgcccccatgactcaattacttcccaccaggtccctcccacaacacatggggcttatgggaactacaattcaagatgagatttgggtggggacacagccacaccatttcattccacctctgacccctcccaaatctcgtgttctcacaattcaaatacaatcatgcccttccaacagtccccccaaagtcttaacacatttcagtattaacacaaaagtccaagtccaaagtctaatctgagacaaggcaagtcccttctgcctatgagcctgtaaattcgaaagcaagttagctacttcctagatacaatagggtcacagtcattgggtaaatacacagattccaaacgggaggaattgaccaaaaccaaggggctacaggcctcatggaggtccaaaatccaatagggccattgttaaaccttaaagtttcaaaattatctcctttgacttcatatctcacgtctaggtcatgattatgcaagaggtgggctcccacagctttgggcagctctgcctctgtggctttgcagggtacagccccactccaggctgcttttacaagctagtgttgagtgcctgcagcttttccaggcacatgggtgcaagctgtaggtggatctaccattctgtggtctggaggatggtggccttcatctcacagatccactaggcagtaccccagtggggactctgtgtgggggctctgatcccacatttcccttccacactgccctagcagaggttcaccatgagggctccaccgctgcagcaaacttctgcctgaacatccaagcatttccttacatcctctggaatctaggcggaggtttccagacctcaattgttgacttctctgcaaatgtaggctcaacaccccatggaagctggcaaagcttggggctttcaccttctgaagccatggccttagctgtaccttggcccttattagttaaagctggagcagctgggttgcagggcaccaagtccctatggtgcatacagcaggggggccctggacccagcccacaaaaccaattttccctcctaggcttctgggcctgcgatgagtagggttgccacaaaactgtctgacatgccttggagacattttccctattgtcttattaagatttggctcatagttacttatgcaaatttctgcagcaggcttgaatttctcctcagaaaatgagtttttcttttctatggcatcatcaggttgcaaatttttaaaacttttatgctctgcttcccttttaaaattaagttccaattccaaaccatatctttctggatacataaaactgaatgcttataacagcacccaaatcatatcttgaacactttgcttctcagaaatatcttctaccagataccctaaattatcgctctcaagttcaaagtaccacagatctctagggcaggggcaaaatgccaccagtctctttgctaaagcataacaagagtcacctttgctccagttcccaacaagttcctcatctccatctgagaccaccttagcctggatttcattgtccatatcattatcagcatgttggtcaaagccattcaacaagtctctaggaagtttcaaactttcccacatcttcctatctttttctgaggcctccaaactgttccaacttctgcctgttacccagttgcaaagttactgccacatttctgggtatctttacagcagtgccccactcctggtaccaatttaccatatccatttattctcatgctgataataaagacatacccaaggctgggtagtttataaagaaaaaagaggtttaattgactcacagttcagcatggctggcaaggcctcaggaaacagaatcatggtggaagggaagcaaacacatcctccttcacatggtggcagggagaagaatgagcaaaacgggggaaaaacccttataaagtcatcagatctcatgagaactcactctcttgagaacagcatgagggtaaccatgtccatgattccattacctcccaacgggttcctcccatgacacgtgaagattatgggaactactacaattcaagaggagatttgggtggggacacagccaaaccatgtcagtcatgatatgagaaattatcaaattaagatgtagggaaggtttttaaaagatttgagcaaccacaaatgacagatatgtgctatagtagtgcaaaataccattttgctcttattaaaaatataattgttcttgataatctgaattataaatgtcatggataattatgatgcattatgctctcagcagctaaaacttcaagcaaaatacacacctagagaggaatcagccttaacaataattctataaatttaattttctttatttctgatagttacattttagttgacttcatatgtgatctaaatacattaccattattttggacttatgatgtagctcttgaagtacatatatgatgtagctcttaaagtacatatagaagagcagataaagtatcagttcaccatttctttgtagtttgtgctttcatgatgaatattctcatcaatgtacagattatttgcaggagccttttaaatccatgtgtccattttatgagacttagcttttgtctgtatataatgtgtttattcagtgtgcatggattaatttgagagagcacaggtatgggtatctttacagcagtgccccactcctggcaccaatttactgtattagtttattctcatgctactaataaagactatatatcacaataaactgagaaccagctggtaaatgagagaactgtggtccaccttttcattgtggagttctcattttccttagcttatgctgcttattcaacactatttctgcataatctaatgcattcactaaatgaaggtgctgtgttagcctccacatgatattaatacagcctatttaatttatccttctttagattaaaaataaataagtagtcatgtgccacagaatgacacttcagtcatttggtcattgaaggaccacatctattactgtggtccaataagattataataacatatttttcctgtacattttcattgttctgatatgttttgatacataaatgcttaccatcgtgttagagttgcctgcagtattcagtacagtaacatgctgtacacctaggagcaacaggctataccacataccttaggtgtatagttaggttataccatctaggtttgtataagtacactctatgatgttctcacaatgaacaaaatcacctaatgatgcatttctcaaaacatgtccctgtcattaatacagtatgtaacaatacagttagtacaatatgtaatacatgactatattcagaattttagctatttctcttatatttcaaatggattttcttatgcactgtgtggcacgggcatttcattttagtaaccacagtctgggaaaggagaagtctttgaaggatgttgagcaaggttatgacatggccagatgtgaatttttgatcagtgactccatgttagcagataaagttgtattgggaaagatcaaaagcatgaaggccagataagaggatactgtatgttatcatggatggaaatgtgagggatggcaggagagatgctatgattgaatgaatctcaatattcttggtgatcaaagaataatgagactcatgcaataagactctgtgaatgattgaatgtagttcctaagctaggaggaagaatgaggaatgattttctggttcctgactacagcacaagttttggatttttagaacaaagaataaatttgtacatgctttatgattcctggttgaatttttaaggataaaaaagtcagctgtaatattattctttcctgataccatgcagtatttgtatcagtgatcttattcattccacacacattcttcttgaacctggacactgctctagacactgattctttccaaatatcagataaggttattcttatgtagaccctcagttcatataaatatgattttcccaaaatgtgaaataagtgacttttcataagatattttttaaaagaatgtcttaataataaattgtgaatgttgcatggaaatgtaggtgacttgcattgtgcatcctgtgtttgattcactgctcttgcatgtcttgcctttagctgggatgacagcagttcagtgagcagtggtctcagtgacacccttgataacatcagcactgatgacctgaacaccacatcctctgtcagctcttactccaacatcaccgtcccctctaggaagaatactcaggtgagaattaccacctttctttttccagtgtttctgccagctttttccccaaaattacttaatattagattaaggtatagcacaagcccttaatccaaaattattacagaaactggaaaatgcagagataataaggactccctttgccactcctgaaccctgaagcatctttcatcttagtctttcctaaagccacaacccttaggaggagcaacaatgtgcactgcagccaattttgaataaacagaagcagcatatatatatatatatatatatatatatatatatatatgatatacattacatatttatatatatgtaatatatgtgccatatagcctggtggtatagttatctatacaaatatatttatttattgttaatatatagagtatataaatatctatttatataatagatatttatatatattaaatatataaaaatatataacatataatagatatatattttatatattatataaatatatatttatatatttaatatattaatgatgaattactatatttgtatagataactacaccaccaagctatatggtgtgtatatattaatatataatgtataattctatattaatataatagtaacatatcaatacttaatataatatatattcaattgattacaatctaattcagaaagatttatgttgccatatctctccttacaatatcgatatgtttgtttaaaaatccagcaattattttcatagtctaattttagatagttcttgattaattttatatgatctctgaaatatatcactggatctgttgtgaatgataaatcaaaaatgaaaaatggacattacatcattaagttctagcttgtcttactacttcttatgacatttgatatagaaaatttctacctttctgtagcgtttaattggtgttttctgcatgtatttattctgaaattctctaatatctgcaagtgggaattatgtggctaaaattaataaaatgtaagtgaaggtaaatcaaaatagaatctttggatttatccagttatctgaaagtacatttcattgccttaattcatactttataaatttttctacataaagtttttctgtaatatttgtctttatagctgaggacagattcagagaaacgctccaccacagacgagacctgggatagtcctgaggaactgaaaaaaccagaagaagattttgacagccatggggatgctggtggcaagtggaagactgtgtcctctggacttcctgaagaccccgagaaggcagggcagaaagcttccctgtctgtttcacagacaggttcctggagaagaggcatgtctgcccaaggaggggcgccatctaggcagaaagctggaacaagtgcactcaaaacacccggtaggcttgtcgtttgccagctgttatgcaaaagtgctttactttattgtttccattcaatctttgttttctctaacaatagcatttctaaaataccaaattcttatccatattaaacatggagtcaaatagttaaatagtttttctgtctacgtttcacaaactcgtcatagaagcccaagtagggcctatatctaggcattctctggaaagcctcctcataaactaggggtactggatgccttaccttgccagagttatttcaggtaatggggaaataagattaggttgctaaagcaacagttaagtttttttgtttttgttctgcgttcttaatgaaagtttggaatttttacactaaatatgccactgaattgcactacagactctgagaggaacaagcaatgacactaatcaattggaatgctggagatttgaaatattgtctgtgtattagacttcatgaaagaagagaatgaaatagttcttcaaaattgtgccatactttttttaaaaagactctccccgtatttttaaaataatgcctaattataaatagtgccacctgaagcactaattaacagggtactccaaatataatcatctcacagatattcaaatgaattctttttctagtaattagcttgatagggttaagtgttatctttttaaaaagagttgcaaaatataagacattaacaaatagcaaaacatatgttttcattttatctcttccatctctcataatgtttcttctgacagccaaatttttgtagctatgcactcagtcctctcaatatatgagatttttgatctaagacaatacatttaggaagggaaataatataaagaagcattcacattttacacattgtttcacgaagtgtggtgatatcaaactctacaggcacatatatttgtgtatttctccttaattagggaaaaccgatgatgccaaagcttctgagaaaggaaaagctcccctaaaaggatcatctctacaaagatctccttcagatgcaggaaaaagcagtggagatgaagggaaaaagcccccctcaggcattggaagatcgactgccaccagctcctttggctttaagaaaccaagtggagtagggtcatctgccatgatcaccagcagtggagcaaccataacaagtggctctgcaacactgggtaaaattccaaaatctgctgccattggcgggaagtcaaatgcagggagaaaaaccagtttggacggttcacagaatcaggatgatgttgtgctgcatgttagctcaaagactaccctacaatatcgcagcttgccccgcccttcaaaatccagcaccagtggcattcctggccgaggaggccacagatccagtaccagcagtattgattccaacgtcagcagcaagtctgctggggccaccacctcgaaactgagagaaccaactaaaattgggtcagggcgctcgagtcctgtcaccgtcaaccaaacagacaaggaaaaggaaaaagtagcagtctcagattcagaaagtgtttctttgtcaggttcccccaaatccagccccacctctgccagcgcctgtggtgcacaaggtctcaggcagccaggatccaagtatccagatattgcctcacccacatttcgaaggtaaggatgtataaaatgatgctggaaaaatataaaggataaatatgtgttagacacatacattacatataaatgtgtgtatatatatattttaaatatgtataaggtatatatatatcttagaattctttaaagtacacagtgagctctatgaagcttatcatataaacagctagcaaaaaaaatagttctcattttgagaaacagtcaaacttcaaagtttcactgtcattgtgatactagcaacacaaacaacatctaagagacttaaaagctgatggtaatacctaagtgtagtgataaggcaaagtaatagcttgtaaaatttctatagatttccattcctccttttcacattaaaaattaaaaccaaataggttttcatgacttttggcattcatttccagtgtcattttcttgctggctcttaatgagttggtgatcataaatgtagatgaagttgttttccttgtaacagattccattggacagatttatacagtgtcatatcttgacacattaaagacaatcaagatatgacataatttgaaactattccagtgtttggtacagtatcacaactgaagagtgggctaagctttctaactcttcatctgctttctttgacatgactctggtaaggatcatgacttggtttctgttcctggattgtttttggtgttaaatatgtgaagttctgctctaagatatcactgtttttaaatacccatgtgtttttaagtggtaggaaaataaatgcagttaaaaattggggacaaatatctaaacctctctgagtctgttttctcatctgcaaaatggtagagtgtggtttatagttcattatgggttcaatatttttaatgtttgtttttattctgttgactaaacccagaactttgatatcttggaaaggaaagattttgaaacatttattttacaataaagcaatttcagatacctgattgtttgaaaaacctaaaggctttattcctccgtagtaatattaatgctgcagaactgtctttttaaaatactgattctcattgggaagaatgaattatggcgtatagggagagtaaatatttctgtttcttaagtaaaagccaatagtgccctcctgtggcccattacctatgaaacaatttctcatattcgtcataaaatatttcactgtaggaaatatggatttcattgcaactcaattagtaatcattatgccattacttcatatcattgtatttccatatttacataaatttgattctaccatctgcttcatttacaaaactaaaatgttttctgaactaaactccaaaatctaacagcaccagctctgtttcaaatcactattaaaaaatgtatttgaatagcactggcaactgacataaaaccctttggcctctgctggggaaaatacagacaaactgacttgttgccgacaatgtcaatattgtttccaaccaactgctccctgacagtgactcagaccaccagatactcaacacaactccctaaacttgctttaagcgttccatctagattttgaataaactgtttaaaaatttaaaaataaaaaaaaaagagaagagctcatttaagtgttgtctatcgaatgcgtagaagttgtttcattataatggttctgtaaataggtaacagcaagtatatggtcaaactactgactttgagtgaaagtctcatgatcacttaaattatgaaaaccaggggttttcatgtttgacttacttttgttccacccacttcccctctttccctagtagcagctcagtactgacctacccttatatgagagattttctgcacttgataaagaagtccaagcttataaaagttcattaacatagagacaggaagtgctttgtagttcagtacatcaaagcacacttggctctgtgtactgtaacccgaaatattaaatgtggatattagcttcttggaacaactgaagttgttatttgtttttcttttaggttgtttggtgccaaggcaggtggcaaatctgcctctgcacctaatactgagggtgtgaaatcttcctcagtaatgcccagccctagtaccacattagcgcggcaaggcagtctggagtcaccgtcgtccggtacgggcagcatgggcagtgctggtgggctaagcggcagcagcagccctctcttcaataaaccctcagacttaactacagatgttataagcttaagtcactcgttggcctccagcccagcatcggttcactctttcacatcaggtggtctcgtgtgggctgccaatatgagcagttcctctgcaggcagcaaggatactccgagctaccagtccatgactagcctccacacgagctctgagtccattgacctccccctcagccatcatggctccttgtctggactgaccacaggcactcacgaggtccagagcctgctcatgagaacgggtagtgtgagatctactctctcagaaaggtgagctttcctggaggcattgataacatcttccccctcttccctgcactatgcctaacccccaccccattaaattcccttgatttcactgtgagtgccccggtgcaaaaagatgtaagactgatgaaaccgggcctttcatttgctctcattaccaaatttacagaggaatagaatcattaaaggtagggtgagtggataattttgttaatatgaatgcatacatttatacccagtaggcaatgtgaataaaattcaaggaatgtatttagatattgaatgaggtctcctgaagacattttaatgatttggcttaagcttcagaacaacactagctccttatgatgacttaagcattttgaaagaccaaattgaaattattctatagttatgctcagagcaatatgttaaatttgttccatttgtacttctatgaaaaaatagcagatggattgctgggaaatcctagttggcctggttaaaaaaaaaaaaaaaaaaatcaattgtcagccatgaatcattagagaaaattatagtgtcagtgccattttcaatagactgcttaaaaagtaatcatattacaaagtgtttctcattggctttatatatatatataaacttaaagtagaggacatagcaaggcatttcttacctaatatgcttactgtgaagcatcccttttgagcaaaatcactctaaattttctcctcaaagtgatcctctcttgattatactgtactgactcttaccaccaggaaaatgtcttaaaaccacttctttttcctgataaatgcaatgctatttgtctcttgacataagtaaagctttaaacatggtcttggccacatgtggaaagaaatactggtcacgtaaaatacctgatatatctttctatgtcttcccctgttttttttattttttttttatttttattttttaactctgatattgatgatggcatttattttctagaccttcagccttactcccggaatgatatttttaaacatcaattaaagcccttagctagacactctctgcattacgccagtttccctttaatgtaggatgtcccaatttgaaattccccattttctcttgactttgtaaaaacaaaacccagagcaaaacattgcttctttccctctttacttcctacttgcctaacaatgagacagggacagccgtgcaaatggggcttcccgatgataaagtaattttaacactaactaaaatattggtgtttcctatggtgggctgctaattacaaaatacatttttcctcctaaagaaaaaaactgggccaaggcaaacagctcagtgatagcaaataaaatgtaaccatttccctatggttttgctgttatatgctattatagacagcatacgtaaagaccagtaagggttcatttttccacctaaaatgtcgggcttcctgtaaaatctttgattctagtttcagcacttctaaggtaaatgggcatcttcacatgtcatttataaaacttctaatgaatgaattatattaaaatagataaacaacctatagttttaatgaatgtatcctagattgtatgctcatatgtaaggattctaaatatcaacttgataaccaaaccaaacatagtgcaaataggttatcatttattaaccacaaccaccttccacaaaactggtcattttttaattattaagataatctgcaacaagttggccatttagccatcagcctatttcttcagcatttagacattaatccaagattcagaaataaagtcaagtaactatttataaccaagtaacattcaaatcaaaactagatgaaagattggttagttgcatagctataaccaaaatgcagttttaatattttactctaatctatattttaactgaagtcaataaaattttcactatggaaatacactagaaaatatgcaatttcttattctttttaagcagatttatttattgtacatgttcagtctttgaaataggccaattttatttatgttatgttatgttatgttatttatttgttttgaaatggagcctcactctgtcgcccaggctggagggcagtggtgccatctcagctcattgcgtcctctgcttcccgagttcaagcaattctcatgcctcagccacctgagtagctggggttataggagcggaccaccatgctgggctaatttttgtattttttgtagagatgaagtttcaccatgttggccaggctggtctcgaactcctgacttcaagcgatctaccctccttggcctcccaaagtgtggggattacaggtgtgagccgtggcaccagcctgaaataggccaatttttaaaatgggagtattcctacattaaaatggccaaataaagactttttctaaaataaactttaaactaattttggataaatatgttttgcctttgagccttaataaaatgcattaatgaatattaagctgtaaaaagtacatgttaactacatagctatagtgtataatattaatattaattagtgccttccagtaaattactagattaaaataaattttaatataagacactgagctttttgttttcttgacaatagaaatgcaagcaatagcaaattgctctaatcctttcaagtacatttaagaaagtttatgacctattgaagagaaaagtagatctagtgggtgatactggcttcattatggttaattaattgatcagtagaatgtcagaaatgctaagaaaaccaaagaactacaccagagagaaaatgtgttaatgtaaattttaaggcaagttaattagcgatatataataaagatgtatataagttcatgatttacctgtttgtctacaattttagatgattttttgatactcatatttaaatcggtagcttttcctatagattttaatttttgtttaaattcctcttcattaaattaaataaaataataaaatacactttttaacagttttctcttctgcagctgctctaggtcattggtggccattgagccataactagtctatatttgttttgggttttgtttcatgtgtctgactcaactaaatttttaaataatttgtagtaaccaactttgcaaattctgggtttgtctttaaatgtcagatctggcaacgctgccttgacatttctgcctagaaactattggctctaggcagtcagtgcctgtctgcttcagactgttgactgaaatccccattcgttttcatgccctatctggcccttgctggcatatgagtttgcaacctttggtgatttgcagaaattgtctatgttagaaaatcattaatatctagattcaaacatatttctaaataaagctttaaattattatggtaactttaaatgtatttattctaatttttttcattaaattgctcttcatcatataaatatataatttttatacaactggatgagtttggcagaagaataccaacttttcatattctttgtggcattaaactttaacttgtacacatggaaataaataatccttaaaatgacttatgaccacataaatgccttagcacatgtggttcatatttggagatttctcatatttgttcaatataatttattttgtttgtttatccacagtacttaagaaaacttctatagtcaacatatatactgtaactggcctctacacagtataagcaattaccttacatggctattaccgataaagttaaagttgtataaagcctttggatgcttttgatttcagtgctaaataatggagtacacatagaagaaaacattttagctttggtttgagtgatcaaattttaggtcagcctttttacattcatgttatatcatccccattatgcgtatcctgtgtatttaattttgatcatttgatgtcctaaaggaagaaagctataattctgcaattttaattaattttacactttgcttatccacatgccagagattataaaagaaatccctaaacttgtcccacttagttgttgatatcctcttcctgtatttttagagaggccatttcttattttctctagacatagcttttcattccttcttgttaccaattgtgaattccttaaaatagagatgataaaatttatagccttttaaatacctaatttatgatttctaaaagatggtatagcttaatttcattaaaatattcaaataaatgatactagaatcaattaagttttaagcaaacattcatatatctttcttcacatgtataaatgggaaataaacatgcctttttattaaaaataatttgaagacaaaagataagtattaaacaatgttttataccatctctgtcaattggaagttgtcactctaacttagccagagcagatctatctcattttgcatgtgatatcatagcaaaagtctaatcagttgcatagggaaggaaaaactaagatagtatttaatcaataggattcagaggaaaattatgctaatgtgatttaatctattttctagtaatcctatcactaaactgtcattgaattgtactgcattagaaaggaactcaaatatgtgtgacggcaatggacatcttgtcacctttagttggcctttttcaatgagttaagcattatatgtgtgttaccaaaaaattattttttatagttcagagaaccatttttgttggatgtgtaatttggaagttttgtttacattatgtccttaggggttttctttgttttaacagcatgcagcttgacagaaatacactacccaaaaagggactaaggtatatattcctctcagcacaattgctacctctctgttgttatgtaaactttgtgtgctgtctctcttccttctttgtttgtttgcaatgtagcacatgacattgaggacgaaatcacttttaattttgatggtttctctggcccgaacagttggtgagatagccccttaggtagagatactagtagagattgaggctgtctctcaaattaaataaattccaatgtgaatatcactattttgaagaaataatactaaacaaacaaacaaacaaaacaaaaacaaacaaacaaaaaacttgtcccaggcattacttttttgggggcagcaactttggtagaatgcagaactcacttcaacaaattaaaataaaattaactcttctaacttttgcctattagagtcatatgcatgcaaatattcaaaacccatgcagtctacagatgtgggcagttaatgttgataggttgaaggatgctacaatctgaatcaaagaaaacatattttcatcatcacaggacaaatgctgtaattaaggtgtgatttttatagaatccttttgataaaatctcaaaattgttttaatttctattttgcaggggtactgctatcagatcaatttaaatctgaattaatctaatatttaataatctcaaaataattattccatccataataaaaaataaaataaaaatttaacttatggccatcttttactgtgtacttttatctgaggaagagatagaatgatctactaatagaggtataacactgtatgtgtatgaaaagttggctaattttggtgctaagaatttacttacaaaaagaaaaagaatatacttagtttggtgaaacactgaataatggcgaaactaggtctttctccattattttttttctctccaatttttcagcaatagcaaatagctggcaattattccatgttaatattttgatccagaaatttatgttccagtaaagcgagcacatctccctccttatttttgtaatctaggcatgatgtcaagtggcagtttaacaaaagaactgtttttcctttaaaaaaaaaaaaaaacaaaagctgccaatatgtattccatttccctatgccttctgtgaccatccttcatttcccttggccctggcccgccactgtcctccatttgtagtccatgttttcaccctctttacatcctttcttgccctgtgcttttgagttctcaattaacttggctgtctgctcattgcttatgatttccaactgcatatctgatagaagcataattttctcctcaaaaccctttatcttattttttttccctatgtgattcaaacagatggcgtaagatcatctggaagaactgagcaattataattagattcaatctgtttgaaattgttcattctgaatagtaacctcctctgaattgttttcctgtcctggcattgccttgcccttgtagatgtgcttaagtgtcatagctgtgctgttttgcagatataccccatcatctcggcaggccaaccaagaagagggcaaagagtggttgcgttctcattctactggagggcttcaggacactggcaaccagtcacctctggtttccccttctgccatgtcatcttctgcagctggaaaataccacttttctaacttgggtaaaatattctaaaatattgattttgttttgtttctttcaccacccactctcacagaaaccctggaatctctccataacacaacacgttttcatttaaagggagggataaaagcactttaacagtacctttcatttgtgtcattgtttactcttcacagaaaaatctccaaacattatgctatttattgctcatgacaaatgcttaacatagattaatactgtggttgttttctagtctaggctccagaggctcagaaagttcacttgacttgaaaaagtcttaccattactaagggttcaaggcagtaaccagttcagaacatctgactttaatcccaggggcctttccattccatttaagaatcctcttaaaaaacaggaaggcatctccttatttatttgtctgaaatattaaaacatccttaaaacaaaattagtaatcttttgtagaaaatagaaacaattaggaagaaaaaaatatgtaattccatgactcaaagttaacttcttttaacactgttaaagttaaaactccttaaaattcatacaagaatttctgttaagacaatactctgaacattttcaaatagatacaatgaaaaataaattaccaacttagtcattgggttactttgtatttaacatcatttgtatgaaatataaaatcatttgcataaaatttcattaaaagcactctgagtaacaaaataattaaagaaaactaaacatgccagataccatttaatagattcaatgactttaaaaatatatttattttctataaagtcacatataaagtattctcattatttttatggtaaatatttttattattagtttatcagaaaaacttgtacataaagatgagtattgatacataatcttattagagccagagacgatcattccttctagaaaaacacatctctgaatttaggacggaggacaatgaaacaagaaatttcactttataatttacctttgtcaaactatcccagagcacatcaattccatcatgaaagtactcctttgacattatataaaaaattagtaatagaaaacacacaatccaaaaccttatattttctaaacttcaagttaatcatcaacttctcttagatttttgaagacctgaaaataaacataatttcaaataacagaactcaaacaccatatacatttgtaatgaggcacaacagtcaattttgagccttgtattttccaggttttagctgaataatcttcactgctttcttagctttttgccagtctagtttggggactattttgccttactgggcctaaacagagtgtaatattaaaatatgttaataagccatactgagaataagataaatgcaggtttctaactccttagggacacaagtggggacaacacattccatgaacacaggtgaatgaatgcccctagtttctctgagttggacaatttcatgcgatcatttttttctctgaggccaaagtctctggtttgatcttcctagcagcttccagaacagaaagtgagtttactttgtctccatattctttttctgcatgctcgggaatcccctgctttcctgatcccaccacaaaaactcccctgaggatgaagccttggctttccaggcttccagggaagcctcgattcctggctggaggtagttgtaccacactcccagagggctaaatcccataaacatcatcttctgtctttgtagatcatagaactttttattatcatccaggaagatttctcttttgaaacaaggctggaaaaactttatgtcagtcctgacctgctctttaatgactgcgtagagggagatgcccagcttatccaacttgggttgcagggaggacagatctgcagcccctcttgccagagaaaacatcctggcacagacacaatcacaactccattcttctcccgatagctcctttgctttgaaactcattggttacttctccagtgttttcaggtctatattctccaggtactccagcacctctttccagggcttggacaaaaatacatctgtgttggccagcatcagtgccaaggcagcagcctccaagggctcctgcacccatggaccacatccacacagagaagcaccgtgggtcctcaagtgcctccctcttcttcccttctcccaaacctgaagcccagacactaaggggtcaaaccctcctgggccctgagggttccaagggcctcattactttttctttttttcactggaaaaaaaattctaatcatgcacctacagaagattgacatttttcagtaagttggactttccagctttcagccaggacaagactcaaggctatgtcttttctattgcaacccttcccactatattgagtagggcttttagcaattgaaaacaattattttggtcatggtttcatataagctaatgatttcatatcaaacaccaagtttttgtttcctaacctatatagtgataagagaatttacctataatgccaaagaatgtatagcttttatttgctttaagatgcagttgattttttaaaaaagcgaaaagcctaacactttaacttcaaaaaatgaatttaaaatgtttgtgtaggtcataggaatatgaaaaaattttatacaacatctaaaacacacccaaatcacctaaagtgctataagcttgctaagtacttcatgtctcctatcaattctttcattaattgacgttaatttgattagttgactccttcttctatttttcctcaccattattattctgattaaatccaccttcattattccttaggaacaaaaagactcaccacttaactatgtctgacattggtgaagtcgtttaaacttaattttcttatctcttgaatggatacataatacctaggttatattgtaaagaatgacggatatagtgtatgtaaagatggagaagtgtgtaagacttgacagattctgccaaatcattattttcactggaaagcatgtcttacacgatcatagagtagcattcatcagatatgcctgagctttgtctacatttaattgagtagtaattcgcaacacagtaaccacaggattttatgtaaaagacattcacagattgtgtttttgaaagattgtatttttgaagtacaaaactatgacattgttatcaaggactcatttaccacaaatatcaaatatttgtgcaaagataagtttatgctaagatttgcataaattaaagttaacatggcaactgaagctaacatgtccatggtcacaatgtgttaaaaaatgaatggttctgtagcacacttgggaatgtattttattacatagttttcagagttaaaacacaattaataaatgaaatgtgaattatacttttactgacaacaaagctctctgtagagctttaatgttctaatgaattagaaaaccactgatcaaatacatcccttacatttcattgctatagaaaccaagtctgaaaggttaagtttacctttctaggatgtgggtttccccccttaatctattgtggtttatatcagagatctctcagctgtgtcagacaggccatgacttaagtgacactgccctcttgattctcttcatacttttccaactacaattctttctcctggggttgctcatcttaacatagctgtatcatttattgtagacacaaggtcacttttgagagtgaatgggactatattaataattgttccaggtattaggtgcaaaccctgggcaatgcaattcatcctccatctcctccttatatttatgtgtttaccaagttgtttttcctgtagacttttttttatcctaaaccctttttctatgttctcattcacaactttaattctaatctctcaaatcaacatttcactttctgtctgagacctttttcagctctaaaactaaaatcccatcagtgtgctagaccatatagccacctgaaatcaaagtcttttcttaagttcttttcttctatttgtcttataatttcatgtatcatccttctctctactctagcacaaaatctgtgtaatcaatagtcttacttgaaactgtgctcttcatattgtacattttcaatagacaggaacctgtgattttatcttcagaatatctcctacatctgtctctcattttcagggacattgtccttgctgaagcttttttaactatagacaattgcagcagattttaaattgatcttactctgtcgactcccttatgtttcaacattttcacccattggaaggtataaaagaagatattcctgtccgtgtcaacataatctcatgtacctctccagatcttagaaacacgtatggcttcaaatcaggcattttgagatctttatgctgtatggtttcagagtggaaaaaatgattgattcaaaaacataatatttaaagagtttttattgtatttacagttcacctgaacctctgttcattgggcaagaaaatgagtactcttaaaatgcaataataaattaaagttactttattattaaattttaaatatatatatatatacttaccttaaatatgtcctcttgttgtcttttagcatcacccatttttgatttgaccattatcttttctgaataatcagtaagatacagaattattattaatgttcaaaagttgcagtattcatgttttctttattctttctaccaattaaaatgtgttaatatataaaatttttagaaattttactataaaaaatcacaacatatattagaaaattaagatcactacaatatgtcatatttagtagactactgtgagctactgccacagtaaactatggttcgtgtgtcgttcccagcatgctagccctagtagaaaccattcccattcaagaaagactaacaaagtatagcttacataaatcaaaaagtctttggatgaaacttcatttgggaaaataacccaatctctacccttcaattttttatgaatgaaaaaatggaagaataaaggcctctaagatccattcaaagccaggagacacacaagaatttctaaatagaagagaaacagaagaggtcatagttcttgtgagccatctcataacctggtgagactcattgtcatgcctccatgcatgataacaatcgctcagattcatttttcatcttgccacaagggttacatgcaggaacattaatgtcaacctgtcacttctaatatccatctaatattctctaaattcgatggatccttttgcatatggtgattgttaaacacctttgcataggaacagtttctatgcttttgtactcaaatcttcctctaccttgaatcctttcccatcttcgtgttcaaccttcaatcttctcagaatgaactcctgtcttctattctttcggaagcatagaatctcacagtcagaagagaccacatctggttcaacccttcatctcttatgtaaaattttatgacatctctagcttcttctttaaacccaccaatgacagaaactactaaaatctagaaataacacctttgaaattctttctttaagagatcaaataaaattttcctgaatcttcacctattgttcctagttatatatatccagattctacaaaataagtcaaagttagattgcatatgacagctcttcatatttaaaacaatataataaactcactagttaatgtctagctgtagatgcaaaagtagagagtgacttggggttatttaagaacccagtccagccagacacattggatcatgcctgtaataccagcagcactcaggaggctggggcaagaggatcccttgtccaggagttacaggctacagtgagctatgatcgtggcactgcatactccagcctggaagacagagtgagaccctgtctcacaataatagtatttaataatatcataaaaacccagtccacatttatataggatcctgttttcctcaagttactacaaataaatatataatcttaataaaaggttagtggctttgccaagatagtggcttggctatgcaaatgcaatttaagacaaagttggtagccctctttttcctaatacattgccatatctgtttctcttctatttggaaattcttgtgtgtctcttggcttcgaatggatcttatagtccttttattcttccattttttagtcataaaaaaactgaagggtagtgattgggttatttgcccaaagcagatggaaagcaaaactaccactagaagctctttaccaatttgtgttccattcaaaaaattatctttgtatgtcttacatttgtcttctactgtatagtttttcttgttctattttacatattaacttttctccttcttcagacatctgccctactggctactcttgaaatcagagactgtgtcatatttttccttctattcaactacaacatctaaaagcagatctgtcatagttattaacttaattgaacactcttaaatagttaggtgtaatttccaatgcagaagctatcaaaagggtttgtaaatgcaaactattccctttaaaatctatcctaatcctcattaatgtttcatcttgatagagctaagtattatgtattgaaattgtagaagtacacttcacttggatatctctgcaatcatttaggtaagaattatacaaagccaaaaagcaaataaaatatcctcctaaccctatagatacgtatactaaaatgatgcacttgcaaatttgtttaatacttcattaatttaaacaagagtaaattcatactgtgaaccaagaatagggtgacttaccccaatcttgccaccttaaacataaacattttaagtcttcaatgtcctacagtgtacctactggctgttgtcactaatcagaccgaaatggtactaatggtcactgcaggctgaaggaatatgcttgaaagataggcagatcctctccctctcccttttttacttttttcgcctttccatcctttcttctttttttccaatagattgtgcactttggagattcatattttcttccttttccattacattttaaatatgtgattcttagtcctatgcttccttttactccaatcaataactggctctatcagagggttgttctgtgtgttaattcggttaataccaggattatcaagcacagtgccttccaaatgtgagatacttctctccggttacctctgggtttacttttcctgttttacattgttttgagagccagtacttgtattaagaagaagtttagtgcctgtgtcacagaaaaaatcttagtaaattttgaagtgatgtcagaacaactctaagccactgacggattccacagggttttgaaaatactcgttagttccctttatatcttaagaggctcctgcctgctttctcatataccagtaacaaacttgcttttcttaaatatgagcatttagaatatctttctcaatttttctgttttgcttttattccaaatttcacaactatattgttttccaatgtagttgtacatacaatcaaccaaatctttccttaaattgatgactaccaggtgaggactctttggcaataagcaataagaaaataaattgttattaaaaattacagacttaagatacttctttggaaatataacatgtttgtgacttttgaccatctcatcatgatatgctcatcttaaacagagtagaaaatcatttcatataattaactttatggtgggctgcagataccatgtatgttacattgtgtttagttataaaaatgtttattatacactatttccttataatctaactttgataataatgatggtcctaatcatgaacttacatcaattaagagcttgaagtgactgagagtatttgcctggaagcatttaaagcccttcttgggaaatttagatgttttatattttactttctttttgattttgctttttccattaaagtgattactatttttaaagagaaaaccgaaaactctagaaagaccatcttttcttcataacaggtagcagaaaacaccatgttattacatttctagcaagagcagtagaggtgacttgttggttttgtgtactgttgctttagaaattgatgtaaggcttcccataaacgtgccagaggaaaagagggacgcaatgggatctgttattgaacatttcagaggcagactcttaccttaaatagggactcactatacattcatgttttcataagtattgggatcatgttcttactttctatcaacctgctattttcatctttcaagcttaagagtaataggctctgtgtgttttgtttttcagtgagcccaacaaatttgtctcagtttaaccttcccgggcccagcatgatgcgctcaaacagcatcccagcccaagactcttccttcgatctctatgatgactcccagctttgtgggagtgccacttctctggaggaaagacctcgtgccatcagtcattcgggctcattcagagacagcatggaagaaggtaagcgttgagggggattaaagatgaagtcactttatttaaaccctgagagggaaaccattgtgtcactcacatcacaaagattcctgaagaggaaaataaactagtgtaattatcatttgggaaactagaagcttgaagaagttttattctgtattatcttctatttctttatgtatttggaaatatgccagaatttgtttatattaatacttggctgtagaagagtttagactaaatctacttttccaatacagaaatatacatataaactattttcccaggtgcatcaaatatcagagcaaatgttttgtttgacattttggttaaagagccataaagacacacaaaccagaaacattattttatgaaaataccacatgttgctgacttttattcccaggaattccctctggtgctaattttttattatatcattttagaattcatattgtacctacttttttgctttataagtcactatttcttcatccaatggcaataaaattgtcacctaacctaataaatatctttatagttatatagttctatgtaaatactccaaataaatcagcttgaaaacctcaggaagctgagttgatgctcaaatatatatatttttgtaaactgtagaagctcaaatgtcaaatttaacaataatttgagagacttttctctttgatttaatgaatttttttagtatccataaagaaaacttacagcatacatattataaagcatgtcagctaaggataaaataaaactagacatacaaattcaaactgattagaatgaaattattaaccctaataattatgtttaaaagaaaagtctccaaatcttgagacataccagagtttaagtcttcagccatccatttacttgtggtataaacttaggcaagtttcttaaccttcttatccctaagttctgcatctgtaacttcttaggtttgtcacaaggatgaaatatgagaacaaagaataattctgttccatgatcttttcccttcctaccttcttatttaaagtatcttctgactgaggggttaggcagcaatgaaaattgactcatgtttttcaggtcaccactatggattcaatatactggcattaaatcagtagagaatagttgtcattgccttttgcaatattaaccaaaccactcagttcactgtgacagacagtgaattatatccaatgactccactgattttttccatgtagatagacaaaatataactactctcaaatgtaaggaccctgctttctgaaatggttctgttgctctcttcacagataggcttcttataatacttttaaaataatttgctaagcatacagatggctttctagagtgtggcattgacaaataaagtgatttttatatactgggaaattctggccttcaatgtatcaggattaaataatctgaatttctgaaagctagcctaagtgggcaagatggcttttttgtgctcacgcattgaatactgaactattctagttcttaaatggcgatctagattcaagacttattgaactagattgaagggactttattgatatcctacctaatgctcacactgacagatgaagagactgagccacatgttctaaggtcataaacagaaagaatgagaatgagatggtctaattaattgtccacctttcctatggtacatcagggtaacactttagtttacgagggtattattagagatagaaagaatttttttttaaataattgactcaaataccaacattttgcacattacatagagtaatagctttgcccaagttagaaaactgggggttcttctttattcctcttttgaccacatctatatactcagttttaaaaaggttcttcctggtatccttcaattccatccccatgttttcatctacaagcctagtgcagctattccagccgtctcctgatcaggtcttaagcacctcccatatgtccttgtagtacccaccatattgatctcagtagcaatcacagtactctattgtaaatatcttttaaattattatcttctctttgagcttttgggattttatcttatttatttttgtagttccaggatctagcaacagcttgtcacatcgttcatactcaactaatgtttgtttaatgcacaatgagcagaaataaacatactactccatagtaaaaagaggatgaacttttctgcaaatattaatcagcaccattttatccaccttttgggtttagtacattggaagtataggagtataaagcagaatgtccaatgtttacagtgatattttgaaatagataaaagccagtgcgacatttccattctcaatttctctgagacatcaccttgaaaaaaaaaagtatttttctcttcctaaaattagtaaaggaacagtaattccacatttataagagtatgatcaacgcatcacagataatgttgtaataacacattagataaaagtgcttattttcctgaaattatatggagaaaaaaatctgaaagtggacctttgttggatacaaatgaaataaataaggtacatacattttttaaggttcgaaagtttatggcaactttagtttgggtttccatgctattctatttattatatgggaatttactgtagctttcaacatgtacgaaacaggctggtagggctcatgcttgtaggcttctgtctaataacttggcaactgaggtactttagggagtatggatggggctcttccatgtctcaacgtcctgactgccaaaaaattatagcaggctggttctcagaatcttatagttagttgttattacttaatttccctaaccacccgttctttactttttctgtaaaggctggaatttttgagtagaccttattgttttaactctattgttctgtttgttttctccagttcatggctcttcattatcactggtgtccagcacttcttctctttactctacagtaagtaatggctgttaagaaaaagcttgtgcttttgccatgcacacagatgatgaaatagatcattttactgtgaacagatcacattcatctatgacttgcacaggagttgtgtagcaaaataacggcatactctaagctgcccaatacccaataaagtgccaggtgctccacctgccattctttggtcacttacatgtgctttcacttggcttttgtgcactcatcataatcaatgagtggatgtagaattcgatttcataaaacctactgaggtatgacttggagtctctgaaaccatgtatgtagtctgctatactatcattttagtaatgacgagttgtccatgttttgttctttgagccgtgactgttaattgttctatagtattttcttctcattttttatttttaagtttattgttgagaggattatcgaagggtaaaagcagtaagggtaaagggtaaaagcataaaagaaccagagatgtttttttttaaatataccttttgaaagagtgtgatttttttaacttttatttttattttattttatttatttatttatttatttttgagtcgaggtcttgctttgtcacccaggctggagtacaatgacacaatcatagctcactgcaaccttgaactcctgggctcaagttatccttctgcctcagcctgtcaagcagctaggactacaggcatgcaccaccatgcccagctaatttttaaattgttttagagacaaggtcattgctatattgaccagactgatcaatacccatggcttcaagcaattcctcctgctttagcctccccaagtgctgggattacaggtgtaagccagcacacttagatagaaactttatttattaagagaaaaataccagtgtttcaagttcttttgcaaacgtgtgacattataattcatttttgacaaggagagtttttctgtttggtaaatacaattctatcttttttaaaaaagtagcctacaggaagttatattttatgagtgagtctttttagagctaggttaacagtgaggtatatttaaaagcagcctactgaatctcaatgggacttgagtactatgaataagccttaatcctgtactgtaaggttcatgaagagttcatagcctctgctgtcactgatcaactgagcatcatgggcagtatttttttcactcattatcattaggttcaaatgtttgtttgaaccttctctttatagattaatctcatatatttactgccttacatagtcattcaaaatctgactgttattggcagaggtaatatttttctaatctctcctttcaatgattaaaattacccatagcttctagaaattaagaaatcacgattagtttttaggtaaatgtactttttgtgcaaatggataaagtgaggaatgtgtaaacacacatgaaaaaaacacataaaagaaatatattaagacttagtgttcctcctgttgggccagcactgccatttgttggggaattgtattctgatttaaaccattgccatttacatctatgtgtaacatcaaaagatgtagcatcattattattctaaatacatacaataattaatatttggataaagctaccttcatgaaacctaagaaaaactaaattaaaaagaaagaaagaaagaaaaatacacttagatagaagaaataaggtctagtgattggtagcacaatagagtgactatagttaacaataatttattgtacatttcaaaatagctagaaaagaagatttggaatgttcctaacaggaagaaatgatattcttcctaaatgaagaatgggatattccactttcctagatttgatcgttacacagcatatgtttgtataataccacatgcaccccataaatacatacaactattgtgtatcccaatattaaagatttttttgaaaaatttattcctcaagaaaaggatcatgagtttaagaaaaaacagattactagtctaccagtgtccagtagacctttctgtgttaataaaagtgttctgtatctacactatctaatatagtaactatgaaccatatgttgccattgattatttgaagtatatctggcaaagagatgaattgacttttttattttaattaatttacattgaaatagccacatgtgcctagcagctactagattggatagtgcaagtttatagagaacacaaggggtacatttgtagataggagtgggatgtcaaaatgatgaggataattagaaagcatacatgagaaatattgttttaagagtagaatatgaaatgggaacacagattaaaatagagtatgtatatatatacatatatatgtgtatatatatacatatgtatgtgtatatatatacatatatatgtgtgtgtgtgtgtatatatatatttataggccaatatatggaggtagggtatatcctagtgttaagtgagtaaagaatggattaggtgatcgagccacatgagaaggtgatattattagaaaattgaaagttgtatttgagatgatgaaaatgatatatttgaattgaaaagtaaactgtagtaaaataattcaaataaatgaatatttggggaactacttaagagaaaaatcataaaacatgaggagtcattctttccccagtccgccatgatcaggccttaggatttaattggcaatgagaaaatacctatgaaaatgctttttaaactatcacatgaaaaagcaacttattatttttcatgccttcttaataactctcaatagagatttagttgatttgcatttttgcctggttcaatcaagaaattatcgcgtgacatcaggcaagttgccaaatttctttggactatacctataaaataaaatttgaaaatattagctagatctaacccatttgtctccggatgtctgcaaagtggttggaaatcacaagcctaacctgatctgcagaggtgttacctttggcaaacttatggtttttgtgtttgttttgaaatctaaggccaagcgcggtggctcatgccggtaatctcaacactttgggaggctgaggcgggtggatcacttgaggtcaggagttcgagaccagcctggccaacatggcaaaaccccgtctctactaaaaatacagaaattagcccggtgtagtggcatacgtctgtaatcccagctatttgggaggctgaggcaggagaatcgcctgaacctgggaggctgaggctgctgcagtgagcgccactgcactccagcctgggcgacaaagccaaacactgtctcagaaaaaaaaaaaaaaaaaaggaaaagagggagaggggagggagagggagagggaatctaagccaacactgtgaaatattgtgaaatatggagcttctacctaaaaattcaaaattttaaattccttttaaaaataattggaatatctatggaatatctagcaatactaagatgaaattcctctgggttttcagtcacctgtaattgacacctttagatgttggcatgggctctcaggaagccacagcctccaccaatgcttttcttcctgacactgaagctaaatttgggtggctagttttcattgtgctgttgctttcctcatgggaaagaaataccctttgctatttatattgctgtcaaatgggaaaatgaaagacagccaaggaagatcatgtgactatttaaatacttcaagtccatttattctttattagccttgtcctgttaggcatttaaatttttgatccctgcaatagatgttttttgattaactgtatattaaaaactatatttaacctgttttgaatttgaattctaaattgtattttttcatgagagcaagtgtcatttttgattcattgtggattgtttaacatgttgcctaacaaatagctaatactaacgtcataactttttaattaataaatttgaatggataaatggccacttattggcttatagaataaataaaaacatttttattcagtcaagtgtttcatattttttatcatctccaggacattgggcttgctcaaaaccattgttaaaaaaaaaatggcaaataatccagttccatcatgatatcattaatcccacacctaagctactgaaaaaaatatattaatattctggctcattgctttatttttatggtaacacccacctggtattaataaccacagagtacgaaagaaggcaaaggttaaagcaaataatagttttgaaaaattggtagtgaaaaaagtcatgctatacggtatgtatataatagatatttaatgattatgcttgctactagtatatgtaacaggactattatagattaacaaaaatgcggtgagtatatttcttgattattttttaaaagaataaattattatttaaaaatacatgaattatttattgattcttgaatctttaccagctttctataattctaggaagcctagaagcagaattgggcaggataaactggcaaaaaatgtaaaaagtaggccgggcacggtgggctacagtgagttgtgaatgcgcagtgcacctgagtgatagatcaagatcctgtctcaaaaaaaaaaaaaaaaaaaaaaaaaaaaaaaaaaagaaagaaagaaagaaaaacaacaacaaaaacaaaagcaaagtactagggaaaactaatagacatagttacatagttaattgtgccatatgttttaaggcaatgaaacttttatcttaatattccttgcttactttttattcaaaaaccaaactgtgtataaaaccttaaaattattaggatctaaaaaataaaatctttccttaaaaatctaaaattgagatgtaaattattcaagagtgctttttaaaacagttttcttataaaggctattaggattctaccacttagccactttattatttagccactatattactaagtttacatatttttaaaggtagtgaaaatatagggaagacaaagctcaggttaaaagagtttctggcaaataaaatatatcctgatggttagactactttgctttatgttttctgaaagaaaagcagtaaaaaacagttcaggtagttttgtgtcaattaatctagaactataccaaaagtagacatagaaaacgagagattgtttttcagctttggatctgcttatggcaataagcagacttgtactattcaacaacattatgcattcttcagcttttcccagaataagggagcttcccaaatgcaatggtgcacataactcattttctggcattttgcagcccagcatgaagaagaaaaacagagctaggagttttctggaagtcaagtcaaaaacaccctgcaaattcctatggcagtcctcctttccataagctgcatagccaaaaatgtttgccagacacttttatcactgggtgtttcagtgttttcattgtttaagcgttttgctgacttgtgataattaaaattattaataatcattaaagaaagaaaaagtagaagtaaataatgttaattatctgtggttatcagtagaggtctgtatgttaccccagctttatttgacattgtttgtgatcagtaaatcacagaataaaattctgacatctaaaccttggctagaggtctctataattttatggagtctgtttcctacaatctgtatgaaagatacttcaatattttaagtttacatgcacccatcttttttagagtataattttataactatttggtttatgttgcttatgatttacatcttagagtcttttaattctgtcttttgcttaaaggaatattatggatcaaatgacctatattttaagaataccttatggtttatatattaagaaacatttatataaaattctaaagtaacttgcttgtactatttcaattgaataacttaatgtatttcattctattcttctcatagtagataataaaaagtacatcatgattattgtattcatttatacttgtggaattaattgaaaatagtttttatagttaaagtctttctttttattgttttacaggctgaagaaaaggctcattcagaggtaaaaaaaaaatatgcaatattttaatattttctattttagtttgcattcatgatgaaattagtcttgtgaccactagagggctctgtgatacaatagcagaactccacaggactgctgaagtaaggcagctaattgataaatggtctttgatattgcctcttaaaaataaaatgaaaggaagtttgtatagcaagctgtcctttcacattctagattgagtcttagctcaacacctaataagttttctataatagtaagcactcattaagtcattgataaatgaaggtctatggtcttcctattttattacagtctttttcccactccctgtaagaccatctacacaggataatggttgaaacttgggcaccaagcctccacaacacaggatactagcatctcagactatctgttttgtgtcattatcttgttgcctctaactgccattttatgtgtggtgtgtcacctattgttctaatcacatatttcacaaatacatatttggttgcactcgtgagcaaatcaaactgcattcaggaaagaatactattttaatttcccttggtaaaacatttgtcctggtcaaagagagcaggaggactttaattatgactttattcaaggtgaggtaatggctgtttgattggtttacactgaggcaatcagacaacagagaaaaaaaatgccttaacaacagcttttgcaaaagtattcctttcctttgaagtcttattttattagcctttaaaaataaaatttgtgctatgtttaaaaatatttgaaaattattgattaaaccaatttgtctttataatctctgaaccaaagagtggatatgatttttaaaaatcaaagtggttttatttacatcacatggacatgacaaagcttctaacactgatcatagtatagctactgaagcatcgaaatgctacatctatttgccttagtagtagttattcaactccccttttatcattgatgctgtatcatgagttatggtttaaaaaaacaatttcaatcactttacagtttcctggattatattttaaagatactggaatcatgtaatagagactatttaatttgagaaatgctctttgagtttggattcatttatgaataaaatagacgctgtattttctgaaatcattcatagtcattatcttataaatgtaaagcaaatgttattttagactggggtgtatctgttccggaaaaaaaaaaaaaacaggaacgaagtagaatcacatttggtgaaattatataagtgtctactgtttccagcttagagttctctactttgttagagtgtttgagttgaccaccatttattttcaacaaaatctaatgcccggggcaaaaactagacagttaataaactatgtcaagaattctctttcaaactgagacagcattccaaaagttcaactacaactatagataagatttgtttttgaagaaatgagaagcatcaaaagtagaatgtttaacatccaagtaactgaaatcccttgagactagatatatacttatagaacctagtgtcagattgttataaatgttctatccttattagtcacaacatgagacttgcagaacaaactgcagaaagtgcttgaattaaaactttaaacatgatataatatatccttacccttttctgtttcagttttattggagtgtgaacttaactaaaaagaaagataccttagaatatacattatattggtttatctaattagttgcacctatcattggttttttcccctgatttttaagatgtggataagctataaagcatctctgagctaataataactcactaaataaaggtcttgataatacagatttgggaaggcttctctgcagtcattgaaactccagccaataacaatttaaatgtgaactgattaaatgttgaattaagcccaagttttagtgattgcaggatattccatagcctttgagaagttttcaaactatgagaaattaaaatgtacagaggaaaaaaaaacctaagattttctgaaaaagaacatggagtatcttttactaaaaaagaacaagaaaaatatgtgtgtatatacagtttttataaagaaaatatttttctacagttttattaccacagtttttctagaaggagaagaatcaatacagagggtaaactgctcttgagtcatttgccatttgagggatggcaaatggagcaagtgagcgtactttgatttgtagattagagtttgacacataacactttgcttttgaatgacatttgcttgttactgtggagtcagtgttcatatcctttattttcaggagttgctgctgatacaatggggttagaatgagctaaatacagcatttgctttcttggtttgaattctgggttttaagtaaaaatctacttgcctattccattgatttttttaattgcattcagcaaatccataaactgcggagagagctggttgcatcacaagaaaaagttgctaccctcacatctcagctttcagcaaatgtaagtcacttcatttttaaaatatattacaacaaatttttatagaggaaaatgaaatcattttagtaacaaacttacaaattttcagtgcctgatacagacttagattaccaactagcaggactcataaaaagttaacattttttgcctactcagtaataaaatgtaaatccaaactgatgagaggcagcaatatggttaaaatggcttgttgtttctaataagattggaaacaatagtaacagccatatgggttacttcttttcttgtttgctatttttattactcctcttgcataagattctctgacaatgtaagaggggttgttagtgtttgactttggaagataaaatattcctgtgcccagcctccttcatctcaatgtattgaacaatttgttaagcatccagttaattctaaaatatgaaattaggtctaaatagggatagcttagctgcactgtggatgagatatggtttgctcaaaaaaccttggcagccttctcatagcaatttaaaagggtacacttttactggcaccagagcagcccaggatggcagaaatgatgacaatgaagaccgtcaattaaattaacatttactgaatatcttccactgtgtcagggagcactcagagtagatgcagaatgataaaggagaaatgtggcactgttcccagtcctgaggagcaatggtgttaagaacagcagtgaggggtaaggaaatgcctgctattttgccatatgtcttacctctctcactcaacagtcctttgctcagttctgctgcatagctttgggcctgctctgtgcctccccacccctcccgctgctcctctactgagtttttctatctcctagacaaagcatgatatgtcaagagtgagcaggtgcagacccacagtgtaagacttgaataagagccatttttaaattttttttaagctatcattgtgcaatataaattctgagtatgtgtatcatttcattcacgatgtattcattttagcactgtatttgaattgattttattttctgaaatttgggagaattaattttggatttattctatttatttttaatagatggtgttaggagattcctgaaaataatagcagtttttagataattgtttaagcaatatgagaaaataagggtattatttaaccttgttgtgtttttaaagagatagtccagaggcaaccgtaaattttataatataggctacatgtatagaagtatgaaatattgttgtctaggttcctgaatttgtacccagaggaagtagaataatgtaaatgtcagaacctcctgggttgtgtttatctgcaataagaaaggctcaatggcaaaccttatttattagattgtcaggatacttgcagatgtcttgaatgattactcagggtttcattttatttttaatgtcccttggttgagctcatcatataattcagatattggaataataaatggctgctagacatagtggaagatgggctgatactttccatttgaaatgtaatgatgcttattgtcttcaaaagaaaaaactaaaatggtatttcacatttttttgtttttgtttttgtttttttttctctgagaatctcattcttactcatgattattggtttcttgtgtaccatttcaacatttttctattatatgctaatgtgtatatatacttaatacacacgtgcaaaagcttcctcacacacacacacacacacacacacacacacacacacacatacacacacatacggaaccaaattctaacataggggaataatcttcggagtgaactctgtgctgctgtttgaaaatggagatataattttagaaaggttcctgcagttggctacccacctcgtctgctctaattatgcttgtcacactattttcactgatgtgttttcatgactttagggcatgaattctcagctgggtgttaatatgaccaacaaagggtgaaaacaggttcttgcatttttttaagtactctttttatgtgaaaagcacagatatgcagataatacataactgaacatccagcatatctgtggctttaaaatatcacgaagaagagcacaattagggaaaagaaaacatctatagtgtttccctaggggaacaatcatttaaaaaaaaataaaaataaggaacacagactagaagcagcagtgccaaatagataattcatgctagtctttgtgttaatttaaaaagtgctagtcttggagacaaacgcccaaattgctctaggttccactcagctgtatgtgttatcattagtattaacttttgcacgctgatgggagactgatatatatcctgttttatgttcctttaaacaatttataatgtaatttagaaaccttctcaaatcacattagatccacacaaaaacctgtacatagcagctttattttttaatagccaaagaaaggaaacaaccaaaaatatcccttaataggccagttaataaacaaattctgatacatctatatcatggactactactcagcaatataaagaaatgactattgatacgtgcatcaacttgggtggatcccaggggtattatgctgagtgaaaaaagacagttatagaaggtcaaattttgtataattccatttatataacattccagaaatggcaaaattaaagaaacagagaacagattagtgattgctaagggctaaggatgaaggagagagagaggtagtgtgactataggaagagggagatctttagttttgtattttgaatgagatggccatcacatgaatccacatatgtcaatctattaatgtaaatcaatattgtattcctggctttgatatataatataattttataagatatataatcattgggggaaactggatgaaggatacaagggacctccctgtactatctttgcaacttcttgtgtatataattataaaatatataatgtattaaaatgtataaaataatattttaagtatcagatactgatctttactcagtatatgaagtgttctatcataacgtaacatgcttttcctttatttgtggtattttagtttcaaactaaaatataaatcacctaaagatctacgacagttcttttgaaaaaaaatcttgcttttaatttcccaggagtttcaaccttaatcctctctttagtgtttctttatttggtagtgatagggactatcaaagcttcttaccatcaaatacatttactgactaaaaatagaaaaataatttacattgtaaaaatgtacaaattgaatgacagtcaaaaggtacaggtaatgaagatatgcattaacatctacttttaaaaaaaagtttattaaaattctcttttagactaatgcagtatctgggaatttatataaatagatatgtatataaatgactattaaacaattttaatgtcagttatattttaaacattttaataatattgttataactatgggggtaaaattttgtatatatctgaacatttttgttcttaaggaaataatcatttttacatatccaggaatttgaattactctcaagtcacctattaattacaagtcattttgaactcattcattttctttgtgtttgctttataatgtcattttagatttcatgcatcataatcagccatcaaataatttagttaatacttgatttttcctcagttgtaagaagtgctgtgtttaaatttcattcagaatgtttcatttcatctgaattaatatctgttaatgtatgtaatatacacatatttttaacatgcatgtacttaaattgattatagggacttggtaaaattacttatttataggatattttaaatataatcaaggattttttaaatctacagttcccatttgaaagtaaaagtaagtctttgtttactagtttgttcacagtacaagtaaactttctaccttttggttaaatgtgagtgcagcccccacagtgagaaattgttatattagaactctaatagctataatttatagggatgaatttcaatgagtttggttctaagaaataatctgttggttttaacaacatttttaagtatcagatattcatctttactcagtatgtgacatgtactctcatagcttacgtgcttttcctttatttggggtgttttttatatattaattggtatatcgcatatttaaacttggcataattacatttatatggactctaaacaataacttgtattttaatttttaaatttgaaatgcatctatgtctctgttaaaatgcatttctttccctttgcccaaatggggtatggtaagtcaagagagtctctagttagctcacctctcatttgactggcagagtaaagcccttgttcagtagaatgtgtgttaagccttccctcccttttgtaaagttgttctgaacagagctgcataaaaccacaggtaaagtgttaagctgattctactagcatgtccttagaaaggagagcggttatattggcaggtcctattgcctggcgtttctgatcaataactcaccaacaaacagaaaacagaagccgcacaaggaaaggcagaactaaataaatggtaatagcaaacaataagccagatagcctctggcctctcgcccacaccttaaggcagctgggtcaggtgggatgcttttgtttgtcttttaacgtattttctttacaaatctcagccattacataatttggaaatggacacaaggctagttattactaacatttttaaagacattactgaatgaatgtgtaagaaaacaaaaggtcctttttgcctttcagcagataagtcttttaaccaaaaatctcttgggtattttgagattgtgttctacttctttgcttatttaatattttcataaaatttgctagttactcttgcttttttgcatctcttctaagagaaaacaattggtgcatattattaatgagaaacacttcagtgtttggacaattttttgtagtggaaaagaaatgtgaaactttatgttgcagaatcattcttggttcaactaactactaattttaaaacataaagtcttaaatatatataaagtttatatgggtaaatatatattacatataatatatgttttatatttatacataatatactatatatttatacatgatatactaaatattttcccatataaataataaaatgctctaggcatatatgtgtgtgtgtgtatatatgtatatatatatataccttcataacatacatatataaaatactatattatatatactctaggtatacatatatgcctatatatgcacctatatatttatatattactatataatatatagtatatattactatatatactactatatattactatataatatatagtatatatatagtatatattatatagtaatatattactatataatatataaatatatgtgtgtatatatatatatgcctagagtgtttttaatttgtcagtgggctgtctctgtaatctatatgaagaaataaaatgtagacgttatgtataatgatatttcatcttgttgtgtggcatcatagtaattctctttacatatctattcagattacttttgcaccagcctaatacattgtatgattccaaaaccaaagagagtatggattgaaatgatattccctttactaatactcagtcttgtctattttattacctttatagacttcacctaacacaagtcaggggatatttatcatcatattaatacaattttactctgaccttaaaattatgcaactgctaaaggaaaaatcagaaccaaataaactgtcattaacaacccccctgaaaatccatattttttaaaagtcattttatcaagtctctcagacaagatgtgataccctataagtttaatcagttttactttccattttctcttcattaaggtgataaagattatcattagtagaaaaattttcccttatttgcctccttttccatttaccctattgagtgagaaatttagcctctcataacttctaaagtagcaatgttaatctgataaactaaaccaaggtgagataaatttaagacaatattttttttcttcaacttttaagttctggcgtacatgggcaggatatgcaggtttgttacatgggtcaacatatgccatagtgatttgctgcacagatcaactcatcgcctagatattaagcccaccatccattagctattcttcctgattctctccctcccctaactcccactgacaggccctagtgtgtgttgttccccaccatgtgcccacgtgttctcatcgttctactcccacttataagtgagaagaagtggtgtttggttttctcttcctgtgttagtttgctgaggataatggcttccagctccatccatgtccctccaaaggacatgacctcattcctttttatagctgcatagtattccatggtgtatatgtaccacattttctttatccagtttatcattggcatttgggttgatttcatgtctttgctattgtgactagtgctgcagtgaacataatgcatgcaggtatctttataatagaattatttatattcctttgggtatatacccagtaatgggattactgggtcaatttctgcttccagatctttgaggaatcatcacactgtcttccacattggttgaactaatttactctcccaccaacagtgtaaaagcattcctttttctctgaaacctctgcagcacctgttatttcttgactttaataatcaccattctgactgctgtgagatggtatctcattgtggttttgatgttacccttttttttatatgtttgttggctgcatgactgtcttcttgtaagtgtctattcatatcctgtctattcatgtctttgcccactttttaatggggaagtttgttttttacttgcgcatttgttgaagttccttgtagactctagatattagacctttgtcaaatggatagattccacaaatgttctcccattctgcagattgtctgttcactctgatgatagtttcttttgctatgctgaaggtctttaattagatcctatttgtcaacttttgcttttgttgcaattgcttttggagtttttgtcataaaatctttgcccttacctatgtcttgaataatattgcccagattttgttctagggtttttatagtttttggattttacttgtaagtctttaatccatcttgggttaatttttgtataaggtataaggaagtggtccagttttaattttctgtatatggctagtcagttctaccagcaccatttattaattgttttttcagtttccccattgcttgtttttgtcaggtttgtcgaagatcagatggttgtaggtgtttttcactaacataatcataacatacatttcattgaaaacaacacgactcaaaatgttctttagtaaccagttataagtttttttgtgcataattacaaactgccattctaatcataaacattttgtggttacttatagctagaaaatgtgagtaatatagtttatacagcatactctttacaatcccgatttctttgtcaaactttaattcatattaaattgataaagtatacacaaagggtaaaggagagtaattttcttcaagtttcacatttaaggattcatagtagaatgattaaaccttacatttctccactataaggagaattaaaatggaaatattgagtaaaatcttacatttcatttagtaagtgctaataaagggtttctgccataattttccttattttaaaagaaaacacacaattttagttttaggttttagtaaccaattttatgggcatagtgggaatatttctaacaggttaaactgaagtgaccatcatgggcatatatatatattttaaattcacatatatgaatactatacagtaaaaactaacttatgctacataccacatggatgaatctcaaaacccatgtaaagcaaaagaaaaccacaaaagaatcatgccatttgattacacttgggtggtttttaaaacaggcatatctaaacatagtgctttgaagtgtaagcttgggtaggaaaaactataaagaaaagcaagaaaataattaccacagaagttatgtagaggttatctttggggaaggaagagggaataataagagagggacaaagaagagcttcttggttcttgaaatgtcctatttcttgacttggctggtgaatgcatgaatgttcactatgtgataagtcagggggctgttttcattttgttcacttttatatatgtgtggatttttccacagttgaaaaggtaaagttcaggtgtggtggctcacacctataatcccagccaacactttgcggggccaaggtgggaagaattacttgaggctaggagttggagagtaacccaggcaacagggtgaggcactgtctctacagaaaatgaaaaaaaaaaaaaaaaagtagctgggcatgttggtacatgcctatagttcttgctacttgggaggctgaggcaagaggatcactttagcccaggagtttaagcctgcagtgaactagggttgtggcactgcactccagcctgggtggcagcaagacactgagtaaaagaataaaataaataattaaaagttaaaatataggaaaaaatgagcatagccttatgctaatttttcagttactaggtctgatatcatcacattccttgcttgtcattgaaaattttttaaactatgatacttttttttagtggtatttatccaattaaatctgctaacaaatttggtgtataaatctcaagggtaagggtatgtggagagtgggtgtgtttgtgtgagagagagagagagaagagggggaggagaaaaagaaggaagagggaaggaatggaaaaagataataaagagttgttctgatagattaatctttagtagatgtattccctacaaattgtttttctccatattgcagtgtcaggtaaagaaaggcatcccaggatgaattcagagctaggaacatgcacctttgtatcataatgctaatggaaggaacatgtacattctaactgttaccaataatggaatatatttccgttattaagtaataagctttaattctttgtatttttgtgatccatttgatagtaggtgcctcagcatttccactctgctataagtacatggagatatattttatttaagtcatcttattcatgtctttcaaaaagaaattcatttttggccaaggatttccaaattttgccccatatataggtatagtttattatagacttcgtttgcaaaatattaaatccttatatccttttagggacacaataaaattttataagtttgagataatgtacttgcagttctacctcaggccgtggtgagagattgaagtgcctcttcattttaacattttgggttcaagttgttgcataagggcatgcaaatggaaactggcctatttttgagctttaataaaatcgtcaaatacttcttaatcttaagagttatagttatgtactacaatatgtataattctctaatatttaaaacaaaacctgaaagccacaaaagcttactgtgaaataaaatgtgatggaatattatttctaactggcttacctgtatttccttcattgaagggaatatgaagtagaaaagcccttttattgaaaagagtttggaaagtaaagataactcttttcaattcaattctttgtaagtagaaaaagagtaaagataatgttctagctgtcagcagatgtctgacacttgatggagcgtatcattacaatagagcagctaacaatatctgcaaaggtcatcatgaaagtataaaaatgaggaatatttgtccattgaccatttcagtgacctctttttgggctttaagtctaaaaatcttggcagatcagaactttatattcggcattttgagtgtcaaatctctacatgatgtgcaagtcagaaggagttattacttgcaaaataccatcttctttcagaagttaaactcacattaaatgccaggagactgaaacactgattttaagaagacaaagtttagaaaagatgaatgaaaatgtgtgttaaagaagagtcaccagtcagagctaactatgatagtcatagtatttaaagagttggaacacatgaaattaagcattttgtaaaatgaaggcttttcatccatccacataagattctgacatttaaactatgtttcttccattctgttcacaggctcaccttgtagcagcttttgaaaagagcttagggaatatgactggccgattgcaaagtctaactatgacagcggaacaaaaggtatgttcagaaattgccactggagactgaaagaagacagcaaattgcataggattcttaaataatacctgaagctccttaaaaataatattccaggctgagtgcagaggctcatgcctgtaatctcaccactttgggagaccaaggtgggtggatcacttaaggtcaggagttcgagaccagcctggccaacgtggtaaaatcccatctctactaaaaacacacacaaaaaattagctgggcatggtggcgggtacctgtaatcccagctacgcaggaggctgaggcaggagaatcacttgaacccaggaggcagaggacgcagtgagccaagatcacaccactgcactccagcctgggagacagaacaaaaaaaagaataataataataaaataatattcaattctatactaaattaaaacaatgataatacctttcttttcagattttaatttaaagattttatcagtttactccatattggaacacacaaaggcaaacaaaatccttgctgggcagtctattaatttacttctggatggaactagtaaaagaatactgaatgttaagaaagagaaacagtcacataagagaatattctgggggcaaactgttatgcagttgacaagaatcacactttgataagaactttcacaaatacatggtcactaaatccagctatagggcatggctgtaggctaagacacacaggaaggatgcctgggactctgccaagtaagggacttcaggttacagcagctatgaaacaaaggccaatcctgtgtaattttgaaataacaagaactagttgccatctagggatatcacctttgaagaaaagtcatttgttatatcaaaatacttaaaatgaacctaaaggattttatggtatgaaagaaggtataccaaaaagaaaggaacggagaatttagttcacgaagacaaatgtattaaaaaggtccatactgcatagaaagcctggtcacctttcctgtgatgaccagttagcttacttctctgctgttagtccagtggccttaacttccttggataggtatcagagataggtgaaacctatagaattctatggagtgtgtgtgtgtgtgtgtgtgcgtgcgtgtgtgtgtgtgtgtgtgtatgaaaactgtaaatgtgcataaatgatcaggtgtccagagctttcatctaattctcaaagagacccattatatcaaaagttttgggtattttcaagaatgcgttcctctatctatccataggaatggcttcagttttgtctttagattctgtaagttatgtgattagctttacaaaagtagtatgtattaccaaattttgtcactttacaaaagtttatttttaaaacagaatgaatagttcaatgaaatcaaaagagtaaatcgaatattcttataattgccaagtattattagcacattgtattctctctcatattctccgtataccctgcccgtgagagagaatattatccattcctggaaaatctgttctagcacagctaacaaactccttttgaaacataaattttcctttctttcctccctccctccctccttccctcccttccttcctttttccttttctttccttccttcctgcctcttttctatccttcctttctcctcccttacaccctttcttccttcttttccccctctgtctccctctctttcttttttgctgcagcttgtcacttcactatgtaatataagaacccagcaaatagaattagaaggctttttagagcagctgacgggaaagaataaaaacactgggccccagtattcttgaatgagaattctggctatgtctgttaaaagctgggtaatcttgagcaagtttatctaacctttcttgaacctcaaattcaccttcttaaaagtggggatgataatgactaccttgtaggatcaccatgaggagtaaatcagatactgttatcatgtcacatgctaggggctaccaaaaaatattaccttcctttacatttctctttttcccttgaaaattataagataacaccaaattcctcactgggcatataccaagcatattgttggaaatgagtgttagaatttaagtctcaatatctttaataagtcaaaattaatagaatttttgtcctccacccaatattttcttgaactctgttatatctgtaagtgaattttctcatagaaacatacagagaattttctcatatacatatagaaaaaaatgtagaggtatgttaatgtataatgcctatgattaatgcctgaatatttaaaaataatttctataacataagagattttataatgtgtctacattatccttaaaataacattgccaaaattataaaattttctcagaagatatcagaatgtctcatattgtccttatcacttttttaactgaaaataaaatcacttctttttgaattgcaaactgtatacacacaacaatcatggttaactagtttattaatttgagattataacttgcctattctcaaagtgatatttaaaagcctataaaattatttgcaatgtgaaatggtataattcaaagacagaatctaattaaaaccagtagaataatgtatataacaatatacctcagcctagataattactactgcaaggcactgaaatgaattgaatttcaaggaagctatagtacaaagggagattgttaggtgtgttttattctcattttctgaccaggagagcataatttagactgaggagaaaactctttggcactaaattcaaggacgaatttattgccaaggtttttaaattggggtcatggaataacaaaagacaaaatcactgttcaaatagacatttctctaaaagctaagggcataacatttaatcatatttcactaaaggcatttcttcagggagctgagataaaagggtatattgctctctggtgattcaacaatcctgagaaaaggcttgtgaagtatagagcagagattcttaaactcccttccccaagttataagtttcatttgtctatttagtcattcatcaagtttatattgaatttgtgctcttctaatgacaaaacagtacagacaatatagatatagaatgatagatataggtctatatctatagacatacctatctactagaactctaaaagcatattatacatgtatgtaatattcctcatggagtttatatttctcatatatatctcatatatatgtatctctttatcatggagtttatattttaggaggtcacagatgataataaaaatataattaaaacaggccaggtgtggtgactcacacgtgtaatcctagcactttgaaaggccaaggcaggtggactccctgagatcaggagttcaagaccagcctggccaacatagtgaaaccccatctctactagaaacaaaaattagccaggcctggtggtgggcacctgtagtcccagctattcaggaggttgaggcaggagaatcacttgaacctgggaggtggaggttgcagtaagccgaggtcatgccactgcactccagcctgggcaacagagcaagactctgtctcaaaaaaaaatatatatatataatatatataatatatatataaatatatatattatataatatatatataaattacatatttataaatatgtaatttatatatataatatataattaaaacatataggatttcaggtgatgataagcactactgaaaaaagtaaagctgagaatgaggatactgagaagctggtttggaagctaaaacacaaagtaacaaaggccaaggtggttacatgttcttgattacatactttaaaaatggataaactaaattaagactcagattctagtctttgggcttcacagtgtgattttcagcaatcacatggcattaatagcctgaaactacatcaaaattgtcatttgatttatagaccaaaataactcccttgaatagagagggattcactcctaacacttttcctatttccagatgccaaataacacggaatctcttgccaaatttgtgtggcagaacactggttttatatacttatagcctggtaagaaagaaaagacatgtatgaataacttagaaggcagaaaattatcatgctattagactcagtacaatgtcatgtgcattctcaaaggaaacatctgcagaggcaggagaattgcttgaaccctggaggtgaaggttgcactgagctgagatcatgccactgcactccagcctgggtgacagagagagactgcatctcaaaaaaataaaaattacaaaaataaaaaataaaaaatagtgatcaatctggcagcattttctgaaagttaagcagtattcccaatagctgctaaaagaagacatgttatataatactaagtctgtaagtaggtaaaaattaagagaattgttaatgtgcttgctggggagtgaaattatctctaggcattaccctatacctaacctaggactcagtagactatgatattggcgtagtttgaccaagaattttatcctgatttcagatcgttttctcttcaccagcacttcttcaccaggattatatgaaaaaaattaaacctgatgccctgaggcatccattatatgtgctgaaataacttcttttctcaccatctagaatggtactagctatgtaccactcttgtcagaatcaaggaaattgctactcaaatcattgtgcagcttaattttctcacagaaggccagttgagaaaggctcaacttctaggaatccagcaaactatattttttataagtaacatttttacagaactacttctaaatccttgtgttcaaatttactaaagctatattcacagctaaatatttcagaatttaaaatttaaaagactttcaaattagttccctgtagctgtcatgccaaggcaattagaacatatgttaaggtatgaggggtttttcttgttagaaggtcagagcagggcagagaagtagccccttgtatgagtgatgaagctcagatattgactcctatgctaaccataaagcctagtagtttgctcatttgttacctctctgaaacatttttttgggtgactacaaaacaggaattgaaaccttcaaaataagggaatttgaaaccaaatctttgaaaatagataatgctgcaactaaaaatttagttgaataggatttttacattaactctccctaatttacgttatgatatttgccatctagaagtgtttttaaaaaatatattgctggagtcagatgatgcatccattaatctttggggcatagaataatgtgaatctaaaattttcaaattatttacactactggtatttggtcaatgtaatttatttgaaactagatgcaatagggatggccaggttatttcagtagaacaactagcaagacttcagatgcatggtggagtggggaaaggaggacctgtttaaggaaactagagctgggaagtgtgagattaacttagtgccaatgtgaggacctaaaaagcagatgtggtggaaaatttaaacaggcttgcctagaaggtcaagttagttgatgacacttgatgagattgtcccaagctttgggattctcaacaaagtctttgttagtgagaaatttggaaagagatcaggtatagttaagaaactgggttggaaaggccaccaggaaaggcgaatattctgacacaaaatttgatcattttatttggaagcatttcaagcctgacctgaacgaattgtttagcctcagatacatgcataaaactgtgaaaagagacattgactcaatttagcttctttaacatgagaaactttcgtggaaaactagaactttacaagctcagctggtgttgggggcatcattatcttgaatagctcactggaggaaaatgaaatcttagtttggttctcaggttttaaaatatctatcatttttgaaaagtgtgaagtaacaaaatatgatctgattatcttattcctaaaatcctttgcagaattatcccagcctcaatcttctctttagtatttaatgagaataagaaactggaaatgactgaattggaagagtagactttaaatccatatcttgatggcatatacatttttcagttttttttctaaatgattaatgaggattctcaaaacttgagtatcttctatgtttcccttcaacataaagaaattgtatgaaaatattttaaaaatttctaatgattttatagttagctatcttgggaattcatttctaatcatgtacctcatccaaactccccactatggacaaaaataaaataaaaattattagttgcatctgaaggccacattacaatttctatgcattatagaaacctgagaaaatgtatcttaaaaaataaatgtgaacaactaaccataattatgaagaagaaaaatgaaaactagaaataaactattgaaaaatgtctatgtatcagttaagtttttattttaaaattctttatgtttatctctataatactattgggaaagagagaaaggaaaacctgactttgttctcatccaaaggaggtgattccactgatttagccaaaataagacttcctggttataataaataataaagtttttgatgttttttatatggtaccccactcactaggtgatcagacaccctcctgcaaaaaaaaaaaatacgtatgcaataaagttaaagttttatgttattctttcaaggggagaaacatctgtttaacacagaccagaatatttcaacaaagtcatcccaatatttatggagatcataaatcaagcgaaaaaatatattcatcaacaactaaacaaactacattaaatagtctcaaagcacattttcactttttttctgacaggaaaacaggtttcacaagtgtggagacattttaccatggcttttaacagtgaggaaggatgtttaaataaagggaaaaattatatggaaagctcagagaaaagagatgggtgtggcttgagtgacaaggtgagagcagatctcattaactgaaatgagagagaaggaaggaattttgcaaatatggaaagataactagtgcaagtttgaacagattatgtcaatcaatgtagaatttggctatctttttaatcaaagactatggaatattttataggtgtttgcttatactcaaagttttaaagaaataacagtatgaatttggttgaactaatttttttcatagataggattctcccaagttatatagcatatatatttcttaactagttattcttccttttacatatattgtgccacattgagtaacaactaacctgctaatagctattggtttttaaaagataattaatattagaaagtgatcatttttctgtttcatattaaacatgatattctgaaaaagcaacattgcctgaatgttctacattttatctttttgaaaacaggttttataagagatttcttgtgaaaagctgaacgttctgacactgaaataagtcagctaactcaaagctaagcttaattttttgacactgttggcatgaggtctcattcccaattttttcatttaaagccacaggcaaatgttttaacagattttaatccgtagtacaagcattattgatcttaaatttaaggataaaaacctgattttaattagaatttaatatgcattctagtatttacgttgtataattaatatttacattccatgattccactatgtaccatttatttctttttgaataaatttccagtaggagcagaataaattttcagtgaatattttatttcttgggggatatttttaaatggaaaatatattaagtttcggtaaaatctgttgctaatttggcagtggacagaatataaaaattggagagactgagtcattatgatgaattgggtctgacttttgtcatgacactggaaatttcccacaaatattatattcttcttttataataaatatagtcgaaatgaattgcagtcaagtatttgaagacccatctataaatttaggcggttactgttgatttttcattatgagagattcttccactcataagctactaaaagtacataaagaaggtctggttgtttgttttaaatgtgactgttctctatcaggaaaatgtcaggtatccgatgaaaatagatatatgaggtgccaggtatctattccaaacttggatatcacttcaattagcatcatctttttttttttttaaagtgtctaaggttagaatagtcaccagatattcccatgtatgaagcaattttctgcaaaggccgctgtggatgatctttttaaaatatatattctgggagacattgagtaaagagaaattatttaccagagaatgaagaaccgaggcccgattctttggctttctgccaaagatgctgaaggcagtgatgaatgacaaatacattaccaaggaattctccctctaagaggctgacaaagatctgatttttaggattatattaccaccaagaagataccccttgtcactgagcttctaatggaaatatggtctatactgaaacaattctcagttctttttctttctatctttttttgagttattttatcttccaaaaatgagttatttctgataaaataattcacttaaataattatgaaagttcaaatttgtgcaaatatttttattgggacatcttaaaattactctaaattcaaaaagaaaatatatgctttattaaaatttgatctgtaagctgctttgtttgtaatttaactattatataaaaattgtataatacatatattttatttactttattcctgtgttgctttggcttggtgagactaggtctccacattaggagttttactgaatgaaaaagtatcagaatgtaacatgactttgatatggcatcagaatttaataagatgacatttaataggaattaggggtaagttccaggttttacacttaaatacaaataatcaattttgcaggcacaaaatacttcaaacaaaatctgaaatcattcatttgacaaaacttcaggtttgcagttgacaataaatacaatacaatgcaacagtgcaatagtgatatctaaatatctaatgtaatcataggtaatattagtaagtgtgttatctgaaatgagtggtgtgatatcctgctttactttgtactggtgagttctgggtgccacctttgaaaggaataaagactattcatatctcttttataagacaataagaaaaacaaacaaacaaacaaacaaaaaaccacctcctttactttagctgagaaagaagttattaggtacagcttgacaagttcagctaagcatccaaatcttccaggaggttgttactacataaaatcaaacctttttaattcaactatgagcagggagattttatttttctttcgggtactaaagcttccaaactctgtttattccacaggaatctgaacttatagaactaagagaaaccattgaaatgctgaaggctcagaattctgctgcccaggcggctattcagggagcactgaatggtccagaccatcctcccaaaggtatatttagaaatcatttcatttccacccaatataatagacatctattttatttattaattacagtagaactgcatttactcagtgtcactgtgcattattaatacatactagttgtattaatagttgtattaatacatactagtagtattaatacatactacgttggtattaatgtgatcagaatcctagaattttagaacagtgacttccattatcagataatttttaaactgatcttaagaaatttggttctatagttgtatacacatctctctacttgattcagtggagatggagatggagtggttggttaatacatgcatatctgacttcaggcaaaacaaacccattaatgagtatgataatctagatctgtatttaaaaatgaaatagtcaatatgatgatatagtaagcagtgggcattgggaacaacttttcctggatggaggctataaaaaggtacatttcctgtagataattttgaaacaataaaaacaacgggtgaaaggtagctctgttttaaattattcctatgcttaagcaattctaaacaatgaaaggggtatttctgccactgcccctacccctgggttcaccactgaagaaatgctcattattaatatcgtgtcatttttttcctttacattggttctatttactcatttcctgacacttttcaatggccttcagtgagctcagctctttcccagcttaaaaaatcctgtcctaaaacatgaatgccttattatctctcttttcatttccagaagaattctgagaaaaattttatgaagtctttcaatgtcttcagccatctttagaccactggagtgtagctccttttccctccactccaccaaaacaatgctctccaggatcagcagaaacttacatgacactaaattcagtaaaacgtttataattcttattgtattagacagacatggaaacagcatttgatgctgatattcatttcttcctatgtgaaacatccggtttttctaatgttcgtgacatcatacattcttggtttttcttctgttcctttgaaatattttttcaatatttcttttgtaaattcactcttttgtatccatttgttaattgttgatatcctaagctctcttccattatgattctatgcatcctatttaaaatatatagaaaatcatctcatactctagctgtaatttttattaatgtgctaatagctaataactgtcaaatctaggtctccaggccaggctctgtatatccagctaccaagagagaactccacgtggatatctttggatgtctgttttgcatcttaaacctaacttctccaaatttgcacttgtcttctgtctcagacctgctgctccttcagtgctctttgcctcagtagatagcaccaccatccttccatttagccagaaatctaagtattcttcataactcctcctctcctcattgaataaattaccaagatccgttgatcccattccttaaatatctcttggatctgttaacttttctctgattttactcttgccatccatcacctctctcctgaaccatgaccacaaacccctaaatagccttcctcttcttaatcttatcctgctttacaccagtcttcacgctgaagccagaatagtcattaagaaacacatctacaggtatcccattcattgcctttagaatggaatacagactcctcagcatgacataatctctcttcaccagcttcatttattcaacaaatatttattcataaccaattaagtgccagatgatgcacatatagacttcttgttctgttgttgcattgcatattccatatttcagctatcctgaattgttttcaattattcataagttctttatgaattgtgttcattccatttggaatattctaccttgtttgatcagcataaagacttttcgagacactgcagcagcagtgaacctaaatatgtttccttgacccctacattgaatgacaccccctgtgatatgtttctggaagcagcaatacttcccttcttaaaattacattatactttggggcttttatttaaggtatgtctttcctgatttacaatagtagagcttgttttttcacccttttgaaagacatcaagatgcccatgatgatgtcttgcatgtaacaggggtttatttgaatttttaaaagaagaataaagtaatttttaaatgaatttcaatttaaattttaggaaaacaattatataaagtgagatatgcttaaattgaaggacaaagtagttctgtaggggctacttctttcaagactttagcaactttccatgtgggggagtgatttatgtgatgcatggaaaattactgcatatttaaagcttatcttagagctataataaagcagcttatgttctaaatcttcatgtcgtaaataggtccagaagggatttaaaaagccttaatccttactttaacacagcacaagtcactgaagtgaaacttgctgaaaggattccttttatgttaggcaacaggtagctgaatatatctacagaaattgaaaaattggaattcttttgctcagaaatgtgggaggggtggagcttaaggtaaaaaataacagttaatatctaaattgatcaagaaatatgaaaaaataatttgctaggttttaaaactaacaaaaaccatggttataaaggtttgaatatatataggatagttagattgtatttctgtaatattaaaactcagcattaaatttaatgaacacaaagtgattcttatcacattgaccattgacattacatggaaaaaatagtcagttggactaattatgtgtctttccatgggttattaaggtaattgtatggcatataaatttatactggaaatcacattgaaattcacttttagaggcccttaaaatatttctgtaatatatatttttaacatatgatcttaaaagatatatttggaatgacacaacagttttatagacaggcctgactatcacacaaccacacaccaatttgtgaatgtgtttctatttcctctaaattaatgcatcacattcattaacaaagtttgataaatgactatagtctataataaaatatttttgtttacaaacatatttaaacacctgctattaagtataggcattatcagatcttaaaatacaaagatttaaaaaattaccctgtggtcatggagctcacaatccactgcaaaaataatgtttgtgataagaaatttgaaagttgaaggtaatagaaaattttacctttatttttcaaaatgtaccattgctttctaagtcactacttctgtgtaaatatggaattgtttttccttaagatataccaaatatagttggataacgcatgtattaaaattctgtcagcactaagttgttttttagacatagtgataggcaaacatagttatattgaatgaaaaattagaatcaaatttattaaacactgtgtactgattgataccacatgccatatgcttgtatagcaatacaaggtttggaatttataatggtaaacaaaatagatacggtctttgtctccatagaacttttagtctagtgggagagcagaaggtaaaggaatgtatgtgatcattggtgaagctgaacatgtatacccaaacagttataagttccaagatggacaataatgggtgccatagggaaggagggtaccaaggaacctactggaggttacatagggaagattattccaaggtagtaatatttaagtgaatatccaaggaataattgtcaatcactttataagtactgagggaggagtatttcaaaagagctttgaggcggaaaataaattagttcctttatggaactaatgtaaggaaaatactaagcaaacatgtaataagaagaacacggttgatgagttaagaactgacaagattactgaaggattgtaggccatatttagaagttggattttttatctattcttattaaagtgagaagttattgaaaggtcttaagtgggggagtgatgatgaagtttgccttttaaaaaagatttttctagctattgtttatagaatggtttgaagatgaataagtccaatagctatacttgctgtaaagtttatgttggtagcttgaactggggcagtggtgacacagaggatgggagatggaaaatgacgagtgaacaaacacatacctgaaaatttaagtttaaaaatagacctctccattaattcagattgctgatattcattcggttagccattctttactgaactttatgatgccccatatactgaattaaatacttacaagcactaaaaaagaaattgttagggaacagtaaaatgcatttccttcatttcacaatattattaatattatggctttgctaatctttattggtgaatgcagtcataattgaaggtaactgatacttccaaggactacttttgacctaggattactatctttttaaaaatttagtattaaagaagtcaaacacaatttattaattctggatataataaaaattctgaaatactttaatactttgtgcttttctatttgtgaaagttaattattaggaacgagctagcaaatgctacttctttttcaaaaagctaatggccaatcacagcaaaaatttaaagcactaagaaatacctacacatattcttctattgcccatttatatgacttccataatagttgattaaaggataccggattcctttattgttgaattaaaacctcctacatgaaaaccttgatttaggtttagaagttggtaatgttttggcatgcaaaaccagttaatgttctcatcattactttttaaaacaatgttaagagatgaattctagggattataaaaaaaaaaaagctgtatgtgtttcttcctataaaatttttcagcatgattgcctcagtagaaaaattaagggacttattgatatatatgtatatgaaggtgaggatacacatatacacacacacatatatatgtaggtaaatacatatattacatgtctatcaatccatacatactcatttattatacgttttgaaagcaaccagttatagttttgttgccatggatcatttttactattcagtaaatcagtcaattgaagaggcttgattttatggtattagttttttggaaactgtcagctttatagtaaattttgacatcttacaacttccactgagatttttttgcttgactaatctgccttgatgccaataagtatattaacggaaatggactaaaagcaaatgtgacttgaagcacaattttgtaaattttcttagtgtctcagtaatacttaatactagtgcattttaggtaggaaaattttcagtttgttttattttaaataactataaatcttatagttgcttgtataaaagaaacagatacctttaacatgattaaatatcaaatgctattctcttcaaaatatcttaactaaagaagcactgcctgctcttagaagttaagcaaggccataccatatgctgcgtacatggcttttaacacaatggatattagaaacagcctaaggctgagactggctccactatttttcagctatgtgaccatgtgaaagttacatttagtaattaaactcatttcagtagtttgctttaagaataaaattaggtactccgggggcatatcaagcatattgtaaaacctagtttgattattatttgttattggtattactattactattctataataagtcatgggcaggcagtaggggtacattggaagaattgcactgtcttaaatatgtcctctgtttaactcacaaactcagtctacctaggctttctttggaggatctgcctttcattggctgtttgactttggccaagttacttaacttcttttcacttcagtttcctcatctgtgagattatgtgcttacatgacttcaggttttgttttggctctaatatggtatgattctatgaaatggaaagttaatacatttggctctagtaactgtatttgaagcacaaatattaaaaagcacaattaattctcattctgagtttccatttactcttttaaattaatcattcagaataaatcattttggaagagctgcttgatccaggtattcagtagaaatcactagcatagcatttaattttagacaaaactgagaactcattaaactgccagggctatggacttatatgagattctcattaaatcttaatgtagataactcagttaattaaaacaaatatggttgtactttattaaacttctaaagtcaaaactgcattgaaattatctgtacaaagccttgttgacctttattagagaactgcctctcaaaagacctaaaagacttatttgttcagatcgagactcttcatgagccgatgtgatactctccctctattgctagatcttcgcatcagaagacagcattcctctgaaagtgtttctagtatcaacagtgccacaagccattccagtattggcagtggtaatgatgccgactccaagaagaagaaaaagaaaaactgggtaagttaccatccttcatctaattcagaagcttattaatgcataatgtgttaggcctttttctttggggctttagtgatctgcagtagtttacaaagggtcccattcaagctactgagacctcaaatgctgcactcatcaccaaaattggagtggcatgtactgaaaagcatacattttaatgttgggactaaacttgggtttgaatcaccactatatctagaccttttgaggggcctgaattttctaaccaataaaaagacagttaatagcaactatatttatttgtgaatatcatttattcacagatgttatctaatttttctatagtataactatacaaactatgtagtataactatagagttatactaaagaaaaataagataacatctgtgaataaatggcttaaaataggggtttattgtgggcatagagatgaaggaaaagtgaaaaaatgatgatgatggtgatgatgatggtgatagtggtcttggaggaaaaggagaatgggagttaataaagggaaagaataaacaatgaaactctcattccacctttggaatcgacagggcttaccgtgtgaatagtttcaccctaaaagaaatcaaccacattagtgtctgcttgatgtttttaaccaagagaatatagcagaaatatagaaatgcactttaacagaactgtaccttaagtttgctagtgatataatttatgatattgatcaatagctaaatagcccaggggaagatactgttactgcgaaaaatttaaaaacaatggagtcaatgatttcttttaataccaaaaaaaaaatgtagattttgagtaaatacaactcttgatgaaatccagacataattatcagaggattttactggagtgctttctacaaataatgaaagaaatatctttttatcttaaaaaatgtttatacaggtaatattttaaaatactgatcagccttcattcccttgatttgtaattccacactctttcatgtttctgcaaggtgaactctagaggaagtgaggtgaatataaaccgtggacaatttggcatgcatctataaaaaaaccctaccttggcatgaatgctatccattttggcagtaggcttttataccttttaaaacagattaccttgtatgtcttttctttgtgtcttttcattttaatctcaaattttaaagagatgtaaaaccactttctgaatagagctgtaggggataccaattctggttttgagtagtctggggttggaaaatttgaatagaaaaatcacaattaatgaagtgttaggtgaatttgatttcattttgctttttaagtttgtactgtcagcaggacatgacttgattgtagcgctaaagtggccatttaaaacaaattgccttgaagagagaagcattgggaatggagatcccttcaaggtacttagttttaaatgagtgctctgacagccatgcccttgaccttgcactatttaaaagccttccatgtttgcgctgcgctggattaatacaagaataaaatgaacacacaaaacacggtatcattttttttttagagatactgtgctgcaattgttaatactctgcttgtacatactgaccccaggcagtggctaggatggcatctgcaaactaacgccccaaagcaaaagctctccaagtgcaaatagacaagaagggtaatttctgtccttgtttcagctgagaagttctttcaaacaagcctttgggaagaaaaagtccaccaagcctccttcatcacattctgacattgaagagcttactgattcatcccttccggcatcccccaagttaccccataatgctggtgactgtggctcagcatccatgaagccctcacaatctgcttcagcgtaagttgctccttctgcaaaatgcagacatattttttaaaaacaattttagatgaaggccttatttatgttctaaccatatctgtaccaattattttcagatttttctgagaatgatggacagcattagtttctcttttcatatttctctttcactggtttctttcattttcatttttctttttcattttcatatgttagaattcaagtgtttcttgatctcattctccagttttctgaatcatgattctcacttcttttcatgggcatttgtccatgtatctgtctaactgtatgtacatacaggtcaccccttgtctggccaccaaagaaacgacaaaatggccctgtgatctacaagcatagatctcggtaaagtggagtgcgatgcatgaatactgcaaagatccaggttctaacctaagtagtgtttgcttttgctttttctaaaatcactcacatgcatttcaacaataaataccttctctttctgttttttcaactaaaatttggtttcctaaaatcaacctgcaatccagttttctttgattctattagttaatctaacctagcatttttatgatagcccactttttggtagtacagtagccccccgttatccaccaggggtactttccaagacccccagtggatgcctgaaaccatagatagcaccaagccctatgtatattatgttttttttttctatacatgcatacctacatatgataaaatttaatttaaaaattaggcacaataagtgattaacagcaataatagaacaattacaacaatattttctgataatagttatattaatgtggtctctatcttcctcaaaatagtgtttttttttttttttttgaaacaaagtctcactctgtcacccaagctcgagtgcgatgtcaagatctcggttcactgcaacctctgcctcatgggttcaagcgattctcctgtctcaacctcctgagtagctgggtttacaggcgtgcaccaccacacctggctaattttttgtatttttagtaaagatggggtttcaccatgttggccaggctggtctcgaactcctgacctcaagtgattcacccacctcggcctcccaaagtactgggattacaggtgcgagccaccccacctggcccaaaatactgtaatatttttggaccatgtttgactgtaggtaacttaaaccacagaaactaaaattgtggataaactataattgtgggggactactgtacaagaacgaacacatttcgaatatagaaaagtgttctggtgagataattctctgtgttatttactatttaaatctaatttccttgtatgcccatgacaacaactagcatagaactcatatagaacagggccactgtgctttgcctacataattttatcatttatgcagaaaggaagaacatgtcactgtcattttgtggccagtaaactagttgtcaaattttaaatggaaaatatgttagttaatataaaacaatttttttggcaaatttcctgcgaagctgtccacaaaacaataaaaacacaacaaggatacaatgtgtttccttcaaacagccctcagctagcctgctaacaggggctgaaacctttgatttagctgtgatctcctaaatcagctgagcccagtagggaggttatataactcacccattatttaaatgtccaaaagtaatatctctaatttattttctacaatgtttatattggatttttatggtaattaaagacagtattgtggcaaagctttttttttgcacaattttacaaaagaagaaatcaacattttaagaatgtaataactgctcttataaaagaatagtcacatgttgcaaatagaggtttaagtcccttgaaaatgttggaatgaaatgtagtaatctatgacttttctgcctataaatatcaccaataaaagaatttttaggattactttatattcagtaagagtagactatttttaaactttaaaaaatagaaaaaaagattaaaagaaaaagctacttccgttttgaacctgtgaatgcataaccgtttgtaaaactccttctccttttctctaggttttgccagcagcacaccatatctgtacctgctggagaatattgcagtgcagcctttaaaagaggcagtgcttttcttaatcctctggcttccccaggccactgattctgtttgtttccttcttcaggatctgtgaatgcacagaagctgaggcagagataattctgcagctgaagagcgagctcagagaaaaggaattaaaattaacggatattcggctggaggccctcagctctgctcatcatcttgatcagatccgggaagccatgaaccggatgcaggttggtactgaagcactttcaaggaataaaatggagaaacaaaaaaatgctgcttattctgttctcttggttaacacagaataaattccacttggaaacccaccttagaaatgtactctgtttattcagtctttgcaactcatctgttagtactgaattgagaattttgtcaaatccaagtttggaagtgggagtgcaaactggcaagttgtattcaagaaccattcaggatactgtactagtaattggattcaggttgagagctaagcttttagagaagctactacaattcttgcttcttcacttttccatcatttacttttattttggctttttgcctgttcttttgaaatctgattttcacatactttcaccagttttctactgaaatacaaaagtaatgaggaaactatagaaattcaacacaagctttctgaatacagaagtaaaagtgatttagaatgccatctgtaaaagtaaggcttgtgtatttttttgaaaaacatctaaaggctaaattcagaaccagtctgtgctcagactaagttttcattttattattgtataccagtaatcacttggtaccacagatgactgcaataagaaaagctcattgctgagcagattcatctgccactgtatatgttcatctaaagacttttgttgtttttttatgagcttagtgtcccgattggaaggaaaaaaagaaactttttcagatgttagatatgattttggagtaattttaaatcaccttattgacattatttttgttttgctctgtctttcaactgtctacagatttataacaatattacaaatggcattatatgcttataagattttaacatcacctttaaaatgagaagtgttatgaatgatttcatcatatttttcttaattcaaatgagaccaagtcctcatgatttagttaaaaaataatgataagcatgtcgaatggttggattgtctatatttgtgaattcaggaatgtataatgtgtgagagagaaaaaggttaaatttccttcttgggaaggaaatcctatttcatatcttatatttctttatttaacatattaacatgttttatttaacaaacaagctaattaactctgataaaagacttggtgctattttctcaatcaaaccaactcagtttttttcatgttttccatcttcataacagaatgaaattgaaatactgaaagctgaaaatgaccggttgaaggcagaaactggtaacacagctaagcctactcggccaccgtcagaatcctcaagcagcacctcctcttcatcttccaggcagtcattaggactttctctaaacaatttgaacatcacagaggctgttagctcaggtgatttagtgcacatgcttgcctgaatcacagcatacccatgagttaacgggtgggaagcctggaatttggagaactttacgtactcttaaaaatgttacactctaattctcagaaatagtcctagtttgatcttataaatctagtctacttagttataattttaaaagcacattctctgtccaaaagtcagtcttagagatatggtcttcataatatttttaagaaatcacttttccctaggaagtactttctccatgattctgatgatgaagaaatactctcagtgatgataattagtacttatggatataataataaccccaatgacttttattaagtgtgcaaaacccatttataagtgtagcaggctttattttctaaatctgacttgatgaacctgtgtgatgctgctctgagaaaacaataatgctactgtcacccagtctgcagctctattaaatttccaacaaagataaagaacacagtactagtgatggaacaagggtacagttttgatttgattgcaaatagaatcatatgacataatgtcatcttaatatctcatgaaccattcaagcataaagtgtagctgtttctgtggaacagttcattcaagagaatcatttcaaggatagagaatttagtctatataatatttacatgaggatctatggtaattgtgaagcacggccaccagatgacgcttggaaaccaataatatgtatgttcctagccaacgttagattccattatagaatggagatagtacactgcttgccttaaatcatattaaaatacagaaggagaaggagaagggaaatgacatggcatgctgatattgattacatttccaatgaatcacatctcttctaaaaagacagaatgttaaaaattctgctattatggctgctcttcataatataaaataatggccttcatcttatatgtaaaagacaagtgggcactccctgtaatttaagaaaacaacttttgtaaacttctggtggggattagagaaagaaaataaattctgagaataagcatcaagtacaactaatgtcagaagccaagtaaaaagcaagagatttcagaattaaatgaacttatagatcattaggtaaaataagactgtggaagtggatggtaatttgagtttgtaaattacacataaagtattatccacactcaacaaaatattctgcaaaagaaagaacgcaaatgtttaaatgtatagaatctggcagttctgaacaacatcctctatgttggcttgttgctgatggacctgacagagaagtgaagtaagatctacatctcataatgaccagtgcatttctggatcctcaggcttgtctcctaggaaaagacaaaggccagtaccttataggtcagactaatggtagggtttcactgccttttataaaattctgttttattttatgaaaatatgataaggtttgaaggaggcaagtttaatactgaaggtggtttagaaaaaacagacacatataaaaaaaacttagtatctaggaaaaatagaactcataaagataaatataaaatcaaagagtttaaatttacaatttctatgtttattggtcttaacacattgatggccatgattaagaatttaaggcaattttttaggaggagccaagttttacgtttttttaatacctttttttacccattccctaagttatttttaatatatcttatttccttaattatttttcaatagtgatacttatgtctgaactaaaaaaattaaatcacacaaccagaatattgttttcattactttcactcttgtggagtgggttcaacacttggaaatcaaaactgcctttatgctggggctttttaacagacagactttctaagtttcatgattaatcttaagataaagaaagtaggcaggagagaggataattggcaaatatctagttcctgaaatattaattgcatgttccttgcatccagtaaagacagacatttcagaagtcttcagtttttggccagaattttactcaattatagccagaatggcagacctctttaatttttccttcaaaatatagacagaggaccatgacttattttctagtaaaaaacaaaacaaaacaaaaacaaacaaacaaaaatacagaaggctctcacattaatcttgctgtttttcctggagttgtttcatcaggtgaccatcctgtcaatattctctgaactggggagattcggagtcatgatgtgagccacccacagtcaacagaaggagttagaataaacacaaataatggctggaagagcaaaacttagtaaacactgaggatgaagtgctttaaaagtattatcttttatgttctcaataactctaccaggaaggtgctgttaaagccccattttatagctgaggaagccaagacttaggaaagtgactgtaacaatttgttcaagatcatgaaactagtaagcagcagaactaataatcaaaccctggcttggatgaatccaggacctggacttttcactattgtgttaattttgctttaaatagccacataataaaagcaaagaatagttattcactcatctttggtaaatatttatcctactgttgtcaggagaaatttcatattgtaagtgtagtttttagaagtaaatatggcatgaaatgaataacatattccaaggcaaatttaagcagcttatgtggatcaacaatcaggccaacctcctttgctatggactacttggccatgtgtgatttggtccatacttatttccatccacatcatttcatactactcctcaccctccccttgtctctacattcctgctaccctaaacatctctgtgttcctttaacatacccagcttacacatctcagggttttgcactgtttttgttgactgaatctttttcccttgttcttcacttatctagcattcctcagccttctggtcttatctccaaataccacttcttcaaggaagccttccaggatgacctatctatctagagcaggctcccttcagttactttctgtttcattgtttggtttatattagcagagtgcttaaactattctgaaatacatactccaaaaaaacaaggaattcactttctttctcatcttggtattcattcccaatatgcagcaaaatttctgataccatttatacctaataaatattggtcaaatatttttgagcatttatgagtaattaagacaagtactaaagtaatttgatcacaaactaccagaagtctagatgtgaatagccaatggtaaaccactctaaacttcttaaaaaggagcaagataattaaaatgacacttaaggaagagttttatttttgagtggagtaggtgaaaaggtgaaagactattaagatgttaacttgggaaaataattaaactccagtgcaggagattatctttgatgatttaaaaatttattgcaaagctctaaaagttctaaaagttctcaagctctgaaagttgtttttaattgttatgatcttagagtatttttattgcttactttcaaaattacatatacttaattattaagataatagaaaccattctatttttggaggccatcttattagagtgttgatttctatgatgctatagtcgtaatctttttttctataaatttattgtcagagcagttgagtcctcttttcaccaggaacatgtgctctttagaatgtaatggagtttcatttatccacagaacattgtcttaatattaagcatggttctatgatagtattattattaaaggaaagcatatatttggaatagtttgccttaataattctccaaattggaaattaatctggtataatatattttgaaagttaatctttaatcaccatttaaaggctgatattttaaaggtagctaactttatcatgcttctgtaactcttagctgattactagaaatactattttggttttgaaactattagcataaaggattccggagagcaatcataattccagtataatgccacagttgaaattcaataacagtacctaataattataaagataaggtgagtagttatatagctggctgtgtcaaatgcttgaaaataatttcagttgacagtcaatttcagcacctttacatttataaattacatggatattgagcttggatattttagattggatagaaaaatcagatggctgtcagtttgtcatggttataatggtgactaaatattactcaggtattactcagacctatgtgtaatagaaaaagaaaattcttatttcctcatctaaagtcagtgagtggcccaacacttgagtgaagatctttgcaagcagaaataaattcttagattgaaactttagcccaaccacagtaattcatcttctggaaagctgaggcttttcaaatcagttaggctagaatgggaagcaaatcccattgaaagatataaaactatgagggagaaaagaatgacagtaaacaaatctgagctaatgttatactgttgtgtatgtctttcttttaaaatttgatagatattttgctagatgatgctggtgatgcaactggacataaagatggccgcagtgtgaaaattatagtctccataagcaagggctatggtcgagcaaaggtacttctttaatcttaaactctttattactaacaatgagaattaccatgagtcaagtgtattttatgtgtgaatatttgatctggtaaatatcctacaacaattgtggattggcattagcttaacatgtcatacaaacatgaaaaggacaataaaatgatgacatcatcatagaggtagaaatgtgtcttacatgtacctcacattcattcactgaaaataatattaacagcccctcatttctaaaactttaaaaaatagttatttctttggcaaacatcttgtctgacatattcttttggtttcacttatttgttataggtaatgtttatgatgtgcagtcgctagagctgtcaatatggtctttatacaaagggaagactctaaactaaatgaatattttagaaatcagaaagacacatgttctactgaacttggtaggacaaattccattgatgttacttgtctatttaagcaaggtcctagatgaccagacaagtattttaatttttttgcaatgaaatattgccttcaaattggcaatgccattctgactctatccctttcttaaaacaacaacaaaaacaaattttaagttaaaattttagttgagtggccaaaaatacaaatttctaagtatccaatttttttacatcaagcaaataaaaattctttagaattttaaaataaagtacttaagtttgaaaagtaagatagcacttgtgaattcttaccttaagccaatgttccaaggattccaataccatcaactttctgcttgagctgcagatgtgtacctacttttcccaagtgggtctttatgtgagagacagtaatactcttagtgaaacataaactaactttgatttaaaagcagctttttataaggtattgcataagcagtaattttaactgggttataaacacactgaaaaataagatttcctgttcacagtaattctaacagacaatgcctttgaacacttttttctaaaaaagcttccatgaaagtacttgtcttattctacttggacttccataataaaataacagactaggtggcctaaacaacagaaatttattttctcacagttctggaggctagccagtctaagatcaaggtgctagctgatttggttcctggtgagggctctctttttgcattgcaggtggtggaattcatgctgtgtcttcacacagtcttacctcagtgtctgtaggtaggaagagagaaagactacaaatcctgaattatctactttacccagtaatcccatcatgaaagtcccaccattatgatttcatttaatcctaattacctcccaaagacctcatctcctaataccatcaatttggaagttagggcttcgatgtatgaattttgaggagacacaaatatcatttcataacaatagtaacaaaaatcacaattgtcagctgtggatttctcaacttattctgcaaaaggtattagattctaactcagattatacctgaataattttgataaccatttatccttatggtgctaaatattacatattaagagattgagggtctgagccagctaagtgatttacctaaggtcacatttcttaattaggtggtaggtattatgtgttatagaatccatatcttctaactcatgactcagtgattattctaccacccgttaatgataacatacttggtgactagaaccaggattataatatgtcaactatctaattatatctactggaatcataatcactatttcgttaaccatttctggtcatcataatagaggctctagctagactacaaattttgaattatttacctttctaatatatgtagaaatttctcaaaatcccatcctacaaaaaagatagatttggaaccattatgtttattataaaataattacttgtttgatgaaacgaatcctgtaggtttctctggcaaggtcttttaaatagagaatttctgataaattcaaaatggaacctgttttgtaggtatgcaaataccttatattatcatagataacacattttaaagcgagattggattctagattaaaattaataaaacaactgagttttggacttatcaaaggtaagatcacaaaatagtaagataaagttctagaattcatataatatggttctgttctgtctctctcaccatttccctcctaccaagctgcttctctttaagaaagtatgcactgcattataatgcaagagtattctttcagattccttcacctttgccttctacagaacaggtcatggatcagttttcctcgacatgctgctttatctcatctctttctttcttgttgctgttgctattgctgttactttatttgtttggttggttagttggctgaaatatgttttatgttatataatccaccatgtgtgtctgttactatagaagccacaggtttaacaaatagtttagtcttaacaacaactacattaactaattttagtagaaaatgtagtaataaaaaagatacacggttggattttatcttactttattttgttcttatttaggaccaaaaatctcaggcatatttgataggatccattggtgttagtggaaaaaccaagtgggatgtcttagatggtgtaataagacgtctctttaaggtatgttgtgcaagacaccctaatagtacttttcaaatatgtttctctttaattgttttccataacttcaatagcagagacacatcttcttttcctctcctcaaataaggaaagctttctgtttgtgctatttgatattaacagttcttatattacccatttctaatattcttgacaactagctctatatccctgtgagttatgtatttgttgtagatgagttgaacctctgttttgattttattttttgtgtgtaccattgtaggaatatgtattccgaattgatacatccactagccttggtctgagctctgactgcattgctagctactgtataggagacttaattagatcccataacctagaagtgcctgaattgctgccttgtggataccttgttggagataataacatcatcactgtgaacctcaaaggtaaaagcaataatgaaaagcaaggcagaaatataatttttagcaacattttattctgccccccgcccctttttggccagtttcccttaaaatttttctatttgaaaactctgtagtattttaaaaatcaatatgactcatttcataccaaaactattaaatactacaatcctactaaaaacactagaatataaagaaatttagttctttgggttctgggatttgaagattcaagactcacaaaaaggaatgtgatttaggaatttcaaatttctggattttcttcattatcatccttcattacaggaggattcaaaacatttagtgtgtattccaaagttacatattcattgatatatctttgattttaaaatgtgtatgcctaataaataccccccaggaagagggaatagaagttaagaatcaaggatggaaagttctgagaattttctttgctttagatgatgtgattaattataggctaatgtaatatctgaagcatctttgtcttcacaattccttgtttatttatgttaaagaatcaggatacatctatataaactgtgagttaatagaggaatttgtcaatatttgattttatgatgaaggtaattgagttcgtaaaatgagatactgttgctcctttcttaattccttgccaaacgtaacaatttgtattcttcaaaagcttgagtggttgtacaactaggatgcataatgagagatagaagagaataaggagatggggtgaagagaaagtaaaagaaagaacacacacacacccatatatatatatatgggtgtgtgtgtatataatcttcacatttattcttcacatttattcttatagtcttcacatttattcttaacaaagataatcatcttcaataaaagatgttatgatagcatttataatgcttccatttctctctggaaacataaatgaaaacaagaagtagacagtggagtgaagcctgaagaaaaagaaacagcttgcttttgtttagatgttcactctgccatattactgatatattttcttccttgaaatggcaacgcatatttgtgggatagaaatatctaggaaattatttttcaaggactctattcctatgactaacaatgctgttgctgtttagcatgatattttaaattctagcttatgtagaacaataaatcatgctatttttttgtttcttctttcaggggtagaagaaaatagtttggacagttttgtttttgatacgctgattcctaaaccaattacccaaaggtactttaacttgttgatggagcatcacagaattatactctcaggaccgagtggtactggaaagacctatttggcaaacaaacttgctgaatatgtaataaccaaatctggaaggaaaaaaacagaggatgcaattgccacttttaatgtggaccacaagtcaagtaaggtatgttacagaattctaagagaacagctacaatttatccataagtgttttaagcaatcaaattataagattttgtgagacttccatgttgtacatggaaaagaatatccatcttttttttactagaattgtaacctggtgagtgatcaaactctgtttcatgaatttgaacaagactactattttcagtaacattcagttatcaggtactccctaagatattgggaatatacagaataatatgacaggtctcctatggcatggtttctcttagacatccacctagaaactgttacagtagaaagaggtccgtgcacaagcaacaaggaagaataacttttcttggaggcatcagagctttataaaggggtaatagtttgttggatcttaatagataagtaggaaataacatgggttttgcaggaatggagatttggcaataattagaatattccaagcagatattctgggagcagcaatttgcttatgtcacatctccctaaaatttttgtttaggaaccttaggaaagttaacaacattcaatttcaccaccatctacggtctaatgtgccatagtaatcagcctgaacactcagatattaaaaaggcatgagggcctatacggcgtagcctgtactttcttattttctgagtaaaacaaaaaatcctaaaaaggaaatagttgatggctaacatatttttaacactaacctagttttacctgtaattatttattaaagtctgaatcaatgaaacctaaaagtttctgtcgggaaaatgcaactattataagcaataccttgagggaatcccaattatactgggtcatattactctttcaaggataacctggttcaatgatctaaactgtcccagtttctcagaaacctgaaatctgcaaattttcagaaataaatgtgactcccaagagcagcccaaacccattagattcttgaaataagccaggcatatagcttaatgaacaaaaagtattaattttctcacctgtaaaatgagggaaatagtagggctattctaaagactaaataaatgagtgtgtatatgcatgtgtgtgtctgtgtgtgtgtgagagagacagagagaacagcgcaagtagcaagcacgatataagagttgcttgcaatttttaattatagcccttggctcccagtgaagatttctctcacaagcatacacacacatatgcacagtgcacgcgcacatacacatacaaccacacacacacacatctttgttcaaaaccgttttatatgtgtccttcaaaaacaacgatgtacataaagcacaatgggatctcttaaagttaaataaatgcaatacataaattctgaatatttccttggaactcagacctattcaaatgtggttgaaccaccatctaaagaaagacatagaacctgaggtagagtatttggctcttctctgagcaaaagtaggaagagcacaattgtctgtttgcttcagctgacatgtttaatgcttcctgtgaattctgtctcctcatatctttatataaaagccttttagcacagttttaaatattttcagccaaaaaatatgaaaggtttgaaaggcctcttagtcatcctcaatgtttgttttttcctcaatgttggtatgacaaaactctttacaaggtactttttttatggaataaaaaagtgtttagaaaataagagcaaaatagatttattggaggagaccatgacattttgataaagttgaggatcacttaaaatcgttttgaattaaatagatgaagtttcattagaatgtagttaacatgctaaaacaaaataggtaattcccattaattttaaaacatagctttccctaaaaaatatctatctgtctatctatccatctatctatatatgtatgtatatatttcagcttaggaaaaaaagtttattgcttagagatgttctgttaagaacatgttagtgtcctattaacttttttatgaaatatttccgacactcttattttttgctttttcagagtacaggctatttgtgccattattaggccagttcagtacttcattgcaaaataatgggcaggggaaaagcattgccaagcattggcagagctaatgatgctaggaaacagtcataggaagaaactgtttttatttttttattttttattattttattttatttttatttattttttttttgagacagagtcttgctctgttgcccaagctggagtacagtggcacgatctcggctcactgcaacctctgcctcctgggttcaagcgattcttctgcctcagcctcctgagtagctgagactacaggtgcccaccaccacacccagctaatttttttaatttttatttttagtagagacggggtttcactgtgttagcaggatggtctcaatcccctgacctcgtgatccacctgcctcggcctcccaaaatgctgggattacaggcatgagccactgtgcccagcccagaaagaaactcttgaacaaatcacaatagcattcattcccaagaaaacacaaattataactaaaaaatatttattttttatgttattccttatggtttgaagatatgaacaagctatcagtaatgctgaatacaaactcgttgccagaaaatttggacaatttttgccaaattgacagagaatacccactattttcctgggagttgggggtgagggtaagtgaggataaatataaaaaaagaggggatgacaagttgagattgtgttagggataccaacagtgtagatttactgaagtaacatgataatgaggcatgaaataataaatcctgttcctgaaaacctggagctgtgtaaatgctgacgcattttatgctgtgccatagatagcactgaagagacaaatccaaaaagcacttactgattcagaaaaaaagaagaaactcaaaccacaaatcatcaaatgaaaaacatcttttcatgttttcagtacctctgcactttacattctgttcctcttcccacacttcaagccctccctcaagctgccagctggaatattttgattgagagcagtacacataaacaattacactttgtgacattcgatatagtaggcccagagggctagaggtggatttagtagagaatacatggtcagctgaagccatttggaatgttaggctggaaaagatcagaaaactgtacctgatagattcctttttagtgtgtctggagtcagcatctgagaaagcagtgatctaccatttttatgtaactgtggtgttccacctgtagtttcagagtatgggattcatctcattgccaactcccatctggtagatatgcctgtttccttctacctgactagatctggaaaaaagacttttaatgccggtgcatcagtgcctcaatctaagatttcattttcatcaagctagagtgggtatcatgaagttatttcaagggaatctgtgaaaaactcctctaagttataggaaaaaagtttatttatgtttgcctgtttctacatccattgctttatacctaccatcagattcccaggggatccactaccctctcaagatgaaagaaagccacattataattagaacctaaaggctctgattgtccaaaaatgacccagtgacctgctaattacaaaactcaattcctttgtgcctccccactctctctctctctttctgacattcatgttatcattttctccttgtttcctgctccctggtaaattgcttttcagtttttttctctctgctcttccttcacttcccagtaaatgaaactgtttttctttataatgaactattctgttctctctcacttttattctcctttggatgactcttgtggcttcaacttggcttgacttgtgtggttgacttcaattaaacactatcagccatgcccattctcccaaatttgtaagctttctatcatcctacacatatgtttctattcacctactaaatatacctgttgagaattgacaatttcagccccaaacacatattataagtttatcctcttccattgctttccaacaaaaccaccctccaccccagattaacatcctcctctgttgtttcttggatttctacaattattttttaactacttgatacacgatttcctttaaatttcccttctctctttttttgggatatattcattcacctcatggaacatagaatatcttttcataattaaaatctgatcaaatttttcaatgttttcttatagatttctgtactacatcaaaaacatcacgttgttccttgttcagtcccttagtatctctaggcttcaataatttcaacattctcttggctggtcttgcttcttcctttcaatatgctcaccacatgttaaatcaccattgtgactacttactcaggtcaccagaagaatgtttcttcactgccaaaaggagatgtccagcgatcttactaatcatttaaggttgcagtttcctttacaatttcattaccaccatttcctttcacaaaacacatattcttagcttttttcctacatggatatcatattttcgtgtttctgactggttattcttctctatttggaaagctcttctgttgtgtttaagcatcaaggtattacccaatctttaaaataagggaataatagcaaatcatactgccaccacagtacattttccagacgctacaatcaatctttacatactataaacaaaatctttgatctatacttttttgaagtagtgtattattttgactgtgaattattgttatatatgtatatgcctgaccttctattccaggaaggtaataagcttcttaaatgctatttccttttctaattaattcttctatctttcacatttctgtttccttggataaataaattgctttcctctactgaaaacaaagaagcaaacaaacatatcaatgttccacacttctttatataataaaatgcaacttcttctgcatggattcaaagtctttttttcttttttattgccaccaccagtagcatgtactatatttttctataaccacagaacacttatttcccaaaacacatcatacacttacacttttcaggtttcactttttattctttagatttcaatcctttttattattattattattatttgcttttttttcccttttaaccactgtactctgtttttctgtgaaccttaagtctggattagatgcctctcttatgtctccctataatgttttgtgcatttcacttagcacactgtattgtgaatcacttgctcaccagcttctctgcttatcaactctaagtttctgaaagacagaaattatgttttatctctaaatccctggtgccagcaggatgtgccagttggaattaatctctttccctcctataggccacatgcctcctttatcctctctcatggaatgttttaccttgcattttgtaaattcatcattatttacatgtgtgcctaccaccccactcaggctccagtgttacctcctccagaaaaccattcttgacacccagcagctaggctaaatctcttcccttgacttctcatatctcataatatatttatgatattatattgatatcatttgtaacatttaaattccagtccctaatgtgacaactcttagagcttgcaggggaaaccagcctgattaccctttttagtcctcatgtccggaaaagtacttgatgcagttcataataaatgttaaacctacttaaactccattgatagcaggaatcagacttcactatttttgtatacccagggcttggtctaaggctatgaacgcagtagatagacagtgcatattttataaacgaatgaatgacttaatgtagctaaattagtgacataaattttattttttcttttgaagtaaatagaattctccagaatattcaacagttttaaacatatttttttctgcattctctgacttaggcaagatttattttatgtgattagctcaatagaaaacaaatagtactttatttccttaatacatttttatatttgaacataaataaaaattactaaatgcctcaaaatcctggcccgttgttttatctcctacttttatttccagcagtggtgttacagacagagagaggttgcatctagagtgagcaattcacatatttacctggctgccagaaaccaaaatcatggaattgttttataaccctgagcacgatttgcaaattgaaaatgtcattgtaaatatgcaaatattatggaaatgttcttactgattaggataattttaagaaacctaattatgttcctggcctacccatctgtgagagcagtcaatcagcaaactggttatcatatttagattaaaagctattagacaggaataatacctgtaaaagaaccaataaactcaggagatgctaaattttgtctttgtttaaaattacagcaattgcatgcagattataaataaataataagcatacttttatcaaggtcctatggctgtacttttagatataccccatctacctgaattagaattaacacattaaaaatattagtggaacctgagaaatgccattttgaatttagttcatacttgaaatattaaggttgctaaaatttacttttatcattgaataccaaaactcagaataaaatctcaatatatgtggtttatcataagagttcatatccagaactcattttggcttttctttcagggagaaaaccacttagaaatatgccgtcatgtttatacttttatatttgctgcaggtgtttggtactggatcttctattgctttcctttttcttgctttcatttaaaaaaattattctgtcagcaatatatggtttttgatttgtaggaaaagattttacatcagttgaataatctatgactttaatgaaagaaacggaatagaggacaaagagtgctattcctaaaatattaactgcttcctattagtataaatttatcactgacgtatctgttttcttcattttttaaaaggaattgcaacaatatctagctaacctggctgaacagtgcagtgctgataataatggagtggagctcccagttgtaataattcttgataatcttcatcatgtgggctctctgagtgatatcttcaatggttttctcaattgtaaatacaacaaatggtatgcttatcaaatattctgaataatgaaatatgaaataattatcatcaaatttgccttcttgtacctgtatgcatttttaaaatttgtttaatatttaatttttattttttaaattgacagataaaactgtacatattgattgtgtacaccatgatgttttgaagtaaatgtacactgtagaatgattaactccagctaattaacatgtgaactacctcagtagttattatttttagacttacaatggctgtcattaatttgagaaaccctctttaatattataccacagttttaaagactccatatgcattccttagaatatctatgtattcattcaacaaccatatcccaggcactcttatggaaacattacttccttgatgatgttagcttctgcagacatgatgaacatttgcgaaaccaacaacaacgttggaatagttttaatcaggaaaattaaaaactaactggagcctttagagctctggtttcattctcagttcatattaaagtttaaattcaacctttctatagagataaacttaatatattcagatatagctccctctattaatgagtatgatttttaactatttacaataaaaggaaaggttaaagtaaggtattaaaaaatcttaaaacccactaaagattcattgtggcatggcctctaaagaaaggacatataagaatatcaacataaaataaatagttttaatagtgtcaaatattccaattatctctgctagagatttttggaagttacaaacgatcagcataaaataaggaatgaaagaatacaaattttctcacaatattaatattctttaacataactatgaaatattaaaatagtaaaagttaataaattttatcataagcattataagatgttagagtgggacaaaacccctatgattatactaactaaactctttactcaaatactgtaaattacaaataaactcaggctcggagagagaaaatgccttgccttgattccagaactggaattagaaactcaagtatcaatttctagtccagtgatctttgtcattttccattacagaattaccctttaaaagacaaatattgaaatggaataatccatatctatcctagtagttttccaagataattttaatgaattaatcacttttacctccagtaaattaaaattttctatttatttttttctagtccatatattattggaacaatgaatcagggagtttcttcatcaccaaatctagagctgcatcacaatttcaggtaaagttaagttgaaggtttttttgttttgtttttttgttttgtgttggggggggcaggggagggggttggcattgtttcttcctgtttgtttttgtggtttgtttttccatttgtactttgacaaatcttgccagagatgacctgtggtgtgaaaataattctcacttctgacactctttctcaagccaacgttttgtgatcttcaacctgtaatcagatgtgtttctttaaacaaaaacaaaaaaaaaaaaaaaggaaagaaaaaagaaaagtaaagtagatgttttttctgttcactatgtccctggttaaagtagagcatattccttctaagtgtgagaaatgtgaagagagttgctatttcaggatttgtgattctcctacagaagagtgatcagcatttagactcccactcacttctgacgcacatgagcttctttttagctcaaaaagtagagttagctacattatagctctcatcctagtagacctcctaacacctttgatcatgaaaaggtggccaccaattgaaatgggaacattattactttctattggaaagtaataatgaataaataaataataatgataaagaatcactgtgaatgtaaaatttaatttatataaaaatgtctgattttttttctttttgtaggtgggtattatgtgcaaatcatacagaaccagtgaaaggctttttaggcagatatcttcgaagaaaactcatagagatagaaattgaaaggaacattcgcaataatgacctagtcaaaattatagattggattccgaagacgtggcatcatctcaacagttttttggaaacacacagttcttctgacgttaccattggtgagttccaaaattataatatgccattttccaggaactaacagtgcttggtaaagacggccagattggatggtagaaaataacaagcaaagctaatgcttattcaagcttccaaagatttatttttttcccttctgaaagtttgcgttcttcttctttgtatctccaattaaatccattttgtcttgacagttatgttttactaaaatattaccgagatcagataagttcaatatgggcaaatatctaaaaatcagataaccactggaaatgaatagtatcgatttaggatactttttatgctaaaaacaaatttggctaaatagctcatgtcaaataaagttgtgaggaaagatgttagttacagataacttaaacgctttgtagataatttaagtgttttgtgtttttcatgaagacaaaactgttttgagttatttctcttttagtttgcataaagatatttacatttttattccttctttaattgcatgtacagaagtctctttcacattgttatgcatcataaaaatgtactcactgtcaacacagtttagattaggaagaagaattctacactgggaccagaacactcatgccaggtcccaattctgcaaataatgacgtgttttatatttggcaattcatttcagcacagctttattgcttgtaaaatgaaacaggataactgcattatgacttttatcatttctcctgactctagtatattgtgccctagattaatatttattgtaaaaagatagaataggctaggatattgggtcttcagtaaacatgctttaataataatcaagctggccaataatacaattttctaggaattttgcaagaaatatattatattccaaaatggtgtctagatatgtgtttagattattaaatataactcttaaaatattttgttatttatttcttatcaggtccccgactattccttccttgccccatggatgtagaaggttctagagtatggttcatggatctctggaactattctttagtaccttatattctggaggcagtgagagagggtcttcaggtatagtactcaattttcattgctatttttttttaaaaaaaaaaagcaaaaaaaattactttaaaagcaaaaaaaaatatctgggtatttatgcagaaaactaaaggcatgaactatatgaatagagcaataaggttttcaagagcaaatagtttgtaatattttgcctgttctgagaacaaatttgtaagagaaagaaaaggcacagttatttcaacaactatacatttaagtccaaatggttgtcatggatgtttacaggttgtttttattagacagctagttaattgcacagttctacatcttatgacacagccatgtttacatgagccttgaccatttatattcttatcacataatttcctttatctttttcttcttttctttctccttccttcctcactccctccctccctccctctccccctccccactctctctctttctctctctctctttctttctttgtttcttctccttcttttttttttttttttttgagacagggtctcactctgtcactcaggctagtgcgcagtggtagaaccatggctcactgcagcctcgaacttttgggctccagtgatgaggctttccaagtaggtgggagtataggcacacaccaccacactcagttatttgtattgttattattattattttagagacatggtctcgctaggttgctcaggctggaattgctttttcctttttttcacataatttttgacaagtagcttttgcttgtaagtttcctgtttttagtatacttcattgttggaagccctttaatgtcacttgcaggatcctttactattttggagagagtactctaaattctaagagagtcagttggtcttttgatctatgacagattggtttcacagcatctttgctcttcctttcatgtgccttctatcttgaggccctgcaaccaaggcccttctattttttcctaactaaaagatgaaaatgtatcactaaaaaaaatccctacttctccaacaaaatacatgtcatttttccataagtattgctatttccttaagtttgatttgaaattgtagaattataaaactctttaaaatctgtgtaacataatcacccaatttattgaggaaggatctcatctccttttcagtaactcagccaagacatctctatttctggtttttacaactactattagaattaagatatagtttatgttttccacattcagtcatctacaatagtgtgttgtctttattttgctatctaaaaaaattgtccatctatttttccctcttttactcccttttactgtcaggctctctttatctattgaatggcatggcagtatttggaactaaaatgatagttctggtgaacatgatgaattttatgaggatactctgaagcctcagagataaagctaagatcctaaataatgctattgattggttctactctagatttaaataaccaaatttaacacttttaaaggtatgagccaatctaccccaagcagaagcctccaataaaataaaagcttatacagatgtttttatttttcaagtataacatattgtgtttcagaattcttagaaaactactataggatatacattggatctttcaatgttgattatttgtaccaaaaaaaatcattttatgaaaattttagaactcataattttgaagttaatatttcgatacattatttgttctctagctatggttttggttttaataaaccattatctaagtatttataaataaaattctcctcatttaatatttgtttactaatagaaagcaaaggaatctttgtaaaaaccttgaaatgataatagttaaaatgcttagcatccttaggtcttatttcaaaaggtacatgggttcttttttcatatttaaattaatattatttatagaacattatttggagaattataattctatgaagtttccatttgggcaaaagtataatcacttaaggattagtttctcaaactaaaactgagagatatttcaaaattatttttgaagagggataaaaatgtctcatttcttgctatggttcaggatgtttagaagtaggttagtgtgaaagatgaatcaaccgtgatttagggctttttgggggaggggaatccagcacatgggaagggaaaaattggaaagtccttttgtgggtagacagttttcattgctattgaagactatgctgggccagaaaagtctatcagctgaaaatatttctaggggagcaagaagcaaaggaattatatctgtcgtgatccattcccatggatttactggcaacaaagaatcttggattggagaaagaagtggagaaacaaagcctggtagcaaaaatgacactcttaagtttagagtaataaaataatatcttcagatgaaggcggatttttttggtgaaaaaccttatggggaatgcactctgccagatgttttagttggaaaaaatgttggtgatacaatggattttgatttttttctggtggattctttcttaactagtcagctatcaattcatctcattctgaatatttagagttctctttgttcaattattttttctacaatatgtgtttcactcggaaatatagtgtttggcccatttagcttttcactggtctcttccaattttgctgtcctggatggttctttaaaaacctagaattaattgattctagacttacattaaaacaaacaaacataattaagctttccaagaattatacatgtttttcttcaattggtttaagttgtgtagcatgctatatgttacatctataaagtaagtttgtaactgagaggaaacttttgctctaaaacaagataactatttttaaaaaaagtataatgattgtacctctgttaccatctcctaaggaaatgcacagatatcagtacctagactcccttttattttaggtaagtccaacttctccagaagaaactcaaaagaaaactccaaggcagtccatgaagtttttatggtgttaatgtccaccattttcccttttgtctttactgaaccaaaacaaactatacaaaacagccatctaacaacaaaccaaagtatgtcatctgagaccaaataggcacctactaaccaggattgtccttggtaaagcaagtcaaatggggagggaaagtaatttaaggaaaaagtgtccctatgttactgcccccttctcttaattttcactttttttctgtgcccttgtaatattatacttttttttttttttcacaatgtctcattcttctcttcaggctgccctttctagtttgggttcagctttgcttgcagcttaaaaatgtttaacatctcttggatttatctgattcttccattccactgccagtactttaaccaggctatatcagctcttacttattgggcaaattgcacaataagggttcttgcaaagttgataattcagtttcctattttttatcctcttttactagtggcctgaaacacaaacatctaaaaagagtttttccaaacaccgcatgttctcactcataggtgggaattgaacaatgagaacacatggacacaggaaggggaacatcacactccggggactgttgtggggtggggcggaggggggagggatagcattaggagatacacctaatgcaaaatgacgagttaatgggtgcagcacaccaacatggcacatgtatacatatgtaacaatcctgcacgttgtgcacatgtaccctaaaacttaaggtataataataaaataagataaaaaagagtttttacagaaagcaatgggattaaagagcaagttgatcacaggaaaattgttatcagagaaagttttcctactctaaaagacagtttgagtagagtgaattaggcagagaaaaataagttacttttattttatttccatctttccaaggtacactttagtagagaactctacttaatatcaagcatattttttaaaatcttccataattgaagcttttatttttcaacctttagttttctcttggtttgtcaaattactagtaaatgtgggcagtcatttctatgtttatttataataaacctcccgtatattctcccccaaaagttgacatctattccaaatattcagcttcattttgtctagccttcaagtttaaagtgagctatgtagacagatacatgttttaaatctgcaaaactgtatacagatacttaattctcttgaaagtcccttaagaactcaatatgtcaaaaaatcacatccaactagcagtccccttttttgctgaatagaaatgcattttatatatatcctaaacgcgtggtcaacttttagatgtatgggaaacgcacaccatgggaagatccttcaaagtgggtgcttgacacatatccatggagctcagcaactctgcctcaggagagcccagccttacttcagctgcgaccagaagatgttgggtatgaaagctgcacatccactaaggaagccacaacctcaaagcacattccgcaaactgacacagaaggagatcccctggtaagaatcagatgttcatttcttcctatgtaatcttgactacagtgtatagtcattaatatttagttatttctagcgaagacatttgttatcctaagcaacatttggaacagttttaaccctattatctttggcctgctttccatggatgaaaatcttaaagtgaaaaccaaacttgtatgcttaaaaagaaatcaagaaatgctacaaccagaatgaactcctagactataatgtttctcttattatgcattaaattgtgtatataattaaataaatataattttctatattatgactcaattcaataggcatttaagagaaaactcaatttttttcttaaatagaaaaacaaaagttatggtataatgtactcatggagaactaaaaaatattttgcctatatcaactaacctgactaattttatagaatgggtcttctcttgcctactgtagcaaaggataaactgacttggaagtcaaatggaagttatggtttatttactttctaaaatagtggaataattgaaataaaagtctgtaaaactccaaagtatgaatattctgaaaattttaagtatgtagtattattaggaaaaaaaacactttttatatatctatttttatttttacagattactttcaatatattggtatcaaatgtgaagtgttactaactcaccattctatgagtatagagcttattggacttttacaaccagtacagaaagaaaagatactgaaataaaaattcattatgttgcttaaatcaaactaagacaaaacataaataattaaaaatcataacctatggctatacctaaggatataaaattacttgatattttaaggaatacccttacaccaacaaccctgacacacacatcatcatcatcatcatctcagctgaacattttgggagtttcttgtggaaaacctgataaactttcaagatcctttacccagcaaaatgcatacacactgaaaatttggcatacaattttaagagtttcataaaatcactgaagtatatatatagacctacttagattccagggatttcctgctgatttctgatctaggcgatatcttccttaagagcccagacttatatttttataacatggtacctggccttttagatgattcatagttaggaatcaacagtgctgatgaaattggtttggattcagcataattgtgagcatatactaaataattgctgatagaatgattaacagagtaaatataagctttagaatatgagtatggattatttaatctgaattcctcaaaaattccagtcctacctctgcagtttttatataatatgtctgttttataaggagaggtgtttataagatttgttctcagttttagtctgtagagtatgaaacccttaggaaatgcccacaactttcccaattctcatagtccagctcagctcaccccataaagcactttttttcctggttctgaatgcacttgtcttctagtagaggaaacaaattcaaggttttcccttctggcatgagaattggggtaaaaaaatttcctggttcctaacctgctgctctattaaacatcttaagaaacagggagttatgaggtcttacatgctaaatggtaaaagacgtcatctaaaactaaatatttggcaggctttctctggttttaaaaaaataaatatttctatcttttttctttctttcttactttttttttttttttttttttgagacagagtttcattctcgttgcctaggctgtagggcaatggcacgatcttggctcaccacaacctccgccccccgagttcaagcaattctcctgcctcagcctccagagtagctgggattacagtcatgcaccaccatgcctggctaattttgtatttttaatagagacggggtttctctatgttgatcagactggtgacgatctatctgtttttatttctatgtatttttgtaattactagcatgaagccaacatatattttcagtccattctaaatcagaaatcctacaaaatatccactatttagtgtcaagaaacatccactatttagtgtcagaaatccccatagcaatgagtgtagcaaagaaacagggaagaagagaggagagagactttttgaatctgaatgaggatgcaagtttttggtatatctcacattattttaaaaatacaatgtgtattcaccattaacaacaaagagaatgttaataagtatgtccttaatgctaagacctggtgatcaggagataactacagtatcatttctgatctcaagaagcttaaaatccagtagtgaagagagacttctacctatatgaactgcagtaacataatagaggcacatattaagtaaaattgtgagttcattgaggaagcagttagaataaagctttacagaggagatgcttgagctggatcttgaatgattaataggagttcaccatatggttgcagggagaacatccaaaattaaagaaatagaatgtgaaacattagaggacagtgtaatagaaatgatgagtttagggaactatacaccagttggtggtaggaattaaaactgtggaagtatacaattgctagatcatgctaagccttgtttatcattgcaggaagttaaaacgttatcacagagacagtggagaactgtcaaaggtgtttgagccatgatttacctagttagatctgcagtttctaaagatcactttaataacagagtagagagaggacagactgaaggagataggatggaatctggaagcttagcagattagatggtaccagtgatgataaggacttgatcaaggtgttagaaatgataaacattaaatttatggctatagatgccctattccatttagtgttgctataacagactatttgaggctgggcaatttgtaaagaaaagagattcatttggctcatcgttctggtggttgaaaagtctaggattgggcagctgcatctggtgagagcctcatgctgcatgaacttacggtggaaagtggaagaggagtgggagtgtgcagagaggtcacatggtgagaaaagaagcaagactctttaataacctgctctcgcacatgaactaatccattccctccagagtgagaactcactgacccctaaccagaatgccattaatctgttcatgaggaatccacccccatgattcaacacctcccactacgactcacatcccaacactgccacaatggggataaaatttcgacaagagtttcggaagtgatatatcacacgcaaaccatagcagtgagtgtggggaagaagtggggaagaagagaggaaaaatattaatactttttggagaattgtgatgtatcacgataatgactaaatcatacgtaatcttctcttgtaaactcccttgatttgaatgcacaaaataatactaggcaaaggcaaagtaaatcccacgtatacatttattatgaatctgagatgtggaatgtattataatggaacatatttactatatgacaccattttaaaaaattaagactttaataacaatactattacacagtgaaacttttacaacatccagcattcaagtgatttcaaacatttgtgcctaagatacaactgtatcttttttaaaagatatcatttatcatttctactcttactaaatcactagggtgctcaaaactcagttttattttacagatcagtttcacccaaatgcttgaacatacaggcagctgctaatgagtgacagatagataaaagaaatgggagaaggaatatgaatggacatgaaagtaggaaggtaggggtgtgggtgacagagaaagagagaggagagtgggagagaaagaaactatgttgaaggagacatttgactttttggcttactgggtttaaaaagttatcacctactacttttatttcataaccttatgtagcttatttaataaattaggagagtcagattgaaaattaggttaaaacatattttcctgagactattaaaatgatttcaaattatgctgtaactgtagtctctttgtcagaaaggaattcttgctgaaattggtgattaccagtttatcatttatttcacaagcatttatcaagcacactttctgtaaagagcacacaagcatgcatagcttaacatatgaccaaggaatcgttttttagatttctcctttctatttctgtaagttggaaaaaaaaaacttttgattatagaataataaaattagtatgcattaggtaatataaaaattgttacaatttataaaaacccttgatatgaaaacaagtccactacccttgtaaagacatgtgccaatttttctgtgctttctaaaatcattgaaccatttattcacaatttgcctttaaacactttttttccgaaaaaaaaaaaaaagtccatctctaacagtggagctccagatctatcaaaattcaagcaatgtgactgctctttattttataatacatggaaatgctagctgcctttctccccaggtgctttcatgcatatgtcccttttactagaacaaacattaccattctcctataaggctgggaaacttgagacagccactattgttccagatgatagtttttgttttcagggatgtatcaatcatattttagccagaaatttaacaacacaaacttgacagtaattctttccttctccctcttcaaacactcatggtctgcttcattcagtcacctcctcccgaggtcagctcctaaacagcagatggtgtgcttgtgtgcagcagctggcttcattcctctccataccctccttctctcaagggacagtgcgtgtgtgcctctgtgtgcgtctgtgtgtgtatgaacattcacgactttcagttgccattcaatgctttctgcttctcccagccaaaaagctgggaagcttggcgtactttccagcaacgaacccagatgtccagctgtgatacagtttcctttccagtctccctgctggagcagtattcattcacaaccccaaataaaagagttatccagaggccctattttgtccttatggtttggtgttgtagtcatgtttgggagaaacagcataggagccaggggcaacgagtaaaaatctaaaattattttcccctgttacttggatgggataagatagctcttcggtgtggctcagggccttgttttttatgggctggcttactcaatgcatcattgcctacatcgatgtcttttttctttcttcagatgaatatgctaatgaaactccaagaagcagccaattactcgagcacacaaagctgcgacagcgaaagcaccagccaccatgaagacattttggattcatctcttgaatctaccctctagagggtgaaaaaagttaagggaaaagactttgcttttaaaaaaatgtttcaaaagaaaggtattttcactaaaccactgccagtataaaagcaccctgtcaagggccctgacccagagttgtggtctccaaggaggcagcagaactaagtctgaaccgccaagatgctaaattgcaatggaagcttaactttagtttatttctaagcattttttatatctgtggagtaatagaaagctccattactcaactggaaaggaccctaatgacagggcaactgaacagattgcacatgggatagccaaactggactttctttgtttcctctttaaaagtttacaatgcagaccattttttgtcccttccttttgtttcctctgaggggctgttcgccccaggcagggtccatctttctgatctgtccaacctcctttgtgccacacggtgctggtcacagggcttcagtagtgtttgtgttgtgcgctcaccccattccagaacaaatccaagaggccagtcctccataagcacaaatggaattgtgcaaccaccagaaaaacactactgtggcaaactggagaagtgccaatttaattctaactgccacgttctcatgatgtgctccaccaactttttagtatatgagtcactggttttataaggttgtttttaccacagtggtctttttaaaccacctgcccactcccttaacaagagttttataccaattattagtcaacactgataaaaggcttttttagggctttatttgtttgagccttttcagtgaaagaaggaacatttcctatggtgctgtctcactgccttaaaacagatttctatgacagtttaacagttggtttaaatcctaaaccattggtaatttccactgtcttttcatttacaaccaagcaacaccagttaacatagtagcctcatctctatatatctttctcttttttttttttttgaagaaatggataggagaaagatcagtatttttagccttgtgaatagatcgctttgcctatcctccaaaatattaaaataacccagaaatgctctttgaccgtcacttaaaacctaagacatgtggcgaaattccatccagttctaagtgaaagagtttcagaaggcagaagattttgaattattatccagcagggctggaagcactagatgcagcatgagcacaactattcggctttccttccctattgtttttgtttttttaatgagttttgacgcatgttgttttgattgctattgttgtacatgagaaattcagcattaaagaacactgaagcggtaaggtcactgtggaagaggaagcgtttatactgtaaaagaaggttagatttgcacagtctactgggtaggtattgtaaataataatttttaaaacttgcacaaatcaaaacaaacacaaacaaaattgtattttatcctgttggtgttaagaggtgtttcacttgctgagatttcctgtacattgcaaacaaatacagaatgcaaaccctcaaagctgtattatctggtgtgtttgtcctgtatttacagttgtttttgactatgcaggagctatcagtgctagagtgagcatgcttcaaaactgtacatgaagccaatatatttttggataagtaaaactgtctgaaagtacatctgtcatggcaggctttaaagagagtgcatgaaaactgatcagtcattggagaagttaccaccacacacaaaggacaggttttaagtttatgaaacccaagggctaggccatggtatagacttcttctatgagtgtgtgaaaatgtgttacttttaggacgtgtatttggtgctactctctgtgaccaccaatgggtcagttgctatagaacaacaacaccacgaaacatctgtgcagttttcagagtgtcacaaagtcaataggtccttacacggtgctattgccctaagggaaatccgaactgaatttatgcacatagaattgtcaccctgactttgaagcctcaaacatggatcaaatctgttgtgaaacatcaatatatgtagctggatgagtgactagtttcccttgtataatatgtgatctaagaaaattgctaatctttccctgccattttgagaaacacagtccaaacatgagcataaacagaatttcctgcaatacatcccagtaggtccacctagtttacaacttaaactagtttgtgaaacatttgtctgtatacattttatattttgtacattttgatgtaacatatcatgtaaataggcagaaacagtgaaataaatcatctgaaaagttttgtagtctttgtaaagccccaacaataagtacttggtgtcaatggacttaactggatgatgtattttctattggtttattgttcctctagcttgtaaaccagcttgcatatatttttttgcaaatgtgcaccctgtatctgtctaaattattactttgccattaaagtggaattatttattgacaa

SEQ ID NO: 338 - DNA, 226516 bp, Homo sapiens
ccagatccaaaattagcattttattcagaacgctggggtcagaggtgtatcatttatattctggtacacaatacagaggcaaagctgttgtcagaagtctctccagtttaaaagcttttttttttccattttttttttaaaaaaacacacacttagtagtgccaccagtgtcaggccacccctttctttcctttcctttttttttttttttggtacaaattatgtaaaacatttgtgctaagaacttttctccctccccaaaccaaaaagaaaataaaaaataaaaaaattaaaaaaattaaaaattgagtattctaactacagctcaacaattgaatcaaatgtcactgttttgtaaatactttatccataacgaaagatataaacatgcaaaaaacctgaatccatagtccaaataatacatacacatgttctgaagtttctgcacttctccatagactatgccaataaaacattatgtacacatactatttttacagtgaagtggaaaaatacagaaataaaaaagtgtacatggattaagaccaaaatgtgtctaacattctagtttatgaaaaaattcaattttgctacaaattggtgatatgaaaactccctttatttgcaaccagctgagtaagttttaagattttagtgaaaaaaaaaaaaacaaactaaagtctaaaactagaagtaatgtacattttccaatctcatggtctcatcccccaagataataaaatcgctccatgagtttttttgtttgtttaattttgtattttaataaaagcaaatgcaatgtaacaaaagcgtgttgaagcatatcatggtttaacttactgctcccaccacaaaatattttgtcttttacttatcgtttcagaaatcagtaccattaaagccttaaacagaaaactaattccaatctgaaaaaggtacaaaaaggcacataaaatcccagtgcttctgtactgtaaaattcaagtgtaactgagctcagtgtttttccaaacagtatggatcactgatattccctctgagcccaaattggtttgcagcctatgccaaagcctccagcaagcactgtgctagtagactacaaagttaaagcctagcttctgaatgctttttgggaatatcagttgaaattgtttgtacttgtccaaaaaccaagttcaccctgaagttcagtcatcacctccaccatacatgtcagcaagtttcttgaaccgtggcccccagtcgttcaggtaatcatagtcctgctcaccaccactacttgaggaattaagggagctcaaggacccagcagtggagccactgccttcatagtcaaacactaacagggagtcatatggtggagctgtggggtcattgtcagccgctttaaggccctgcaatttggaaacacaaagaatgaaagaattaagagagggttacactttacaaaaccacaagcagatcctaatgaattcacgggatcaaacaaacacttgtttgtaaatttccatttacataccatattttcaacacatggaaaagggagatataaccatttgaaagttggacaaaaattaacttatatctttccggtgcaaagaaacaaccctaagcagtcaagctcagggaggccaaggcttatgaagggagggggttaactgggtaataagttggacaggtggcagaaatgaatggccctgcttgaggcagagaagaaaggatcttaaataacataatatatagagcagcattgctagattaaatttaaaaaaagcacctcactgaaatacaagagacacacaaatgagtaccatgtggtccatgtccctccacaggcttacagtctagcataacaggtattactactgtgtgaagcaaatgacaagtgacaaaactatgaagtcaaagcaaaagccatcaggttgtgggggaaaaaaattcacatcagcattaagagctaggagttcaaagagaaagtagcattgtatttgacctcattttggaaggacatcaaaggaagactgaagacaggtcagatgtgattactacataaagggaggtactcagaaaatcatttatgtgactaacatagcataaaatgtggaattaattaattgtaaactggtattttaaaaaatagggtatcttctaacttccaaaaaatcctagaaatgtcataatccaatatctgtacacggtataaatattgaaaagaggaggactcctgtcaatctaaaataacatgcgttatctggttcttataaagaattttaagaaaaaagaaacaaggaaataactactatctatatttgtaacttttgtaagcagatgctttttaatatacaattagagtctctatgctctgcaaaacttctaaggatttagtattaggtcctctggtatattttctacttaattttttcccccaattccattctagtactcctagatacactaacattagtctccaaacaatcgtttgctttttccacactctacttgtcaaatgctagttggcttatatggcctcacctatctaagatgtgtcacagacagtcctacccttgagagatcaagcctgccaatacacatgcattttatgagcgcatacatgggtttttatgagcatgtgttcacctatcctttcaaggttacaaaggagaaacagggaagaagagcaaaaaaattaaggtcagaatcagtatggtgtagtggttaagagatcagactgtgagatgacaccttagctctccccagtactagctgtgggacctccgcttaacctcatctacaactgtaatcataataataggactattataaagaccaaatgcaataaagggacccgaggtctcaccacagtgactggcacatgtagagctcaatgaatattagttagtatttttaaaaaatttaagttttgagaaaaatgtcctgccttgggatttgaaaaaataagaaacgatgaagatatattttaagaaacaaaatggcagctgcttgactcacgtcaaaaatcagagaaaaaagtacacatgaccagttttctcatctccaggtacctctttactaacaatccatgaaatttagcagtactttactacttttcgtcatgtcattttatactgtttatactccagaaaagcctgtgtaaaataaaataaagcaggtttcagcaaaatactttgatatatacaacataaataactttagataggattttatcttatttttagactaagctacaaggcaattctgctaagactgagaaccacaacctacaatttctcaaaacttgtaactcccttctgtggtagattgtgttactgccctcagtgattcactgctctttttctgaaggcagaacacacacccacactcccacagagcctctctggggtcagggtttactttcccaaccacactgtaaggcttggctgtctgactggctttggccaatgcaatgtaagtagctgtgaaaagtacccgcttcaagaactctatctaatgtgtttccacccttccactaatccccctttccccctctgccaggagaatggcctgctccagatgggaagtttatctgcctggatcctgaaacgaagacgacatatggatcaggaactgagtcactgacagactacagctgacttacaacttaagtaagaagtaaaccttcattattataagcagcaatattttggagtggtcagtgattggtaccttagctaacaaaagccgaagaatgcaccttcattcattttgtttgtgtttattcattagattcaagatgtatttgttgattatctattaatattattgcaatgtattctgctaactggtagagacacagctactaatgagctagatccaatggctgccctcgtggagttaatattcacatattagcctacactcctcttccctacaagatctagcaactgcaaatttaaccaacagcggattgccttagttcagcattgtctgacttggggtcatacaagtaggcccaagaaggatctgaagaaaaaacaagaaaaatcagggaaattcctgataaggagaatgggtccctgaaaacaaatattaaattttcattatgacaattgctttataatacagacaacagagacaatggctaagatcactttgttcaggtcatctgctttaccacaatttaattattaagcgaaaatacacacagagccctggcccaatccttatgatgtcaacaccaaactggaaatatggagaggtcaagactcaaattagggatagcattaggagaaatacctaatgtagatgatgggttgatggatgcagcaaaccaccatggcacgtgtatacctatgtaataaacctgcacattccgcacatgtatctcagaatttaaagtataatagtaaaaaaaaaaaaaaaagaaaaagaaagaaaaagagaatgacaagttaaaaaaaaaaaaaaagactcaaattagcccgaaagggtcaatggcaaggcctcaagtgtgtctgaatttggaggagaaaaaagggatggcctgtgtttactatgtccagggaataaacacaagaaggggtctggtcttccctggtgtgttcacggaccccaggactcttcatcaaatgactaagccacctaattcaattccttaaaataaatataatgcttgtgataatcaactcccatatccactattgagagtctaaaaaatattattttctttattttttagctcctgccctggctttctgatcatcctggtagtttacaaatctctgttttctttatttctgtttttttttttttttttttaaagaggttaaggccataaaatccattagagagagaccactgtgctatgctagagcacggcacattgccttatgttttaataattacaaaagggcaaaatcactgaacttttcaagagttcttagacaagccagctttctatgcaggttaagtactttaaatcccttccatttggatagcactgatttttatctgagaataaaatatgactcttctgaacgaggtattatataaactcttggtaatattttggtaattctaaaaagatcgcactgaagtcctaagaaactgacagtaacaggcacgaaatctgagtgaatgtacagaagaaatccagtgggcaacagaaccttctggttctcccttatgggattcctttattcttggatatgaacattatttcacaggatgtactgttaccaaatttacaaactaaacgcctgtgtttctctaggtttgactaaatttagcaaagtatcctcttgttccacctttcctggagaggtagatcttgaattctggataaagctgaactgtcttctaaagactgaggcttctctgcagagtgagagagcttggctctggctgaattcttgctgagcttgtatttatagacttctgatcccaggctttatgggcggagacatgcttttatgaggataaaaacccacattatccagcgaggaacacatgagggatgtaaaagaaaagaggtcttactgtttcctttacattctgtcttctacagtcctagtgccactgctttagtggaggtcatcattatatcttgcctggaccagagaaaaagcctgcctaactggtcttcgcctgtctccagcactgttccagcttctttcctacaaactattggtttctgtctcaaacgttatttgatatcactcccgcaagtaagacctctgactgctctctatgactccttccaaatgaaagagttcccccgacaatgggcaaaatgatttttaattggtgcatgaacactttaaaacaattatttaagaaaattaacttaaaaattgatgaacagtttaagaaaataacaagaagtacacagagagggaaaaaactggaaggtgttaactcaaatgcctgctgttgggtaacctacagcatacagtaaaactctttagaaagcattcagtgaaccaagactgtttacccaccttttctgtttcagctattctcagctccagcaaccacgactgaattatgcacccccaaagggaatccccccaaaccccaaagcatcatgttcttgtgcacttctatgttgtttattcattttttttagaattatacttcttatattttttatctgattaatatccatccatcccatccatccatccatccaaaagctcattaaaaatatcacttcgactgcacagatcttttttccccaaccatgacttaggagtcattcctgtggtctctctggtcccttctacttttttattttttatttttagagacagggtctcactctgtactccagactgtagtgcagtggcacaatcatggctcactgcagccttgaccttcctgggctcaggtgatcctcccacctcagcctccagagtagctaggactacagatgcctgccaccatgctcggctaatttttgtttttttttgtatagagggtttttttatcaggttgctgaagtcggtctcaaactcctaggctcaagcgatctgcctgcctgagcctcccaaagtgctgggattacaggtgtgagctgctgtgcccggcctcatctacttttatcatcttgtttggatgacactagattgtgacatccctttctacagaggctgttttgtattcacatctcactgtccaacacactgcctgacattcaacaggtattctataaggtaactatgcattgttgtcctgggcgtagtttttcctgctcagcatcctcttcatatttatatccattcctttcagaaacagctagaatctagatttaagacatatgtggatataaaagtacaccatacttacattacagtagaactgaacatatcaaggccaacattactacccctctttctgggaatttcattttacttaaagcaatttttgatgcagaaggagtggattttaattgttttcttacaattagagaacagcagaaaatcttttactcctaaaaggtaatttacctgtaatagttactaatatgacaccaataataattaagagatttttactatgtgacaagcactatatgaagcacattacaaagataatctcgtttagttctcacgcaatcttaaaaggaggttctattactattcccattttacaaataagaaaactgaaaaggttaaaggcaaggatcttgaccttgtaacaaggtaacagagctgttaggtgggatggctagatttgaacttacacaaatgcccaacttctataagaccataatgagatattttaaaaaacagaaattaaaattaattaataggagaaaaagacaagcattttaaactttagtagtttcaagcaagttgtaagaagcttccataagttttaaacaatattaatgaaaaggtggtcttttaacagaattattcacttggtttttatacttttgagtagagaaatatacttcatatactaatgaatacatatatacacacataataaaaatctctttatatatgtatgtttgtatctacaaatatacatatttatatatgtatatatgtgtatatttgtatatacacatatataaatacgtgtatatttatatatgtgtatatttgtatatacacatatataaataagtgtatatttatatatgtatatatgtgtatatgtgatatatgtgtatatgtgcgtgtgtgcacacacaatgatacggtttgactttgtccccacccaaatctcatcttgaattgtagttccatatttcccataatccccacaggttgtgagagggacccggtgggaggtaattgaatcatggggacggttacccctatgctgccgctctcacgatagtgcgttctcatgagatctgatggttttgtaaggggcttttctccctttgctcagtacttctctctcctgctgccatgtgaagaagaatgtgtttgccttcccttctggcaagattgtaagtttcctgaggctttcccagccctgtggaaatgtgagttgattaaacctctttcctttgtaaatcactcaggcttggcagtttttcatagcagcgtgaaaacagaaaaatacacgtatatatataaagaagtttatttctttttacaaagaaatacacaggattagtattagtaaaattattggaggtatattaatatctaactgttgggctgagattaaatgaatttgtttgaacttttcactccctgaaggtcatgtttaaaaattcaaaacagaatgaaactctcagttgaaattcaaaaacatgtgacttattttactctgcctaccagactggaaataagttatcatttttgagattcaaggcaacattcattccttatttaaataaacaaactagaaaatgttctcatgagctttcttattccttacatctataaaagcactccaattataatcaccactatattattcttcctttggaacatttggtgctctgctaaatcaaataagacctgcagataaataaatttgtgtgccttttaaatatttttataaaatgtgcttttctttctttctaggtgctttcaactgttttaaaactctacaagtaagtattcatttttgtctgtccagtaaatgaagacactgaacaagtcttaacagttatcttggatgaaagagtctagatggtattttggagagttattactggcttaggccttctgacttacattagactttcatctcccttaaaagtcccacagaactgaccatcatctccttaaaactatcgttttgattgttttctattatacctacctccttagattttctgtctccaactctaggggcatttctagctgaagatatttgattgctcctctccttcacatttctctatcttgtaattatattcgaattcatggatttaggccaggtgtggtggctcacacctgtaatcccagcgctttggaaggttgaggatggaggatggcttgaccccaggaggctgaggctgcagtttgttatgattgtgccactgcactccagcctgagcaacagagagagaccctgtctcttaaaacacacacacacacacacacacacacacaaacacacactcgtggatttagttgccattttcagaataatttccaaattggatcctttcatccattcacttggttcaccaaatcactgtgccccatactggcccctccagggagaagcctgtctcccctcccctggaacatggatcagggggaggcaggatggaaccatgggatctgtgatctgagggaggtgagttctgggtaccatgggatgccagtggatggtgtctaacccatactctgtatgcctgacccttcctgggttggtaaatacttaatgaatttcacccaacgctagaaaaatgggaaaggaattctagacaggaagaacatcttgtagatgggcaccagcatgaaattgtaagctgagattgtaaatgacaagtagagttctctgtagatagcctgcaagatgctgggtggtgagggccttgagatgaagttggaaagccaaataagaaccagacacaaatggcctcctatgcctggcaaataaggcttcggatactggcacatttgcattgcacaaatatcgtgctagcaacaaagtagggtatacacacaaagagaatcgatgtctaatttatgcttttatctatatattacttgcacagttatgttacacacatggatgttcaatagtgatttgctgaatggatgatcttacattgagctcaagatggtttcacaatgagacatttttcacatatgcagataatcttcaaattaggaagagattgtattctggaagtcaatttgcagtcagttgtttggaagacggtttttcatataagtaatcatacctgtttgttaatggtctccagccataataaactgtatacctgagcactgtttaggagaaagaaaattccaaatggaaattcctactgtaactcctactgtggccgagaagggttgggtaagtgaaacttattgactagatgtctactgaagaagagatagtcattgttaaaaaaagaacaaaaaaaaaatcaatgaccatagacatagacacacacacacaaacaaacacacactcaaacataaactcagaatttgaatgtaatctgacaagtaggatgaaaggctctagactcagtatccattgaatctcaatcagatgtaaagtgggtggtgcccaatagcatcatgccctacacatttgccagggtgcatacttgaatgcctgaaaatgacaaaaatctaagagctaggtaacatactagatgtttaagttataaaaacatgaacaagaaatagcgcttgtcctggagataactcacatactgagtgggagaaagaaatactgacagttacaccccagctggtgagggctatgacccgaggggcaacttgttatcccttcccacaggcatcaaggaaggcctcacagagaaatgttttggctgaatcctgaaggcgaagtggcagtcctgcagatggacaattaggttaagggctttgccgaagttacagtatattcaaaagtgttgatgcttttgaggaactgcaaatagttcagtggggctgcagcacagaaagggaatgtggggacgtgaggggtagaagaaggcaggaatcagatgaggaatagcctttataaataaaccttactgtttgtttgatctttagcactgagaaaagaagagtatcagggatggaatgaaatccacagaacactggtacttcagggacaggcagaaatatttagtaaggatttgttaaattatacttaagctagaattctggcttcaaaaaagtatggttccagctgggcacagtggctcaggcctgtaatcccagcacattgggagtctgaggcaggaggatcatttgagcccaagaattcaagaccagcctgggaaacaggctggtgagaccctgtctctacaaaaaccaaaaaaaattaaaaaaaaattgtaaggtccagttcctaaacctacagtcagaagattcactataacttgaattgacaaccatcagaataactcaacaatttcttatgatgacaaacatgaaattagaaataaaatcatcaggcactcttacatttttctaaaagatctaggcatatatgtataaatttctgcaaattctcctaactggatctatatataactaagagctggcaaagtcaggacatatttctgtggataaagggagttactggcattctgttgtttttgctttccatgtgtttttaaatcatgtcaactacaaattaaccttattacctatttagcagaaatgaatacatatgttcagaaaggcagcatatattttaggaacagacagtaatggatagttatagagacaggcaactattccaattttgttttaaaactttttctacaagcaataagtatatctaaaaacctaatgtagattatgtttaatattatatgaattttgaggaagcccaggatacaagagtcttatcagcctatgactgaaggccatatccaacagatgcattccactttgtaatgcactgagacctattctgatcttggagacaccaatgatatgaccagaaaacaggagttctgccatatattcacagtcaacatcaatatgtagtgttctcttacattcacaatacaaattcaaaagaattacagtaagactacagacatgatcagaagcagcagcacaaatcattgaacttcaaaacttaaatgtaacagaactcttggtcagtaataaagaatgtcataataattttgacagtgaaaatcatatctgttatatgcaacagagaaatagcttccttttacagaagctcttaaaactcctcaactagacaagtccttaaatcacttacataatatttaatttagctcttccaactaatctcttttgatggagtcattgggcaggcactgaattctcacgatttgtgggattcaaagggtacagtgtgaggaaaattaaagtgaactactgctacatttattaatgctaataaatgaaattagaatgcactataatattgttagtctatttattacttgtaatctaggaaaaaaaatccttctcggagacagtgtgactaattctgataatatatgatgtatgtcattttacaaatgcagaatcttaattgatagatctctttttggttgatcaaagcaattacatttgttgttaatgaagccacatttgctttcacacaagatgaacttcagaaacacaagtatgttttagtgaactatatagctgtattccaagcaatttgtggcctacagagatctaaccattagcatgaaatgaaaactcttatagagaaaacgagtgtctctctgtacctcattaatgaagtccccaatgtctccagggtgtggggctgcagatcggaccggatactggggctcggcgtggatgggtctttcatccattcgtcggattcccacaggcttgatggcatcaggctccacagtgtcaggctgctgcagctggctcaagtcatagtcctgcaaaaagacaaaatcaaaaaccgatgggagatgggcacaaagatagaaaattacaacctcgctttttaagcacatactcagaacacatagaaatgaggaaaatttaacataatggaaaagttgccactatgagtttttcatgttatgattaaatatttctttcacacagctctttcttctgtgcttttcatttctacagtctgtgctccatctgctttacaatgttcctcatcagtttccaatgaaaaacagcagtgtgatgaggtctcactataaaacaactaaaaaaccgactagacaatatagttgtaccatacaagcaaaggtgctaacttcatgtctttaatatttttttaaaacgagggtggttattcttccttttccctaaaggaaggcattagttcatgaaggtttcaagccacccttcttccttctctctctcccttctaaactctagagcagaggtcagaaaactatgatctctgggcccagtgtgacctatggcctatttttctctaagattagcttttacatttttaaaaagttacttaaaatacaaacgacaaagaaaaatgtgctacagggaatatatgtggcccacaaaacctaaattatttactatctggccctactgaggaaaagtttgctgacctctggtttagtggtggtagaccagagagagggtggattttcttccaatgctgccctgtgggaatgtcctggaaaaacaatctgtccgctttcagagaggcaaagtacaacttgtgaagaaggatgctctggccataggttgggccctcagaactatttttagctcagacatctggacaggaatgtataaagaaagagactacaatgtggaaataatccacatttaaggtttgggcaaatagttggtagtattcaaacctctgaattctggtgatacaaaatatcatatccccaagcttacccaacattctttcaattcaaaactgacatttgcagcaagcatagatgtagttatgcttttcttagttcaggcttcatctctctgtctgaaactagcttttaaaaccttttgcagttatctctagagtgattttgatttattcgacagttgtttaacgtttaccatgttttggcaatggtctaggtgtcttacatatgttcactcatttgatcctcttagtacatgtgatactaagttttattatccccacttaagagatgagaaaactgagtttcaaataacccaagtaagtcgcatatggtcccagatctattaagaaaaggattctgactccaagtgtattagattccaaagcctggctctcttcacaatcatctatgagtaaatcaagactgagttacaaggttggatttaaaggtaaggaactagataaacgagcttgagcttggagggacaggaatgtgaggaatgcttaaaataacaaggagacaaagggaaggaaaaggtcagtaacttcatactcactgtgggtcaggcactataccagactcttgataagtgttttctcactatcaatggtgcctaagaaacccatgaaaaatgttttatcatcatctctttaggtggagaaacaggttgagtaacttgcccaaggtcacacagctagtatatgactaaaatgagaatcaaaaccatgagtgtctgacttcatagcacctgatttaaaatttatgctaattgagatactctgatcctggcaacactctccctgaatatttccttatcaagaacttcagctggcaggtgaaggcactcacatacatacgctgatggaaaagctcctcctcttaggtgtgtgcaatgtgatgcggaaagcgaggtaggtatagagacttcgaacccgccagagtgggatgtacatttggtgtatcacaaactataaaatgttcagggggaaatcagctttagctctgaaccatctatgggctggcgacaaagcgccattttgggagagtccacagcaggagcaaaggcatcagaatgctgctttctcttgtcaagatggagtatttcaaatcatccatacaaaacttgagaaaaaacaccttgatcttgcacaaatgtgctccattttcaattttatagaatttgagttatttacggaatatctcagaaaaggccctcaatgatgcaacagatgtgaaagtccttgaactgttaaaatgctatacacgacaaaaagagggatttagtcccctgcactttgggaggccaaggcgggtagatcataaggtcaggagttcaagaccagcctggccaatatggtgaaaccccatctctactaaaaaatacaaaaatcagccggatgtggtggtgggcgcctgtagtcccagatatttatttgggaggctgaggcaggagaatcgcttgaactcgggaggtgaaagttgcagtgagacaagatcgcatcactgtactccagcccgggcgacagaaagactctgtctaaaaggaaaaaaaaaaaaaaaaaaaaaaaaaagatttattcagagaaattttaatgctttcacactaaaaaataaaatatgttttttccaggccatgtttaattgtataactaccaagcacaacagagtggggtgaactatgaataagtatgcattcttattcaattaccaaagctgtccttaaaatgggggaaaatagatggcaagtatattgatgacagtgaataaatgtttttaccctaagggtgaaaaatgttttattagaagtctaaattacacacaaaaaggtaattgaatcttatgtttaagcactgtcttttacctggtgacatattctttgatactcctggatatattacataatagctcagggtgacaaatataagaatatagaggaatttcgttcatataactggagataaaagaggcatgtgggctttgctcatgctactccctatctgggaagagccattctactctgacttcttctataactccaactgtatccagaggctgcaaataaaattgcattttgattggctagcagacttttaaatatattcaaataggtcaccaacatttagacataggtgtatctcacctgagaataacaagatctggcaaaagagatcttacattctgacaacaatttgctacagctgagagcagttgtcccctctggacaaggaaaggatagcctcctaacctgcttcatagatgaatgtgtatataacatacttacataatagcaaataatttacagttctttatctttcttttgatagctttttcctactatcttaagaaccagagagcaggaagagtcttaaaacttcggtggtcttgcttagacctttggaccatcaatgtttcaggcttatagaaagttcccactaaaaaaaaagtgttgaacataatctcagtgatgatacttatgccagatatcaaaggagcagctaattcaagaaatgtgacttggatcacattatacactatagtaataatttatgatgagacgggagagaaagacctcctggtcccattgctgagaatcattgccatggtgaatcaccccataatgatggaagcctgttaaattcctccacggtgatggtgtccacaaagaggcaaaaaatcactggtttacaggaagttagacacaaggttaaaatacatggcttagagtgtctctgtgatggcttctccttatctactgcaaatatgggacataaaaatctgatgatggcaggcagcgtgtggaagtatcctccggccacagggtgggctcttctgttgacgtctatctgtgttgtatggcaaaagtcctgaactgagagtctaattttagaccttttgataaaaaacgctccctaattatacatctttacaatcccataatgatgtacataaacacacaaatgacaacatgtaggatgagaattataaagagaattacaaagaccaaaaatcttctcaacgtcattgggttcatggccttactcctgaagattataaacaatccaaaaagacatctttatttggctcctaaaactcaaagagtgggtccgaaaattctcttatgattgccaacctttacaatgttaacttcccaaagaaattcaattttcaaacaaaggccaaggaaaatctcttttttacttcattttaatgtttggaatatgtgttaattggcaatcatcattaaaagtaggcatggaatttgggttttgagaatattaacactgcaagtaacttaaatttttttttggtctatgatttaaaatgtcttaagggcgatatagttctgggggagttagtaagaagttagcatgacttgcaatgatttataattagtttggaaaatgatacaacgagtttaactcagagcatttggttatgctacaataaaataaaatgttgcatcagtataaattgaaattctggaatcccaggcaaatacttccaaaaactacattgcatgtagaatctacagaattgtatagtcaacccatttcagggagtaatgcaaacactcactcatttaccattccaccagtatttatggaatgtctactgggtgccagatgccattttcaggtcagagagcaagaaagcaagcaagcaacctttatctggtgctcatcatctgtcaagaattacattaggtgctttctcatgtggtattgcattaatacaaacaaaaacccttctaagtgggtgttattgttcccactctattgattaccacagctcagggaggttaatgatttgaccaaggtcacagactcacttaagcacgtcaaaagataacacagagcccaccagggcaagcaaaataaataatcaaaaagctgcatctttttgtcacttgccagtgaagaaatgcacgaaagagtttactgagggggaaaacatctggggtttgaagtgctggaggggggagtttaagatggttccactaatcagtcactgggcactagcactctgcatagaacaaatgagttcttcggtctgtgcacagttggttaaaataagactaactgttgtttaggcaggaaggaatcctcacttaggtcaaataagagtctgacacatggaggagaggggtggacacttaaagttcacgggcctttatcagcctccactggttagaaccagtgatgaaacacaacagttttgctatctcttaggcatgggctggttcaagtggaacattttccttttatagctgcaaaggcaaatgactttaaaatccccatatagataaggtaaacattaaaaatgtttcaagactgagtgactgagagaaattaaaatactcacatggaagtaaatggacaaaattctgaaggaaaaaaaatatctggaaaaaagctgactgcggcacaggcaagaaacttcagacacaaaaagaaatggaaggtgggagagaagaacactattatctcaccctctatagctcccggcattaaaataattgaataaaatagtgataaggtgtcaacatattaccaaacaactgctgacaagtaagtcaaatatacccgtgcaagctttatgtaaattacattacgacctgattttcttccccagtgaaatatcgttatgacggtaactatcttcacaggtgaaacgatgtggaaaactaagtagattccatggattatcacagcccccccaccaacaaaaaatttgctaaaagctttttctggattgaaccataaacctaatacaaataaaataacttggggactttcagtatacagatgaaggatctctgttctctctcttcatatactatacattttaatcttactggtagccagttttctacttcccacaagggagaggactgagtccccactaaaagggaacagtcattgtttctgcccctgtggcttactgttaatgctgacatgtcagtttcctttaacatgctacctgttttcagaattatgaatgagctataggttcactctttgatgtaaaattacacttctattttagaaactgtgactgttgaaatcctatcacaacttatttcccgttacaaaattatggcttattcttttaggaaaatgtggcatatacacacttcaattagacttgattccacaaattctttcataagaggggtctctcttgggaaacagactcggttactaacaacactgagcctttactctaatgtcttttaaaaggacatattttaaaataatgaaagtttggccaggtacggcagctcagcttggccgggtgcggcggctcacgcctgtaatcccagctctttgggaggccgaggcgggtggatcacttgaggtcaggagttggagaccagctggccaacatggtgcaaccctgtctctactaaaaatacaaaaattaggtgcctgtagtcccagctactcaggaggctgaggcaggagaatcgctagaacctgggaggcagaggttgcagtgagccaagatcgtgccattgcactccagcctgggcgacaacagtgaaattctgtctcaacaaaataataataaaaaaattaaaataatgaaaatataatatttaaagttacaaaaaatacggaaagtgaagatgtcagaagctatgaaggaagtactgttggaagaagggaggatgcagatatgcagaggaacagggcttcagaaagatggagcactggaaatatgaaataatttcccgttgttttgatgcaatccagttacattcctataaagagaaacacatttcttaacccttccaagccactgtctgtcttgggagacaaaagtatagccatctaaatgcatgttgggttccatgttttcacctcgagttccaatttcttcttgcaaaaaacaaaaaatgtgaccacttggataaagatcaaagccactctatctcagcatgacctattaattcatctcagagaaaacataaaaataggtaatttggttgagaatatggtggcagagcatcaaaatccttccctagtttatgacacatcattttgaaatgtcctaaagaatattatttgttttaggataaatgtacacataaagtaaatactgcaaagggagccaagtatttgattttttaaaatccttgattcaaatcctggctccatcatattttaactgtgtgaccttgagcagattacataaacttcccatgctaaccttaatagtattcaacttttagacaaaaaagccaatgagaattccattgattaaatccgtctataacaatgttcaacaatcttttcctgtagggtctagatagtaaatattaatatgtttggatttgggggccagatagtccatgtcacgatgtttcaactctgctgttgctgcagcataaaagtagtcatagataacacataaaaaatgggcatcaatgggcatggtgcatggccatgctccagtaaactttatttataaaaataggtgggaggctgaggcagaagtctatgtgtaggctgggcgcggtggcttacgcctgtaatcccagtactttgggaggccaaggaggatggatcacgaggtcaggagttccagaccagcctgaccaacatggtgaaaccccgtctctactaaaaatacaaaaattagctgggcgtcgtggcacacgcctgtaatcccagctactcaagaggctgaggcaggagaattgcttgaacctgggaggcagaggttgcagtaagccaagatcacaccactgcactccagcctgggcaacagagcgagactccatctcaaaaaaaaaaaggtagctggtggatttggtagctgctagaacactggcctatagcatttttgcatgtcagttctttttttttttttttttgcatagtactaatacatacttggtattcaaatctttatcattgttattagtagaatatcaataactttccatttccctaaaacgaaatatagaaaatttgtaatcagccaggaagaataaatattaagatgacttatctaaaatactgtgtcacttgcatgaagtgacaggaatgatgaaggaaaagtcatatgcaaatcatatgcacagtgaaagtatttaataactgggaggggatgggcactgaccagttcagaacacatgcttttacagcccactaatgtgtaccctggccacgagtgttttgagaatagcatgcaaaaagggaatgacaatgtgctaacccaatccctagtgaaactttccttttgtgaaatcagaatctttcaataactaatatataacagtgtttgcaggttggtaaaaatgaatgaataacttgggaacatcattaacaaagcatgctttagccaacaataaaagtgttgaaagtggtctccacagttatgtccagattcagccatctgttaagtttgcttaaaaggcagaataaatttataaagcgattatttcaagcaatcaaatataccatagttagattatacagcttcattctctaacacttaaagtccgatagttgggcttgattgcccacattaggtctggttcccgagactggcagaagtccacagagatcccctggctcaagaagagatttcttgactcagaaaagtggcgggtttgttctcaagtggctttcttgtacctgtgcccccatccttctgtctaggcatcttgcctggactttagatttagctccagactgtatactcagatttttttttaataacttggctgcttagattgcttctccagattttaactttgttaatgtcaaaatgggtccaattctgcaagcttaatcaattgattacccttatgtcttctaaagtcatattaccagtggtcatctaataagctgtggctatgagcctagccatactggtccaagccagtaacacctcctgcctgctacagaccagtgagactaaataaaatatctatcatatgacctctatcacagtgcatgagagcctgaactctcgagtcacatagacctaggtttgaaaacggactaacagcagtgtccatttcatggagtcatcaggaacattataaaggacatgcaaactaagagagtagcacagtgcctgacacagaacaaatatgcaacaatgctagcatttatgaatgctatcatcatttcctgaagacatcagagatctctaaggatgacagtgaagttatcgggagtatactggttcaattaagtcacagatagagttgcaaactaagttagaaattcaggaagagggcccacagcagttcaactaacattctatgagtgttgccaggtgccaactgtcctagatactgaaataaaaaataagtatgacaagtccttgccttacagagcttaaggtcaggaccaagagtggacataaaagctcaaaatagaggtagactgggaatgctgtgggggcacagagcagagaaacttgatttagcctgggactctaagacaagatgtcttgagatgaatcttgatggctaaacagaattaggtgaagaaatggactacgttaaaaaagtgtgagagtgtggtacaggtgtgcaagtataggcagttcaaaatgcaaagtggaggggtaatgagagaacaaactgaattgtcaacccttgaagttcgcaatcctaaaagccaaaccccaggtcataggaactgtgggttcttaccccatctcaggcacttggacttggcggaatgtgctttctgtgtcaccaagactctagggatctcatctacatcaatattgaaactaatttccacaactcacataaaaaaatcaacttcattgaaaaaaagtcagtggacactcatatggtaattatatctaggtcttctgggttctgaaaacctaggccactaagaggcacttctattataattccctttatcatgaaattgtatgtgatttcttacatgtgccagtgctggatcctgatctagaagactttagtatcacagaaagtactagaagctttcttcagataaaggaaagctgctttcccttgtttttggtgaaccttacattccgtttctcatgcctatacagtgttgtatttcatgagctgtgcctactgtatctcctctgtgccaagggacctacttccctatgacatacctggattggtcagaacagtgcaacccattgtgggtgaggtaaaaagggttctcatacaatctccaaaaacattctctaaattcaagtacctaacctgggtttgttaagacttccagctgatcacttaaaccatttatttttctttctagacacactgaaggttatttcccagggaattaggagtggaagggatgtgtgccacttctaggcctggcccataaaaatctcccaaaaatcatcctccatgccctgttgtcatgtagtgattgcatggatttaagggtagggtgatcctagaagtcacatgtgaaagatgggagagtctttggcgcttaggtccctgaatgactgtgtagagagaagcagacctcctttctccatcccaaatgcccacgacctgaaacccagttaatgttaagaaaccaataaatacattttcaactagacttaggtcactgaaattttagagtctgttacagcggctagcctattttaactaatacctttggctaaacatatttgtgtggctacttctctctctctttttttctctctcatttaagcaatataaaactgtcttagaaaatcacctcctctttgtacaaacctgtttttgttaatctaagacttacttattactgtataattcaatcagggcctgcaaaataagtatctatgaagaatgggctgataacatatatcaagaaagctggtctggtacaaagaataaaaatactggaacatgcttgtcctgcttaaagagggaaaatctctgtttagttcccaacaactgtcatgtcagaatgcaggccatgtttccagatctttctgctttttgaaaggattaggaaacaagaattttatgtgaatattttccatttttaattctgcaagctcaagaaaacatagtcatggactacgtgtgaacagattctcagtttataaaatgctactttaaagtgacacagaatccatcttccagacatgtcccccaaaacacaggggttggtatgaggtattgctacgctctgaatgtctgtgtcccccactaaagtcacatgctgaacctgaattcccaatacaatagtattaagaagtggggcctttacgaagtgattaggtcatgagggtggacacttcatgagtgggattagtgccgttataaagaataccaagggaggttgtttgctcctttcattgtatgaggacacagcaagaaaggcgccttatatgaagcacagagtaagctctcaccagacactgatctgctggtgccttgatcttggacttcccaggatctagaactgtaagaaataaatttgtcttgtttataagctacacagtttatgaaattttgttatagcagcctgaacagactgaactactttctttgtgatttcagaaccatctcagatcaaacaaaaaacaaaaaacaaaacaccccaatgaaccaggtgtcagtcagtctttaaaacttaaaaaaacacatttcagaattcaggcagagtgttctcagtcctggaatgggaaacctatatagtgttctctgagcctaaggggtgctgggccttacctggagagactgagaagaaaacggagccaattgtcatgctccagtcagcaacagacttgagtatgagaagaaagatctgagacatggtggatcacaagggccaagaacccaagagtgatcaagagaaaactgatgtggaatctttccacagccacgtagccttactgtcacaacctcctttgcccagcatcagcttcagtctctcacaagttaactctgcctgacagaaaagtcctcatccctttgatgcaggacattttcttgacctctttgtgggactggtgacaggggtgccccatttactcagcctgctgagccaattccttgtgggagggagcgcacaggtgagtgagcacgggaaccagccggccactttggcactggcagaagcaaactccgtgcaggccctgtggtggcgtctaggtggggtgcctgccaccccaaggccccagagggcgtgttacaatgctctcatagctctgctgtccgcagacagcagtgtgttatcagctcagtgggccatttgccttgttgcatggggtggctgccccctgccagtgtgggcaagaggtccgtgtgacagccttttgggtacccacacttggtgggtcttgaattcttgtctggtacccaagaagaatgaggtcatgtggacaaactgaaggatggtgaatgtggagaattttattgagcaatgaaagcagctctcagcagagaggggagctggaaaggggatgggaagggcaggtcgctctcccctgaagtcaagtcacctctctgcccctctcctctgcaatcaaatgcctctctctgacatccagctgcttctctcttctaccggctgagtctggggtccttatagggacagaatcgggggcagggcaggccataggtagttttggaaaaggtaacatttgattggtaaaaagacattattcagaaggaaccaatcatgagagagcaggcaaacagggacagaagtactcactttgggccataggttccaggcgtttcagctttaaggtggggctttgacaaggacccgtccctgtctgcctagagcttctctgcctcctgcctttatcaccttgaggctggcattgctccttgaaccagaactcatggtctgaagggttccagtttctatcaattatcatttgtgaccccagccaagatgaatagcagtacctcttttcatagattatgagttctcacagcagcccaaggccttgggatggttaatgtttcaagtcaaattctgaaagcacaggaagctgctggatgttccagttctgcttcaaggatgggagagccttctgacaaattcgcatggcattccaaaaggcagtattttagttgcctggttgaacatgagctttgtaaaggatggtataagatatgatagacaccattttctttgcactgaggcagacaaagatttaatcttcactttgctactttctaacaatatacgcctattttactggactattgtgaaggacaaatgaactaatgtatatttcaataacgaaataatgtacttagtacagtgcctaacacagggtacaccaaataacagcttttgctattagtatagagaatgaaactgcattgtgtcaggtgatgtagggagaggtttaaagtgagcaccactgactgagcaccatttatacacacttgataaatgtttgtaattaagtctaagccttaaaaagcagaaggctaacagtttctctttcctatcctggggctgaaaggggatggtcccagggaaagtgagatatcggctatattgtacattcaccctgattttattagtgacgctgatatggaaagaacttgatacaaagatcattgaaagcgataccgtatctgcaaccaaccccattggccaaaagggcactgaaggacatttactaatgagggtaattaaacatgccttactaaccagcaaaaaaagccctgctgttagcagtgaaagagataaagaaagaacttcactctctgaaaagagactagatatactaaaagtgtctgttcaaccgctaacagccctgtgtggagataacactctcaacagaacacatctaatgctagtttcaaatatgggcccaacctagcctcctgacaatctaagccacagcagaagatccacgaactctaataaatctctgttatacacaaggtaagaaaaaagatatcggagtagttgtttctttttttttctttttcccattttacccccttaggcacctcttagttattttgttaaagaaattagcaacctgtaccttgacatagaacttatacagacagagactccaatcaaagacaggtaagataagaactacccttgtaaaagactactttgctttgttttctttgtaatcagttagctgctggtatggatactttgtcttggcaggaagaataggaatctcagctgagccagtttcaggctaattttctggagactgctgtacagacctgccttgctgtaaacacagtcattacctggcatccagcaaatacttaaactgatctctgagatctacacaacttttaaagctcaataaacaacatgtggttcagtttacaatggaatactattcagaaacagcaaaaattattctttaagactgtccagctaagacatgaagcagatcagaccagcacctcgtcatcaccagccattcacacctgaaggtacacacaggctccataaaaaaaaagcaatggataataaagatcaatgaaaacttgtccagaacacagcatggcaccagtcccatttccaaggcctattattgtagaaagagagtatcttcataaaaattatgaattagattccattgccaaaaattcttacttcacactacaaagaaacagaatttctaacaggcagccacatgtaaattatggaaaatagaacccagtgtatttcataccgctgaacttctcaggaactgaccatgattttaagatttaaagtaagaacatctatttagaaagtggagtacttgtagtaagtacacttaaaaaataagataaatggtttatttttcttaaagaaaaagtaaaacagaatccaccaaaaatctaaaaacaaacaaactttgcagaatatagtcagaaaacttaccctattggtttcaagacactagaaagctacagtaatcgaaacaacatgggattgactcaagaacagacagaacaggtagtaccgcatagaacagcaggaagctaacccacaaagccgcacacacatatcacctgctttatggcaatgtagcaccgcaatgcagtggtaaacatcatctttttaccaaggggtgctggatattcataaagaacatgaagaagtcctgacccatgtcttaaccaaatgaaaaatccattacagataaattatggacttaatatgataggtaaaacaatatagcttcaagaaaataatatatgtagttggggggggggattcattaccttggggtagacattttattttctcattattattatttttctgagtcagggtctctgtggcccagactctggagtgcagtgacataatcacagctcactgcggcctcgacctcccaggctcaagcagtcctcctatctcagcctcccaagtagctgggactataggtatgagctaccatgcctggttaattaacaatttttttttttaagagatgtggtcttactatgttgcccaggctggtcttgaactcctaggcttaagtaatcctcctgctttagcctcccaaagtcctgggattataggtatgaaccactgtgccccactcaaaatttttaaatagaaacatgagcactaaccataatggaaaaaaaatgataaactggacaacataaaaaataataaaaaaacttctgttcacctaaagacccattaagagaataaaaaagctatagaatgagagaatatatttacaatatatttatctaacaaggaacacatatctataatctataaggacctcctacaagtcagtaagaaaaagacaggcaacccaatagaaaagtagacaaacaggctaaacaaacgtcatgaaataacatatcaaaagggtaaaaccgtaggcaggaatatcccaattaaataatgagacatacatcatcaatgtggcctaaattttaaaagactgaaaaaaatccaagtgctaattgaggaagaggatgtggagcaattgggactttcatgtaccacagtggggaagggaggtgtcaattgtatgatcactttggaaaacgtacaggactgtagtcgagctgcacatatgcacactctgtggctcagacattcaactcctgtgcacacaccagaaaatgcaccagaacatatgcacacaaatgttcataacagttttattcataataacccaactggaaaacctcaagtgcccaagtgaagtaggatggatacataaaatgtagttaattcttccaacagaatactattcagcagtgacaaaaatgaacgacttctacacatgaatctcacaggtacaatgttgagtaatagaagccagatgcacagagtgccgactgtttgatatccatttacataaaagtcaaaaacagggggtgctaatctatggtgacagaaataaaaaagagtggttactttggacagagggcaaaccacctgtttgtgggtataagggaagcttctagggtgctggaaatgttctttgttggtgtgagttgtagttacactcttaaccctacagaaagcatctgcttctggttgggataaagtcatgagaccattattcaaactctaatgccaagaacaaaccagctaagttcccaatcaaagctttttgaaaccataagatagcagagaacaaaataaagcctaactgaatgaaaatatagaatcagacaagccctttctaggagaagatccacagctgcttttatccctgaaggaagagtgagaggaggaagacagaactctgcctttaaaaaccgtaaggataaatcacccaaactttgaaggaaacttaagtcaccgtgagtcaacaggctggatgaattcacatcctcagggagtctgcacccaccactgacgctttctcatgggcctttacctagtgtatgagggggtaaaccaaaggttgggtgcagcgctgaagagctgtcatgctaaggaagaagttccaaaaggtggattgggatgttaaagcacagacaagacaccgtttaggaatctgttgtaggatggaggtaagtgaaggtagaggccttggaaatgaggataagtgaatggatttcatgaaccagtttagagatagaggagaaagagccttggtgtggcactcctacatcacatattttattctgttatgaggttaaaaattagatgcataaaaaccccattatataattttgtcacaactgtctagaatgagaactgcatggagaaatcacggaagctcttggtctagactaatatgctatcaaagaacccagaggctacaaaaagataccacaggaagattggtaccaaattaaaaaaattagccccagagtacgatacagatagaattccagaaaaatctttggactcgtggggaagtagatatgaagcacatttatgtccaagagtttggctggggtcaaaaaaaaaaaaaaaaaaaccccaaaagccaaaagccaacaagcttcagagattaggtaaagaggaagttgtagatttatgatattattttaacaaatcttacaatagatgagttttaccacttaatctcaagcatcaatctaagtggataaagtcaacaaataaaataagtctttcctaacataactataacaatacggccatattaaacaatttattggactggtggggaaaggagaggaagattcagattaggtgacattaaataccccacggtccagtccctatacgagaattttcttggttcttgcctctgagcctccaattttgggcagcatccagttactaccggtggtcttacagttattactacttttactgaagcctaattgagctgggttttaggtttatgcctttgtaaagtatgcaaaattacacaaaaaataaaatactggaagtagacgatttatgagagaatgtgatcaatatgtttgttgatcttgaaaatagcctaggaaagtgaaaggatagattaattaaagaattaagccaaacatgaattttaatattcagagacatttataagcaaaacaccctaaggtatatttatagagccactttaattaggcagtattcaaaacagctttacacatgagtcaagttttcaacgtactttaaatatgcatctcttctaaatgagagagctggggtattgtaaaccaagcatggaacctggaatcagaacatgaggccttgagtcctggctctgtgggttacaaactctgaaagtaaatcatgcaacttttttcaaatgtaaaatggaaaactctaaggggctgccacaaagtttatacaataatggatgtaaatgtgctttgtaaaatgaaaagtgatatatcatttcctcaaaggagtgaagcaagggaaaaatatgttcatgaaaatttgcttttattcaattagcaggcttatcaataatatctgcatatatacttaagagagtacattttaacttactgatactgatgcaaaaccaaagaatcctgggttctctttcagactgttatccccgacatttgcattagccagtagaaatcagataactatcaaatgtatctaagaattacctgtcatagtgatttctcatggattacattaatatcgcccatataatttcaagagaaactgtatcagaatagtttagcctgtgaattcagagaaacctgaatgcaaactctgcatctattacttcctaagtgcatgattttgtagaatctaaccatccttaacttggttttataccacaaaagtggagatgttcacagtactagtatcacaagtttcaaggatttaagagagagcagcacctaatgtacttaacagaatgcctgacatgtagtatagagcttacagatgtttgctatgataacattgaaaatgttgcttcagagcagatggagatttttgttttccatttatggtcattctcatccttgaagaggtatgcaatcccatacgcacatagtgatataggttcacattagttaatggccagaaggagattctgacatctattgaataaccacctcaagccaggaactatgacagacactataaatacaaagatgaactagatgttaactctaacttcaaatatttcacaagaatgtaagactcttaaggatagatatttgttaactctgcccatggaggtatcttcagggattaaaatagtgcctgaaatattggatttccttggtaaatacttggggaataaatagtcttagtggtttttctaccatacatataattatccagatcccaaagtagaagatgcttttaatatattttggatatccagtgaagagaaactgtaaagtatatttatcattacacagatataactagaattgggtttaaagcctttgaaacaaggtgttttttttttttttacaaaataaatacaatgacatttggtactttgaaaaaaaatttgagaaatattcaacacacataggaaacaatttaccaaatgactgataacaggagggaaacctgataccattttcttactgatgtattaacacttcccactattaaatttatacgatcataaaatttatttttaaagatttaaagcactgctcacctggtcttcttctcctccaccttcttcatcatattttaaaatattatctcttacatcatcttctggatcaattaaaagttgtttggcctggcgttctttatcccggcgtttcatccataccacaaacatcagcacaaggactaggtagaaaaatagtaaaaatacataatattgtcatttttaaagcctggcctatttagtcacagtattcagtactaataatttatacttatatgaactgaaggcctgaaatgcgtctttcactctactatctatttctggcctcacattaagagagacaagacaaagcaagctaaagcactgggtttagagtatgaaggcctgggctcccatccctggtgccctctgcaaactcacttgagaggtgatcatccttgttctcagttttaccatccatatatggggacagtaactttttctatcttccctttggcttgctagaggatagttgcccttcatagggccttgtaaattctagagacacaaaacagcagtaaggtgttacttgctgtgttatttcggttggtcagtcatcattacactccgaaattcacagaagaaaacacttatccaggaggacaaagcttgcccagatgacctgggtagtaaattggaactaagtcaggaatcagatcttgaggttttgactcccagaggccggtgcatgtttcagctaagaaagctaggggattcctttgaacactgaaataatattagactttcatgttttacactttgcgccaggtctagaaccataaattttccagtgagttgatgttaaaatcagcaccaattcagtttccttcaaaatgtcagttacttcttcattgccataatccatcatgcctaagtctttcttgataacattggcatctatgccacatttcagttgaaatggaaacatatccctaggtgcacatctaggaacaaattctatctaaaatctgggggtatcagtttacatcctgaagcaaaagatttaatgactcctattggagcacatttttattattggccataaaagtaaatatcctccttttaaagccagataacatgatctcatttgctattgttccagggctaaatctagcaagtggattattagtatagcatgcaggtttcaaattatagccaaagtagtctccacacaggaagtaaaaaatgcttagacttctatagtaattgcttagaataaagggacagaattctaaattaccagaacacttgtaaatggagaaaacataaaagaaatggccaacattttcaagaaagtgattggtgcatagcatgatcgcacaataaactaagtcctgctgctattcacaataaaacacagggcccaggcaatttattcttttaacctgcatgcttagaagtggttcctaaagtactttccagtggttaattttttgcattccattgaaccaaagattgcaaagtaccttaaaaagaagcaattccttaatctacacttactctaaagacagacaatctactgagctgtgtaatcatttctattatcaaatgtcctgtatgtgaagtacaatctctcactcttctacacagcccttcagaaacaaataccttgatcctcgcatgactggagcacgttgctgactgtgctttatatgaaggaaggtgaaggaaagcaatatacttattttcctaaatcatcaactacgtgccataaattcatactcaaatcataagaaaagtgctcaaacttgggattgtttaatgtttttctatgaaaagcgtttactacagctccctaagcaataagcatgagaaagggtaagagggcaaggaagaggcatgctgaggcagcttgttgcaaacatcaagtgcttgaaacaatgctctggggttttttcattctaaagtggacttggtcgacccatatatgattggcgaggaaatgctgaaaggtcaaagggttgttagactactttgccaggcaatagcaacacatgactttgctgaacatcctagaagccaagagaactgaaatctaaaagacaataaaagtactcactaagcaggatgatgatgcagagcaggatggcaatgatggcaccggtgccaagccccgcacccacaatcctgtccacatctgtgcagtccccgttggagtcacactggcaaaccttcacacgcaggatggaaatatttgatttgggaggattacccgaatctgtgattatgatgggaacttcatagataccagcttcaagaaattttatctttaaattaagctgagcaaaatcacctatatgaaaaaggaaaaacatagtttgataggtaatacttaaagcgataaaaaaacacatagcattgttcaggatgtatttactacctaatagtacacataaagcggattacaactatgctgcattctaaatacttttttggccgtaaaggcctttaatatcttacttaaactttaagtagcttttaaaatatgtataatgagaagattatgaagcacataaaattaacttttcatgccaggcttcaaaatctctcaactgcacatatattcaaataattaacctgttcttaccattaagccgagtgatggtccaatttctcttaatagtcactggagataaaggaagatcaaaagcaaatggtccagcatttggatcaatgtcataatcaagtgctgtaatattaattgaattggggtctggagtttcgcaagtctctgcctcttgaggtaacacttgaggggcattgtcattaatatcaagtaaatagatctgcagcgttcctgttccactcataggaggaattcctgaaaagagagaaaaatcacaaatgatgctgaacagttctctccaatgagcctcaattatggtgaaattctcaaagcttctaaccttctggcccttttaactgtgtaaccttggaaaaacatagttgctatggcatctgggcagaccgtttccagaacaaagccccttcttgcttccctgctagaatgaccctgagctgccactgctgctctgcaggagctgagcaaggtgacgaagaatgcccctgtgatggaatcccgtaccctccctgcccctcctgcccattattcagggcttgcgtagaccatgctcctccaggcactgtgaggagtgttggagatgcaaacacagggctcgtgatcctgttgacactattctttttatggagaaccaagacatatgcatgaaagaacataagaatgcttttaacgctctaacacagctttgacttaacgcaacagtctacagacaagtgatacagaaccacagacctcaactcaggaaggaacatcatgcagaagagaaatgatatttactaaccaaccaactacctgcttgagatcatattaggctgctctatgtacactctttgattgtaatcctatgacacaggtttacacagatgaacctgagtctgtaaactgctcatggccacacactcttgtaagtggtggagttgctactaaatattggtcggcctgacctcaaacccattctcattccactataataaaatgctgtctccaccactttgtgtgataatttaatctggtgatttgcttctgctacattgtaaatattcacacacacacaaatatataatatgtttatgaatattttataaataatgctgtacactgaagaccagagacttaagcgacctgccaaaggtcatgcaactaggaaggtgcacatacatacacaatcctggggagggaataaggaggaatgtttaccaacttctatgaggaatatgatggttctaagagcagggagagttgaactggaagggtatagtggctgttacaatattccaacaccaccatgaccactatgatactcaacagtttgagggacttcgaaatttactatcacatttaatattactatacttttataacaactatatagaatatgtaggtagtgaaacaatttatcaataatgaaactaaggcatacagagtataagagcttgactaatcattaacgaacagagctggggctccaagtctagccttgtggcttaaaggaaagtgcaattgcaaagcatcacagctacatacattataacaggtcacttctctctcttatcaaaagccctttcaattagaaaacaatccttcctggtgaatgagaaatctggttgtaactcacaaccaatatacatacatacatacatacatataattttatggctctttagatcttaacataatgattcaagatgcattactttcagtaccactgtagaagaaagccacggtttatggcaaaaaagcataaaacaggtactaatgacatgctttgatgtacaatggcaaaagctattcctacaaagttccaacactaaatatttaaacaagaggtcccatattaaaaaggataagaaatatttctttggttggtcactacatagattttctacagatagtaatctcattaaatcttagtatacagatttagaaaggttcactgacattattcttaaagtattgatatgtcttattttagtaatgcaaaatattttacaatttgaaaattgcaaacaccaacttcaaccaccaaattgaagcctgctattttttattaagtaccaacattcatattcatagtttaatactgaaaatattttaaaatatagttgtggttcagttttgaaactattaatacgcaataggaatacttagttgagtggttagttcgtgtcagccactgtttcaaatgcttcatatatatgtagaagtcattacattttagttaaaacactgagttaggtgctgatacgtatctatttaacaaaaaaaggaaacagatatatttaaaacctcatggcaatcccacagattcaaagtgggaaagccggagtctgcacctgggggtcctgtagaactccagagcttgaagtctgaaacacacatcgtactgagagctaacgaagcaaaataagcccctcatcaggtttacaaaagtcccctttatattacatatctgaaaaaagtccttatctattaatcttaaccaatgagaaaccagcagagactcagaaaggaaaaaaaggtgctacatatgtattctaaaacccataccctgaagctcactactcacttatctcaatttatgcacaaaattaagtttcctagcccatggcagacagaggcagagaattataaaaaggaagactgatagagatgcacatatgaaaggcaacagagtgactagaagacatataaaaagagccactgaaaaaacccagtgtctagggccactgaggatggacttaaggcatcaacatgtgacaggacaataagataacaaaggtatgtctacatgaacgatggatggacatcgagaacagtcattgcaaagacagtgaaggatgttccagaacacctgtctgaaatgataaataaaagctggacctcggaattataaaagtcagttttccaggcaattgagttttgtagaaaactttaattcctgagcatgcatgatgaggatctactgtctttcatcaacatacaagaaaaaacagcgaacataccattgtcagaagcaaggaaagtagcattatatatattgtttttcacatttggtgattctcggtccaaaacagcaattgtagttatttgtccattcacaggatctatttttagccaattggcaggatcagataatttagtgtatctacaaaatgaaagtgaagtttaatttctttttatgaaactttaaaaaaacatattttacaggtttagttccaaatgcaactggctcattaacttgcatttctgtagatgatggctggacatacagctttaacaggaaaaagtatttttgtgacagtggtattgggaggcacataaaggttgtgtttggtcaggcatgtaggaaacattctacaggtgtctgagggacaagactaggtgcacagtctccctaatgtgggctaaagcagattggaaagttatcattttaggttcttgtccacttcaacagatatcaatggttcaggtaaaatagcttgaatatagtttctagataagcagtagtctcaatgtacaggagttaagagaaattataatagaaattgaatactgcatcacagaacactcctaaaacattttaacactttatcatggccaacatgaagccacactggagagaccaccataatcccattcctacttgaatctttcacactgggccaagcctcagatctatacctttgcaaagaaagtcctacagtcttgagtctgaattggcagatttatcagcttaaattcctttttaaaatttggagtggggattaacttttaaagattagataaccagttggattggaaaaggtatgctatgtttggaaaggtacaagttgtaggatttcaatacatctattaactggctatttattaatagttatcttgatttcagtgaatagagaaatggagaacatttaacatttaataaaagataacaatagaaagttatcttttagcagcagttctgtaagaagtttaatgaaatataagttcattttaaaaatgatcatcaccagctttggagaacagtcgcatggggtgtgctctggcaaccatccactccctcatcagaaaggataaattacattttgctgagtttggaaatctttacagataggtttcataagtccaataactactgtacaggtaaggaatgaaaataattaactcttagatcctggttttggcataagctttctttccttcatgatgcatggaggagagataaatgttataagcctctgaaagttccctgcggaacctttttgtgatgtttggcataaaggcacaggctaaataattttaaagtattttttaagtaaaaatggcagatacagagaaacaagaacagctttttcttcaaatagtaaatccattttaatatggatacagatatctatttatatctaatatagtcattgacttactgagaagaaaattcaaagaattttaaattatcttttaataagtagttttgattgcaatgaaaatttctactcaaatagtgaattagataaattttatgcacagcatagaacataagtaagctacaaaaacactacaaacagcatttcatacctaatattttgctgcatatatcgatctgggtcctgagcagtgaatgttgtcaacatggtaccggcatgaagcccttcttcttggcgaatgatcttaggattgggggcaaaataagggttttcatttacgtcaataactgtaacagacacggttgcagttgactgaggggggtgctgaattcccttggctaatggcacttgattttctgcagcaacagtaaggacaaacatcctatttgtttcaaagtcgattggctggaaaataaaagggaagccatatttttgcaggaaataagaatgcttgcattctgtagtttattcctctatcaactccatttccaaaaaattaatttcttcattcactacataacaaggttcctctcaagtttctggaaaacatgcattagcatggtcacttatcaaaatatttatcccaatttaacctaattataaatcttgagtacttaaaagatttatgttcacaaaacagtgcacatgattactgcacagatttatttatttaggtacatctaaaaacttgattattcttaagaatagcattgttgactaaaaatactaaataatataaagtcaagtgagaacatgatggtctaaatgtatactctcaaacattagtacaaagatcactcctcacccaggaaagctttcaccagtctatgatgaattgaagaaaacaaaccaaaaatcagaaaatgtaatttttaaatacagctaaacttatttgatttaaaagtacctttcataatttgaagtacacattttgcagtacaaacatgtatacataatcgcacacacaccttttaaaaataatactgttggtaggtggaagatatttttcttttcctcttagcaaactaaaactctgctgtcttctggaatatttctggatattttattggtctgtaaaacccccaaatttaagaaaaacactctagataaatgcaatgcacaaataacccttcatgtaaatactaacttccaaagttcactgaatcttgctgtcactagaaatattaccaggagtcaaatgactagactggacattcactcttaattttccttgttcacctgcgaatggatgtgcaaataagcattactgtgcagtaataacaggaaaaacaagagcattaagatctcttaggctcataattggtagcctaagaatgatcgagaggtgacgctcataagaaagcttcattatcagcagaaactgcaccagtttcgtaccctagaccaccttttaaaaatcttcaaacacatctttttttctctctaaatccccaattcaacattcctttctctagtattttaagcaagacagaaaaaaagccagaaagttaagactgcaatatttagagtgatttcactagccacacgaaaccttcccctgatgtaacatttatgctaaggggtatatgcacagttcaaagtcctttaatgtgtatgaagctcatttatctctcagaacactatgactaacatactgttatcagcccctttctgcataagaaacctagaatttacagtggttaaatagttggccatgatcacacagatatcaggagcagagctgggactctaacacagacagcagactcaagttggtgcttttgatcactatgttccttctgagagtttccattcccattctattctactcccgcatctgcataattattggcaactggcactttagcacatctttctatgtaaggtcaatatttaggttcacttacaaatcaagagtgcttaagtgggaggcaaagaagtaaatctctttactgggtggctaaaaggaagggatgttcactttaacaggcttttccattatagctacgcatttattattcttgaagaacatccccttggcttctagcatgcaactgttttgtttggttcctttttgaccataagatcagaagaatacatttcttaacgtctcggaaatagcatttaaaaacagccatgcaaatgcaagagctttctaaaatgcaggctttcttcttgcctactcattacatttttcttctatggcttttctggtttgttcactatctgccaatattctaatagctgtagacatgaaaatagcagctgtgaggcatcattcttaatagctatcaatggtgatcaaaatttcagaatgtgatatatcatgaatatatcaactacactaacagttaatgttgttcaggccagtcctatcctcagattggtaaaaactgtccaaactgattcaaaaacaatcatcaaaactctcactcaaaactctcattcaaaaactctcacaaaactctcatcataaaactcattcaaaaaccctcacatcagtgatgatgtgagagtactgatgttggccttagcctcagcataaattaaacagtaagatataacctcccaaatatatatcagacccacatctggagatgtctgaaagaaaaacgtcctaagtttccattgcaaaacaatgagtgggggacatatattggtccttgctgagcagctgttggagagatcagtggcccgaggaacacttactttgaccacggtgactaacccgtcgttgctgtttgggtcggtctggatggcgaaccgtccagtaggatctccgccactgattctgtacactgcgttccaggctggtgtatggggttgatccttatcggtcacagttagattagctactatgatgtctaccctgttctcaggaacttcaccataaaactgcgagaaagacaaacctcagtcagaggaggggcatggaccactgaaggacaacttgtcttgatgaccacaccgtccgattttactgccccattagatttttattatctacactaaatgaggagactgataatgcaggtaatcacagcatttatgtctgactttaaaaatactgtaacatttttcagtagtccaatttttttccaaattaccttacagtttcattaatattaaaatcagcatccatttgtgagtctctgggtgattatggtggggtgggggaaagaacttgtctgtgcaaaatgattttactccagatatggataattatatgctgacaaagtagcataaatcagtcatgcagctcatgcacctgaaaatattcataagcattttgttgtaacagcacagtctttttaggacgtgttttccaggcagcttattttaacaactttaacagtggacttgaagactacgaagaaacaaattacttggatgcctcacgtaaggccctgatgacagaaatgtccgagttagcagccatgctactattaggtgaagcaagttccacctctatttaacacatttattattcatgaccaaccttctcagtaacgaactacagacccaaagttgtgtgagtgacaggctgtactcaccgtcatggcagtaaactctggaggattgtcattgacatctgtcactgtgatgacggccgtggctgtgtttgaaaggccatatgtgggattgccttccatgtctgtagcttgaattattaacgtatactgttgcactttctaaaaagacataaagataagaacttaaatgaaactaattcctcaagaagacataacagttgttctgtaaacggctctttataatgcaaggagagcatggcatcattcattctgattaacatgacttgaaatttcgcaagtggagtttcctttaacttatgaagcacaggtctggtccttgtctagagagatttaactgtgtatattcacctctactggcagaaaggaatgcactgcagatgtgtgaaattcacagctaagctgaaacctccatctggttccaacttttgcctttcttcacttcacgagattgtgatcaagcattcaagtcatttggttcgtatttactttcttctatgttaatttctacccagtttaggatactaaaaacaatgaagaatctcaagacagggagaagaacacatacataattcacaaagtatataagctttccttttatatgttcttacatatattctattattacagggtagatgcaatatttccccttaaattctattgatacatatgattcaaaaccatatagaagagatatacagtattcttaaacaaagtcaaaacttgaagggtttccgtttatttccatagtcttctaacagggcatatatttgataactgcatattcaatggattaggatttgggtataacactcattgtgtccactgctttaagcacagacctacaatggatataaatattgatacatttacatgtagatgattattattagacaggcatccactactttcaaattccaggttgactgttttaaaagagccaaattaagctataatatatctaagagaaaatgctgagattgagaagtcaggcatttgctgagtaagttttatattaggaaaacctaactttaaacaatatctaaaatcatttggaatctctgtggaaatttgcagatagatcaaaaacagtgatcattttcataaatgttaaaacattctgaacaacaaaatccgctacatacaaaaataaactgtcactgcaaagtgcagttttccctgtttctaaatatagctaacattatgaatggccattcttaagggatttctggagcttagatagaacacacacaaattgtagcttttgatttagttgtcagggggaggggcaaagaaaagaaaggagtaggaaggaaagccaaaccgcccacactagattctaagtctctgtctgtccacccaaatgccaatctctagcagttatttatttcagttattttttgtcttccaaaaagagaaaatgttacactattttgaattaaaaaacacacacgcagtaagaaataatgttggttgagtcatttaattttttcttaacccacagtacctcactataatgttaacataggctaagggctaggtgcggtggctcacgcctgtaatctcagcactttgggaggtcgaggcaggcggatcatgaggtcaggagttcaagactagtctggccaacatagtgaaaccccgtctctattaaaaatacacaaaaaattagccaggcgtggtggtgggcgcctgaaatcccagctactcgggaggctgaggcaggaaaatcacgtgaacccaggaggcggaggttgcagtgagccgagatcgtgccactgtgctccagcctgggcgacagaatgagactccatctcaaaaaaaaaaaaaaaaaaaaaatgttaacataggctataatacttcttcagttgctttccttccccaattagaagtgtcacttcagcttaatgctttcatggttagtgagagaatttcgcaggacattcagttcagcctcccagctgaaaaccatgaaaataaaaacttttatgacttttgaaatgtcagttttgttagctgctatttgcagaaacagatgaacattctcaaaaagagagaaaaaaaggaagcttatttcttaagaagttaactcacataggtattacatgaaagtatagttatttcctaatgtctagtctacaaaaatctttagaattatgtaagcataatacatccaataattttccattgatctgcaatattggaattagtagctaatacttgaaatttcttattgctgcaagctagtctggaaattttaaattacaaaaggacacttgttatttccaaagtacaatatctcttcaaataaaaaaaaaattccacttggtaaatagtaaataatgtcatctccattttcaaatgccagattgctaaaacattcttatatttagtaaggaaggcttgatagcctgtgttttagacaactgaactgcttagagcttcttgcctaatttggtcattgggcatctggctgtgaatgactgacatttagattccgttaagtgttcgacttcccactctcatagtacctcagctgatcaaggggattctgcttgaaaacttctcctcccttcctgctctatatggaataaaatccaaaatcatctgcttgctgtcaatccttccctctccgaaactcgcctattttacaaaagtgattcctcccattcgcttaccccacacctggagctgttttgcatttatcttcaaatgccctgtcatgatcctgtgtcattccatttggcattctcctctgcctagacaagtggatgttacacagagtgaacattttgggttgttacaactaagcactccttagttgtgacaaccaaactcagtaccgacatctaatgggtagaggccaaggatgctgctaaacagcctatgatgcacaagacaggcctcataaccaagtaaaaatgtcatagtgtcctggctgagaaacccttgcctagaataccattcccttcattccaagcctggctaacatgcagcttacaagtcactttggagacgacttctgaaagttcttgaggaagagctgtttgtgtcctcaggacagagcccttacaacacaccccatcactgtttatagtttatatggctgttatcagtcgtatgtctgtatctgcctcactgtgcatgtgtgtgcatacagagacacagacacacacacacgtgtcccaagggcccttgctttgttgatgcttgtgccactggcatatatggcacagtgcctgactcagagtaagaattccacaaatgcttctgacttggtggatggatgggtgaatgcataagaaaccttgggttttgcatgatcttatctcaggtaaagaaaaagccatcttctattcacatggatagctataatttacttcttaaaacccatactgggagcataaactagctcaccttttcccaaaaccacagtgattcatgcacagtagtcccaattctaacatttcctcatactatgagtcacttcctatttatattgacattaatttccctttttaaagcttaatttattgtaaaagtcccataaatggaaagctagcatcagttatcataaatatgacagtaaaaaataaacatgatgaaattcttggattctggcagtctctacttgatgaagtagcacgtgaaaggctgtgtccgcttgctgtcctagaggcttctcagcatttaccaattaaaatcttatgcacgtgcagcacaattttgaaacactgagtgacatcagtgaatgaggaggtgagaacattcagtcattcatacagcagacatttaatgaaatgtcttcaaaatgccaggcaatggagtatttacttgggtaaaacagtgaccaaaacgagatacagccttgctttcactaagtgatggaggcagagagtaaaggatcacaggaccatatagagccaccaaatgcatgagtgcaagtctagaaatggtaggaagaagtaatatgaagaaccttcaatagtgcataccaactatcaggttggtgcaaaagtaactgcagtttttgccattacttttaatgtcattactttgagtaaaaagagaagaacttgatgactaaacagattgcaggtagagggacagcagggcatgggaaaggcaattaaacgatgaccttgggagactgaggagaaggtcctggtcacgtgaaataggaaattcatcataaatcacgggtttcaggagatgacagatttgcctctagataaattgggttggggacagagagttgaataacaatgtcaccgaaacttaggagggaagtatagatttgtgactctgttcaaattctttttttttttgagactgagtctcactctgtcgcccaggctggagtgcagtggcacaatctcggctcactgcaagctctgcctcccgggttcacgccattctcctgcctcagcctcccgagtagctgggactacaggcgcccgcaaccacgcctggctaattttttgtatttttagtagggatggggtttcaccgtgttagccaggatggtctccatctcctgacctcgtgatccgcccaccttggcctcccaaagtgctgggattacaggtgtgagccaccactcctggccaactctgttcaaattcttaactgctaagccccacttccctcatctgtgaaatgggactaaaagtaccatctaccttataaatgtggtctttcttttgtatacatattacatgctggcactgttccaagggccttgatttaaaaacaaaaaacaacttttattgagtttgagcactatgtgcccagcacagtgctatgcactatgcattatttcagttagtcctcacaataatcctatgaggcaggtggggttttgaaaccccattttacagatgaggaaatgggcttaggaaggtaaaggagcttgccatggacacccagccataagaggcagataatagacttgaactcaggtatggtcaagaatctgtaccgttaaccaatccactacgtgagtgccctctaagatggtaagagtactgcacacatgcagcatgtgcacaggtcaagcgggggaagcaggtggaaagccggacttcaagtggacaaggaaggagtggaagtattttttgcttgtttgttcttgagacagggtctcattctgtcacacaggctggactgcagtggcacgattatggctcactgcagccttgaccacccagactcaggtgacaggtgatcctcttaccttagcctcctgaatagctgggattacaggcatgcaccaccacgcctggctaattttttgtatttttagtagagacagggtttcgccatgtggcccaggctggtctcaaactcctaggctcaactgatctgcctgccttgagtgctgggtgccccttggagaagactggtgtggaactcaggtaaagtatagtaacttaaacatttctttacaattcatgttcagggtaatgagacaaggaatatctgccccactggatgttgagaatgggaatccagatatactttctgtgtaacacagtctatatagaggtatgcagagactactgtgggtgatcagagaagggattgagaactggctctcagagggtaaggattagcctgttatgtaggagaacaatatttaggcagaggaaacgggaacagaagaatagaaaacttcctatttgcacaaggactgtgtgtggttcaatgagtggttgggcatcatttgtatgtgaaaggcaagtaattctggggggttaggttaaggagggttttggggccaaggtcacagagggtctggaatgcactattaaaaagctctaacttcatcctatagggcatggagagctatgctaccacagtggagacccagcaggtttgtagattatgaagcaacctgtagaggaaggaagattgaagacaacagaaaacaggagaacaccccttcaggatggaactaggagttgaaggcacaaacagaaagattattaggtttggaaaacaggaagtatttctttcatcttatgaagaggagtaaaggtgatagatagtgctcaaccaggagatgctgctgttgctattcatgatggcagtggggaaaacaatagctcagatttattaggcactgtgctgaatgccttttaaaacgcttttaaatttatatatatatacatatatacatatatatatgtgtgtgtgtgtatatatatgtatatatgtgtgtgtgtttgtgtatatatatatacattttttttgagacagggtgatatggtttggctctgtgtccccacccaaatctcaccttgaattgtaatcctcataatacccatgtgtcaagggcggaaccgggtggaggtaactgaatcatgggggcagtttcccccatactgttctcatgataatgcatgagtctcacaagatctgatggttttataagcgtctggcatttcccctgcttgcactcttcatttctctccttccgccctgtgaagaggtgccttctgccatgattgtaggcttcctgaggcctccccagccatgcggaactgtgagccaattaaacctcttttctttataaattatccagtctcaggtatttctttatagcagtgtgagaacagactaatacagagggtctcactctgccactcaggctgcagtgcagtggtgcaatcacggctcactgcagccttgacctcccaggctcaggtgattctcccgctcagcctcccaagtggctgggactacaggtgcacaccaccatgccagctaatttttgtattttttgtagagatggggtttcgccatgttgtccaggcaggtcttgaacttctgggctcaagccatccacccacctcaacctcccaaaatgctgtgattacaggtatgagccaccgtgcctggcctgaatgctttatgtgtcatgttacataattcttaaaactgtcccatgaggtaggtaatactattatccccatttatggatgcaggagctgaggtttcaggttaatacactgaaagtcaaacagcccatactaagcagagccagagttcaaacctggggggagcaggggtgagtctttgacagtcctgcacaaaaagggcagaaaatggacatgaaatggaaaggccaggaatactaccagcaagtaatgtcacaagaggacagatgggaacaaatgctgaagactgggtaatgtggcaaatacacctttaggtctggagaagctgaagaattaaaactaaatttttaaaacctgaagattaaacaaaaataaaaagctgaatctcactaagcatttcaatgattaggagttcaatcacttaaaggtgtcatacatcctgagagcacgagaacacacattacttttgacagaaaggaaactgtgaattctaatagaaataaaagaatttcaagtctgcacgaggcctgaaaaagtcaaagtaatttatccctggcctcaggaagaattatcataaaccatccgagatagatgcattttttctatgttaaatgactttcagaaaaggaaggttttccataattttccctagtaactcattgttgtgtttaataatttcactgtcaagaagctatttctcatactgtatctaacccataattctatagtttcaaatccatttccacattagtttaatcaaggggtagtgaacagcttctctatccactggaagataaacttaatgacaattatggcctcacgtcaggctttcatcctctaaacgaaatacagtctgatttttaaacatggttggtctgttttagtaaaaagtatctttaattttccatgcctctttctttccataaaacatccagtctaaatgagataggaatattaccatatgaaaacaggatgaagtctcatttctgtatctcacaatgacaatgtgaatgaaagagaaatattaggattatgaaatgaactaaatctacttggtatatgagcaacctggcactgaagaaagaatactgaaaattaccccatattctctaataaattatggcattcatgctgagtttatcggcatataaaaatagtatttcatatagcaatgaagaggtgaaaatatacacatgttactgaactaaaagtactacttaagaaactaaactgagtccaacaatctctgatgcaaatcatttctagaaaaagaactgttgatgcctacaagtcaataggtacaatgtcataggcatacactaactcctaagtaaggctctcagctcagaataaactaatctttattggctcatattactttattgtagtgcctctagcactattttgtgtgaacaattgcaatagtaatgttttcttctattcaattcaaatgaatgcttctatagcaaataaagtgtcaaaaaacacgaacttctaaaatccttgtcaatgatattttattgcagtgggtataatgtctccttttgacatacataatctaagtctcattacagtaaaagctggctcagccagaaatctacaaagcacagatctccctatgagttggcgctttgatatttcactcaaacaatgattacatgtggtcaaaataatgaccttgagagtctgtaagaaaatagtcaggacagaatcgagaaaggatgaaaaagtttcaccaggagtggggttttcaggaaagaatatgagcagtgcttgaatcagaaccggaagaactagaagatccaagatcaagataaaggtgcaaggcatgcctggccaaggggatcacatgtacaaaaacacaggggtatgtaggagcacagtgggtcgaggcctgtaacactgagatggcccactgggaattaaaagaagtacccattccatctcagactgtgatactgcatagtatttcaatgccttcaacattgcatacattttcaactaaatgttatttcagaaatgtgtttctttgtatttctaactttaaatacttgtgggtagaattaatgcagttactactgcttaaatcttttaagtaaattaatcatagagttaaggggctagttctaataaagaagataatctactatatactatgtcagactattcacaagggctacaaaaaaccaaatcacatacatgttatttgcagccttttaataacacaagcattaacaattatcctaagtttgtgtgcaaattatttggctgtgatttttaattcctcacaaaaacctttgactataaaggaaaatgaggaaatgttaaaaattttaaaaattagataccagagaatattgcttagtcagtgtcacattaaaaactacataggctagcattgatttatccagtatatatacatcatttaaccaatttgaagctctgcagaaaaatatacaacagattacttaatgaaaacgattagcatttgaataacactgtgagtatattgtgatgtggagataaaatgtatgtgatatgatattgtgcacctttaagattaaaaacaaacacaaatagagtttttggttggcttacttctcgatcaagtccagctgccactgtgatgatgtcaccagtctcattgttgattgtaaacatgttgggtgaaggggtgcttggagcctgagacacgattctgtacctcaacatcccattgagggcattgggatcgtcagcatcaattgctgttacggtcatcacatatgttcctagagacagtgtacatggaaaatgaatggttacccttcattccagggaccccaaaatagaaggtatatttattgttttgatatgtcttattttcactttttaaaaacaaatatttaaagtcatttagacttgattaaaaatgctactcataagaacagtacttatttcaaaaaagataaaacctggtctggatctttgaatgaaaaattatacaacatacatatttataaaaactcaatttttccataacttagaagataaattcactttatgattccaaaaaggttcattttagaccttaatttatataaaatgcaaataatgggtaatacagataccattagaaaagtaatttattgccgctgattcttccctctgtcatcttttcttccgttatgcaatgatgtctaaaataacatgctgagtatgattctccccagtgcctgagtcactttccgaatgtaggctgtgtgcagaaagcagcacactccatttcctcaggtcataaggaaccatttcatgcactgctgttttggtacattgcatagagatttggcatcgtggttcattatttcctcagtgattaaaagaacattggaaccaacttagagacttcaatttattagatattttggaaaagaaatcttcaaagcctttgtatcgaattagttcaaactagctagacactctgtaatttagaagtagagtgagaagtagttactgtttagagtggtttgttctgtgggatccatttaaggactgaattatgaaatgtttatctccagtctaccttccttttgaatactcaagttcagttctaccttacagcctgtttacattgggtattctctctccatggtataccttgggttctgaactaactgtgctttggtaatattattcaaatctcatttcagaacttgtccctttaaacgatttacctattttgattatgtgtcatccctacacccttattttttcaaaaccttcagtgtgtacttccttgtttgcatgttttttatttctctcccctactacaatttaagctccaacagggcaggaactagcttgtcaccactgtatccacagtgtcagaacaaggcttaccacacagcatatgctttataaacatttgctgaatgaatgaataaatcatcagaataaaaaggtatctttcagaagtgtgagccaaaatatagatcacaacgcagtttagctcaaaattcatcacaaatcttgcctagaaggatgttttcaaacttatagaagaaccacaagaaatatactcacaatatgtctacttctagcaatagctgacagtcttttatttatgggtggctcatatggaaattcatggtaaaatgcatcataaatatagctttagtggcacattttaaacaatttttgtgaaactattcttgtaaagttggaaataatagagaaaaaaaagaaaataatataaaaaaatttccacagtcccaaaagcccaatgtttgttttctttggaagatttgtctaagacttgtgttttagtaaggaaatgctgaatttgctttaattttactgtattttaaaatactgaagaaagctactctgacgatgtgacttagaaggagtcacagatggctgaacttcctgcacagcccctggtctccctccagctgcccccaccctacccctacatcttttctgaagaggcagagatatgcacttggaccaagaaaatgtatgtgtttgaggcatagttggttatatctataaactgacttatgcataagggagttgcataaactggtgtcaatgacaaaggtattatgcagcacaattttaaatgctgaggcttttaaaaatacaaaacaaaaatacaatagctaattaaatctctctgaacaccacgccatctcaggaagcctggtcaaacacttacttttaccatccctataccaactgattgtcttgtccactggttttctagcggcctggcttttctactgtgactgaagtgtgtcatatttttaatacgagaatctaaaatcttagtcaaataccactttacaatcatgagtggctttccacaagtgctatttctaggccagggcattttccattttgctggttgaagggatagaactgcaggggacacgctggccaccctgaaaataactgtcctgtggagctagagggcagcaatcacagatgttactaagccccttccatgctttcgctatgacttcgccacctagtcccaggaacgtcaagtatctttaaggctttctcactgtgttaaattgctgctacgtctcatacagtcacatctgtacttgataaacagaaagcctctcgtcttctggggctcactttcaagatgcattggctgtatcaactaaagcagaacgaaaggatcctatgtattccacaggacagaatcaaatactgtagtgcatattttttcaaaggtgggaaaaatcagtatgagtaataagaaggattttttttttgtttttctctcttcaattggtttttccctaagttaccttccttctttcccaaaagcattatgaatgaaagaaaaggatccaaaaagcctcatatgatttctccatttcttgctcatataacagggctggttacaccatactttcctcaagtcatcttcaaattattatctttaaacttaccaggctttgatccctcaggaactgtcccattccaaacctggtgtaagaactcaggtctgttgtcattcatgtcaataacattgatgacaatgtcaatggggttctccacttgatttccattaatatctactgcatgtgccctcaactgcaaaagtaattagaaaacaactatttaacagatttatgtctgtgagaagataaatacatcatcataaggctacaaaaatagcaagaataaactcacagctgaaaaacaaaagcggttcttcccatcaaaatttaagttacaccaagtccatataattaggatagatatagtagcaaaaagccatcatttactatatgctaggcattgttctcagagcacaatggattttaactcctttaattcacgtacaaaagagtgaggcagaaattttcagcatttgaagatgaaattgagcctcagaaagactaggaaatttatgaaggtcactgctgtctctgctgacaggacttagatccaaaaccagttgtgtccagctccaaaatcccttccctaaaccagtagagaagacagacttaaggtaattaaaaatgtgaaagtaggccaggcacggtggctcacgcctgtaatcccagcacattgggaggccaaggagggcggatcacctgaggtcaggagtttgagaccagcctggccaacatggcgaaaccccgtctctactaaaaatacaaaaaaaaaaaaattagctgggcctggtggcatatgtctgtaagcccagctacttgggaggctgaggcaagagaatcacttgaacccgaggttgcagtgagccgagattgtgccagtgcactccagcctgggtgacagagtgggactctgtctcaaaaaaaaaaaaaaaaaaaagaagtggaagtagcacaaagtagtgatagagatcaaggcaacagaaaataatctagaaagaagtgtacataggaaattttgacactagtttttttcttttccttaattgtaaaagtcattcacaaacattaaaaatatactagtatatggctgggcacagtgagtagctcatgcctgtaatctcagaactttgggaggctgaagcaggtgaatcacttgaggtcaggagttcgagatcagcctggccaacatggtgaaaacctgtctctactaaaaatacaaaaaattagctgggtgcctgtaatcccagctactcagaggctgaggcaggagaattgcttgaacctgggaggcggcagctgcggtgagctgagatcatgccactgcactccagcctgggcaacagagtgagactccataaaaaaaaaatatatatatatatatatatatatatatacgagtatatacgatagctgttcctctccccagcccagttctcagttttataggtattcttctagaaactttatcttatttttctttttaaacaaaaatattcatttggctacacttggcagaatatcaaaatcctttcctctagaatagattcatttcattctttccaatggctgtttagtgctcctttaattgtttcttttggactggaatgcttctagttttcatgttaagtctgatgcttgccattggttgctgctggatacactctatcaaattaaaaaaagcttcaacatatccttttttaaattcagaggttatttaaacacataaaaacaatgtaaattttaatactgccattcaatacctatagagataattcttttttttcccttggcttatttaatatcttacattacattaatagattcttaatactaaaacaattatacttatatattgaatctgaatactgaaccttaatactttcaattttacaattaattctgttctgttatgggtttttttgtttttgttttttttgtgagatgcagtcttgctctgtcacccaggctggagggtaagagtgcattggcacgatctcggcttaactgcaacctctgcctcccaggttcaagtgattctcccacctcagcctcttgagtagctgggattacaggcgtgcaccactgcaggcagataattttattttttatttttagtatagacagggtttcaccatgttggccaggctggtctggaactcctgacctcaagtgagccaccagccttggcctcccaaattgctaggattccgggcgtgagccaccacacccgactggtattgctcttttaatgtgcaagtagcaagcacttagcaataatttaccccaaaattgacctgaatatactcatttcctgagttttaaccacaggaattcagaaagcgagaattcctataagaagagatccttaagaattttaaattgatcttatttatattcataaattagaaattagtctaagtagaggcaggtatattgtgtgctatctaaaaataagtttccttattaatgctatgttgtctttgtgagacgtttggaagttttacttcttttcctatgtttcagaactatatggaaagcattagaataacctattcctccaatgatattaaaaaatggaatgatgaagaaatcaaggtctttgggaagagaaagtatagagcaatactcagtgcataagacattttaaatttctcatatgcttatttgtctgttagatctaggtgaatctattgaagtttaaaaacttcaataattgttctcattcataggtgggaactgaacaatgagaacacttagacacagggtggagaacatcacacactggggcctgtcgtggggtgggatgaggggggaaggatagcattaggagaaatacctaatgtaaatgatgagttgatgggtgcagcacaccaacatggcacatgtatacatgtgacaaacctgcacgttgtgcacatgtaccctagaacttaaagtataatataaaaaaaaaaaagaaaaaacttcagtaattttaaaagttggtaaaagtacaagaattcaacaaatgtatcagtgggcaaaataagagtctggaaacacatccatgcacatgtgggatgaaagttttagtgattaagtgtagatgatggatcaatggggaaactaattcaatatatgctgttgggacaagtagctagtcataaaggaaaaacaaagtgggtctctccttttattaaaataactctgcagaggttaaaaattcaaatgtaaaaagtaaatacaacaaaaatttggggaactggggagattggtatcctggagtaaaactggggagactggcatcctggagtagggaaggcctttatcaacatctctggaaagacagaatgtatgataaaatttttaaaaatgaattttgcagtgtaaaaacgatgttatactatgggaaaattattgacaatgttagaaataaacaaaaggagaaaatgtaggacaaaccaagcactaacattcctaattagacaaaaggttcttagcaataagaaatcccaaagaaaattcaaaataagaaaggaataggggattcactttgattagaatactatgcattcattaacaatgctgtgacctctatatattttacatgtaacagatttgactccattcatataaatttgttcttacagattcttaaccacatatctgaaagcaagtatcaatatgtaaagagtaatgagattttaggcaatttcacttccttctttctttgttgtgggcactatttgtttttctatgagggcatttatcaattctataaaaacaataacattattaaaataaaccaaaagactacagatacaattcttaaaactctcagtattgaggctttcagactgatataagaggcaatggtaaactctgcagacatttagaactgttaatacacagaattatcagctggttggaatcttacatgaaaccgggctatctgctcgcgatccaggggctttgtcaccgacagctgacccgagatggggttgataatgaagataccagttggaggctggtcagctcctggcccagttacactgtaccgcagtgaaaggtttttatctctatcagacctgatctgaggatcaagaaaacaatgacattaagtgagagactaaatgagctcattatcagagatggggcacatcacacttcatgccctttttcagctacaaacttataccatctctccccagaaaatcactgaaactctcctagtgcctgttcttcctctgcttctcagtgacaggcttcaaaagagatgtcatctatcaccagaaagactggaggcaacattaacatctaaaagaaaactcactaggagcagtgcaaaagttccaaatctacaagtgagagtttttaaacaatcaaactctgtcctgggagtttctaggttagacgatttaacatagtaagagctgtccaatttcattaaaataaacattatttacctttttgcatcagtaacaacaagaattaattgtctatccatagtgtgaaatatactcaaatggaactctaatacagttatggttgaccctgaatgtcagacttctgtacttgcattgtactaacactgttcattgcgcaccaaagctttccgtatcattttaagtgacacctgaaattttcattaataataaagcacaaaagaaagcattttaaaatatatttttatgctcgcaaacattatatcattataggctcactgccttctccaaatacaactactctcaagaaaattaagtcaatgtatgagcagtcacaggagacagaacaggctatggaaggggacgaagggaggcaggtacagagaaaaataagagatccttatgtattaggtacttatacttaatccatcaataaaatctaggttttttttttttgcggggggggaaggagtctcactctgtcgtccaggctggagtgcagtagcatgatctcggctcactgcaagctccacctcccgggttcatgccattctcctgcctcagcctcccgagtagcaccacgcccagctatttttttctgtattttagtacagacggggtttcatcgtgttagtcaggatggtcttgatctcctgacctcgtgatctgcccacctcagccttccaaagtgctgggattacaggtgccctgcctgttttttttttttttaagttaaagcaaaattcccttttctctcaaacttcattaaagtagaaaaagagacagtatcttaatttagagttacattctttgttaaagtgaattataatgtacattaggacagaatatacaacatattttaaagcggcttattttaaaaaaaaggctttcagtaagtatgtgttagaatgctaaaataatcatatacagaaacatttacattttaataagtgggaatacagcagccttgtcttactatacttttgtaataaataatgggttaagtttattaaaatgcaaaaatatctgcattttttttctgtagctgatggtatgtatctagagtaaataactaaaaaaaaaaaacttactcctcagatttgaaagcctatgattttacactgccctggggattctgttaatggtatcagaggtcattcttttctttaaaaaactctcaaatgcatttggtgctggcatttttaacaatgattgccctttattttttctgtggcccaaaaaccatctgtagagggcaaagatcatcacagagagcccagctttcagacagggaagtttaggggtgtgtgtgttatgagagtggaaatggtatggttgggaatatgtgttggctttagggcttgtgtagtcacaaactgaacaagctttctaatccacagtgtgcaggacctacaagtgagctctacttataaataatccaaaaggtaacaaagaaaatgagaagaggctttctacaacactacagaaattctatctttatagaaaaacacttttagtatatacatgtcataaattctactttgtaaaaaaaatagacagaaatatttttaacatacatttgtcttgtggtatgaaaacagttaaaattgtgccaccttaccctgacaagctcttgaggaaaaggtcccctggagttttctggcaagttgattggagggatgacccagtctctcttctgcctttgtaggtggccactgtgcttactgaattgtcttgggaacactatttcttcaacttctgctgactcctttacattaaaatagaagacattcctgagtactaggaaacacattttctgaaagtacatcaatattattgaatacctgaaagcataggaatcacagtttattatgaacaaaaaataagtctggaggcccttttccctggccccctattaaaataacagaaaaataccataaaatttttgggttatactgtgtatctgaaaaattgaattctaaacaatttattatatggcacagctgtgtaaactatttgcagtttctataaacctttttagatagcagttaatattgagcaaaatttaatagtacccttttatatatttctcattagtttaaaccacagttcaggtaatgtgctactgtacattaaatttagatcttgatgtgctaaaatataatttgaattccaagagaagtttaatacatactgctaaggaatgtctcaaatatttatgaccctattatatcccacagaattaatgctgtaattattctaaacctatgtcagccatgatggatgctgcagatgacccactttgcacattaggtattaatctctgctggatgtcaacattttcttctgtttcttcctctatctgtagacattttagccattagcccttgctgcttcagtgcaaatatccaagctagtttgctggaacacagcaaatcaacaacaaaagcatcttttcactccattagttactgggttttcactttatattacccaatgacatgacttccctcaacagttaatagattaacaaattaaatttcacataataaaaccacaacactgaaataagagaaaaatgatatattttcctctgatatattattcatgtttgattgtgggtatgtatatcacatttacaattaaataccagaaatgaatgtgtctgtttttacctctcacagtaaaataagcataaaaaaagtagtagtcatagttccatagttcatggacttcagaatatatgggtgtgtcccatcatatttgttttgaattaactcaaaaaactaaaatattcagaaaatattatcataacgttactgaagttactgtattttatttaaaattccgaacaatgacttatacaaattaagtgctcaataaatatttgttgaattgaactgaatggcactctgttggaaatgtacctcatttattttatcttggctcacagcagcttccaccagagggagtatatcattcctaaaaagtcatgttggtagtataaataattcataccccccaactggattattaagggacaagacaaaaacccaatactcattgccagaaatgttttcctgttactactttaaatctgtacttctcatctaataaatctgactgatgacatcttgtaaagaattgtttattttgtggttttatttaacagcttgtaaaacttctaagaaatttaaaacaaactgcttctaacttaaattataaatctcaaagtataaacaaatctttaaaatacaatttctagttgcttaaaatatatttagtctacgtatcttaagagattacaaacacaacaaaatattattaaaatgaccaaagttgatacaaatgcaaatagtggccatccattaatgtggtctgaagcaaagcatatatttagttcaaactgtataaagctgatttttaaccagccctaaagccatattcggatactataccttcactgactcctcagttaaggttggcttcaggctcaattttactgccacttgccacttttcctgggtctctttgtcttgggcatatatcaggaacttggcatgctcagaagagagtggaaagcttctcacggcatacaccatgccatcttcatccaccttaaaatctgcaggctcactgctctcatattgtacttttctttttccattgcagttgctaaacttcactgtaaaagataagaaataggtcagttattataattataccaaaaaggcaaaaaaaaacccctaatacttaaacctatatcctgcttaggttaaaggataaaaatacagtagcatgaaacacagaagttttatttttattttattatatcaaaagcattttcatactatgaaatgccagatggtagttctgagctgtgccctagcatttccttcttccaaagctttccccttcttttcatacttcctggacactgggtcctcaggtgcacctgcttttcaccctgacacctttcactggtatttcctcccaccctattacaaacttccactcactcttcagtcccaggtctaaagtcactcaaagcagaacaaaccccctttttctcagtcttcatgtagtgatctgagctctgctacctcagtttcttagtcatgtctgacactgcttggaagaggcagtttggggcaaatgttcttagttatcctgcataccctgcatactttctggcacacagtcttaatacataatttcggaacaaatgcttacaggaagaaagcaatgcatttattaatgttgaatgtttactatgctctagaattgtaagaccttatggtaattaacaggtaaataatttacaaatttctattcctcttagtgcttacagtacttccattaagcagtaacatatttaaaaaattttaaacaaataaaaataaaggtgtatcccaaaagaaattttaaattaaaaaaatgatgacaagagtagaagaattcaaaaatgtgtcttatctctatcatacatgcaatgacttcacacttaaaaaaaaaacaactactgctgtcttaaatgctatgacagcttgtctcaacaggtaataaaacaaaaattaaaccatgaacttgtgtagaactagacaaattcaagatgtaataaaataataaaaacaaaaatattctctaaggaagattattcctttaaagtccttaattgttctttctgaagaaaaattctatgggaatagcaagtaaagggatcaaataaaaaatgatttttttatttctgtaaacgtctgatgttatgttctggctataattacataggatactctttggagtgtaattaatagcgacatattacaaaatataatcaaatacaccttgtgcatttctcaaggatctaagtaaagtgtttatgaaccctcccactgcacatataagctgctgacagttcttctgctgtcattagaataaattcactgagacgtgcacacagccacatctaaataacaggcatgcttatttcccttagtaaccataaaatccttgatagaagtcataaaatactttaactactgaatatattattttccacataatgccatctatattatctttcatatttcaatcatttcaaagtgaaaataaaagtatatctcaaactaaatgatgttaagtcaaaatgtttgtctttggagtagaagtatcccaaaagatatttaattactccatcttccatgccccatgatttaaaagtgaaaaatgggaatcttttctacagaacaatgccatctactgctcatctttcattaaagacaaaaaatgaaatgtaaaattgttttttggatccctgctgataaatcaaaacgagacttttgccatatttttgtataaaaagtacttttttatattacaagagggattcatggtccttaaaaacataatctggaatagaaaaattacatactcttctgcacacttttttgttaactgtgatcactctagtattattaattgtcatccataaacacctggactgttacataagcctcctgggtagtcttcccagttcctggtcatggcatgcccactgctagactagacacctgctgtgattttctcctccctgcttaaaatctgtaacattatatgtcagatctttaacctagagtacaatgctctcttaattcttgggtcacctggtctcttcagttttacttacaccactttctaaaacatatactgcctggcgagagaggctgcagtcatcccctacctcgtgctgctccaccccacaggctcaaattcttatctgggacactcccattttccataccaaagccctagggccaggtcatcactttgggggaagagtcgaccatgatgcctttcacaagatttcggcctatgccctcatttggaactgctctaaattttttatttttatttgtatttcctgtccactgaaacacactgatactttatgtttataataataatagttataatgatggttattaataatttcatatgagtggatcttctctccctaagcagactataaactcactttggcttcatgagagttaagtattgcttcttttgtttcttaggacacttgatggtcacaggaacagtataagtgctcattaaatatccactaatatcttacaactttttcaaaaagtaggaaacagatgggaaccttagaagtacacacagcctactatagtaacatctagcaacacaaacaaatgaacaaacaaaacccagggacttcaaaaaattctactttttattaggttgttggtagtagaagaaaatgaattaatacttatggaatgccaggcactgaaaaagacacttcagattatgtcacatgttaaccttaaaaatgactcctgaggtgggaatcattgtttctgttctgcagatgaggatgaaaacttcaagtcatctatgcacatggctgtttgatttccagcggtttactcccatacaaaagtgcaaaagaatctaaactcattacataagtcactcatatctaaagctttaatataaaacaataaaattaacaaaaagatctgaaaaatgcatacgaagagaataatgccaaatttagacctctgagagtaccacagtaaatagcgcattaaaaagaaatctttttctgtgtctattgagatgatcatgttattttttgtttttaattctgtttatatggtgtatcacatttattgacttgcagatgttaaaccattcctgcattcctgatatgaaacccacttgatcatggtggattatctttttgctatgctattgtattctgttatagctagtattttattgatgatttttgcatctatgttcatcattgctctgttgtagttttttgttgttgttcttatgtcccttcctggttagggtgataccggcttcacagaatgatttaggaggaattctctgtttctctatcttgtggaatagtgtcaatagggttggtaccaattctttgaatgtttgataaaattcaactgtgaatctgtctggtccttgaattttttttcttggcaacttttaaattactacttcaatcttgctgtttgttattggtctgttcagagtttctatttcttcctggtttaatctaggagggttgtatacttccaggaatttatccgtctcctgtatatttcattgtttaagcatgtaaaggtgttcatagtagtcttgaatgatcttttgtacttctgtggtattggttgtagtatctcccgtttcgtttctaattgagcttatttggatattctctcttcttttcttggttaatctcgttaacggtctactagttttacttatctttcaaataaccagctttttgtttcatttatcttttgtatcttttttggtttcaactgcatatagttgtgctctgaccttggttatttcttttcttctgctgggtttgtgtttggtttgttcttgtttctctagttccttaaggtgtgaccttaaaaatctggcatccctttatgattaaaaccctcagcaaaattggcatagaagggacataccttaaggtaataaaagccatctatgacaaacccacagctaacattatattgaatggggaaaagttgaaagcattccccctgaacactggaacaagacaaggatgctcactttcaccacttctattcaacacagtactggaagtcctagccggagcaatcagacaagagaaagaaataaagcccatccaaattgataaagaggaagtcaaactgtcgctgtttgctgaagacatgattgtacctagaaaactctaactcatcccaaaagctcctagaactagtaaattcagcaatgtttcaggatacaaaattaatgtacacaaatcagtagttctgttatacaccaacagtgaccaagctgagaatcaaatcaagaactcacccccttttacaatagctacaaaaaaaaaaaaaaggaggcaacagactgctgtaaggaaaactacaaaacactgctgaaaaaaatcacagatgacacaaacaaatggaaacacataccatgctcatggatgggtggaatcgatatcgtgaaaatgaccaatgaccatactgctaaaagcaatctacaaattcaatgcaattcccatcaaaatgccaccattattcttcacagaactggaaaaaccaatactaaaattcacatgggaccaaaaaagagcctacatagccaaagcaagactaagcaaaatgaacaaatctggaggtattacattacttgacctcaaactatactataagtccacagtcaccaaaaaagcatgactggtattaaaataggcatatagaccaatggaacagaaatgtatgaaaaaatgctcaacatcactaattatcagggaaaggtaagtcaaaaccacaatgtaataccacctcactctgtaagaatggccataataaaaaaaataatagatgttggcatggatgtggtgaaaagggaacacttttacactgctggtaggaatggaaactagtataatgactatgaaaaggagtgtggtaattccttaaaaaactaaaagtagatctactatgtgatccagcaaatccacttctgagtatctacccagaggaaaagaagtcattatatgaaaaagatacttgcacacacgtttatatatatatatatatatgtacatatatatgtgtgtgtatatatatatttatttatatatttatatgcacaccacgggatactactcagccataaaaaggaacaaactaatgacatctgcagcaacctgggtggaactggagaccattattcaaagtgatgtaacttcaggaatggaaaactaaaccctatgttctcgctcataagtgggagctaagctgtgagaatgcaaaggtgtaaatgatgcaatggactttggagactcagggaaagggtgggagcagggtgaggaatgaaagactacacactgggtacattgtacactgctcgggtgatgggtgcatccaaatctcagaaatcaccactaaaaaacttattcatggaaccaaacaccacctgttcccccaaaaacctattgtaattttttgaaaagaaagaaaacaagaaatgaagaaagaagaaaggaaggaaggagggaaggcaggaaggaaggaaagaaagagaaaagaaaaaagaaaagaaaaagagaaacaaaggtaggataagggtttgacagacagaagcggggatttcatagtcactggcacttattctattaatgttgtactgttacttatttggattcaggtgtcacagtgcttgagggaggaaagaaggaggactttgcaaaaaacgcatttgcaaaaagtcacttactgcacatcctatgaatgagaagaggttgacctaagagagtctgacactagagaaaacactttagaagaaattgtataaaggtcagtcatttaaagtcaattggtttttctatcacctctgcccctaacctatgaccaatatgaattggtttaatatatctgttattacgattttcagagttttaaaaacaggtgctaattctcatttgctcaaatattaaaatacacaaaatcttttggcattattcaggctctatggaatgtggtgtattacacaattccctttgtatatttaatcagttgggtcaatatcttagataaaactaagtcaactgaaaaagttctccttgatgaaatattagtcctgacttgatcctgtggttttggagcaatccatgtatggtacctggctcatgattatatgcttcttccatgtgaatcatattttattatttgcaagtcacacaaattaaaaagctttcaaatttcaatggataacatgtgaattccatttatcatccactggtcaaggtttattgcctgttgtctggttcacctatgacttagatgcagctaggaatatcttcttgaatttgacaagattcacctctgctctaggaacaaacactaaaacttactcaagttgtttattttacacaaacttaaaagttaataggaaaaaagtggaaaactgttaagttacagaatcttaggtataccagtaatatatacttaatttataagttatatattttttagttcatagcctttcaaaaagactttaaggcttaaaaataaaaatagtacatagaaacgatgtgaaagggagaagatatacatgggacgtgctttatttaaattagcttcaaaaattaaactttgatgatgaaaataaggctaatatcatggacatttgactgctgtaaggagaaatacatagtccactggagccaacctatttctgttattaaaacattttccttatgaatggcaggtacagaactctgagtaccataatgaacaagattttcaacttttatttttcaaaatatgaagcagttttattatttttaatatatgggctttcaagaagagatgatgacaaatttatcttaaaatacacgtttaggagtgaaactattctgtatgatgctatgatggtagatacataacaccatgtttttggcaaaatccatagagctgtgtaacacaaagaatgaaccgtattgcaaactagaaactttagttaataataatgcattgttatttatttgtcaattgtaacaaatataccacactaatgcaggatgttaccaacagagaaaccaagtactgggagagatatatgaaactctgtatttctgctaatataaaactggtccaagaagtaaagtttattaagttgaaaaagtataacatttcttagagatgatggttaaacatgctaattatcagatataacttaaaggaatggatggttgtctcgttgtcaatatccccaatctctcacaaacatgacttccattgaattgcctcaagctggtattagtcagagttggataatataatcgaatcaatacctttatgtaattatcctaagtatgaatatactgagttgatatttaatgaaagttatgctattttaacagacacatataaacagttaaaatttcatttcaaaaacgattttaaaatttggcttgaacatcttttcctgagagaacaaccttccttccatcaacattaaattttcttatgctcagataatctcaagtagaaactccagaatatcataacatgggaaaaaagaaaatacgcttccttagacaactgaaagaacaggcttgatcctctggattaattaagtctatacacgattaaatgattatggcaaaaaaaatcatactattaaacaacaaatttattattagagatattgcatagtttacatatatcagatgtagttattgtgttctagcccacataaaactgtgtgaacatgatgaacataaaattaatcaccagggaaataattattttaaagaaattttttgctctgaaggtaatacctcaaaatgatgttaaccataaaaccataatatccttataaaatattaacaagaaaccacagatcttatatattaaatgtattagcatttaacagcactacataaaccaaatgaatgaaaatgtggaaatactcacatatggtttctaatttttgctcaagtaaacattataccatatttagaaacaattatatgagaacactcaaatattttcatgtctaagtatctttgactttttatttttttccatactaattgctattttcaaaggcattgagaaaatagaaatagtttcacagtgttaacaaaagtttcttttccacagccacagagcagtatttattaatgaatgagatttcaattaatgaaggcattaggagggaggaaggtagggagaaactgccacaacagtaagtgtttcacagtgtttttacatatatattccaatggagaatggtcaccacataacgaatttgctcataaatctgaaaaaaaatctgcttaggtaacattttgccacaatagttcctttctaaatttcatacaggaatgattttttttttctagaataatttagttgccatgtcagggcttaccaatcctttccacacatgtacaacaggacagttttacagacaggttgagaatgtctatacagagcttggtgaaaaaagtcattccattttctttatagcatataattatgataagaaaacaaatacagagtattagggaatatataaactaatatgcataaaatttccaactgaaatattttttaaatctttaatgataaatttgaccttgtgttcacaaaatacctttgtatgtctcctgattgaaatatcaaattcttaattactatcaacgaaaactttattaacaagagttagtgggagtaaagggcagtagagtatttaccactttttctccaaataatagaaagttctttcttgtcatgagccatgagggctaaatttattaaagttcatggtccttcctttacttacaaagacaaatgtaatgtggaaagtcctttggaaatgcaaatgtttttcaaaatttttcctattaagtacttcaaaataatgagtttcaaacattcacagggattgctctaatagttttaatactttttttaggttttcaatataacaccaataacacaagtgaatcatttttatccttttttgaaagtttaacttttgctttatatctataaactctgtgtgtgtaatatttttatatggcctttgcaattttcaattaagttcattcaggtgctccaaaatgtctggtaagcaagctatcttttttcaagtgaataactctccttcaacaaatctaaagagagtaatatttaaacacacaatgtatttttttaattaactcttgaaaaaaggtatctttttagacagcttgtgtacacattggcaaatatcagtaaatgtgataatctaatcccttatctttgaataaagctctagcgatttatttagattcatattttcatatatgaccttatatggaatcacgatttataagcaaacttttatgtacaagagctgctatgtgagtaaaactcatctcagatgaaactcttgatgtttacaccttcatatcatctatagcctttatagcttcatgccactagggccagagcaccagcctcatgtatgaatatgaattattttatttcattttgagacagagtcttgctttgtcacccaggctggaatgcagtggggtgatgttggctcactgcaacctttgcctgccaggctcaagtgattctcttgcttcagcctcccaagtagctgggagtacaggcgtgcaccaccatgcccagctaatttttgttattttttagtaggacagggttttaccatgttggccagggtggtctcaaactcctgggatcaagtgatccacctgccttggcctcccaaagtgttgggattacagaccaactgcacctggccaatatgaatattttaaaacatgaaatatgaatatttatttgcctccctgcatacataatctacagaagtttgttttgatttgctcagaataaataatgatcttcaaggattctaaaaagtctattagcaattatactaatgtcttaacgtcatcaatatacaataactttttaaatttaataatctatttgattaacgttgtcactacgatgtgtgacatgccctcactgcctgttctgatagcattatgctaacacggctccttttctatttcttctgcttcatttgtttccagtctactactgatagtgaacatataggctggtaaaataagaaattccatataacagggaagcactttggcttagtattatatgtgaaaccttgtaaaagatggcttttaaaacttgatcatatagtgctgtatataatctcataaagaaggattcttactttttgtgtaagagaattcaaaactacttacgtctaagatggctgttttggggtagactgccacaaaaatgtgtcatgcaagtagcttcacttcatcacttttgcatgcaaatgaaatgtttactccatgtgtgagaataattataatggcacatgaattccaatttaagagaatcatcattatattgcccaattatcttaataatttgaggggtggattctagtgatgctcagaggttttcagcatttattctcaaaatatcctttgtgttgggaaaataaacatatgtagaaatgaaatcttaagacaaaacagattgtaggcatgtacaaatctagaaaatctatttgttaataatataaagtatatatataaataatataaagtaagtatatgtatttaaaatatatagttaagactatctgcattttaaatgctttaaaataaagcgaataaaaagcttcaaaattaaacatacagcaatctaaattagaatttaatttagtaattaaaagttaaaaatatatacaatataatcattttctacattcctagataaccaaaatatattttgaaaaccatcagtttctggaacttactgttctctttagtaatttagtgtccagagaaatcaactaatttaattgaaaggagtttttttctaaaaatgtgtatcttaaacataatataaacactttaattctaaaacacacaaaattaattattgatttccatcaataataagacttttgactaattgttaaccttgaaatccaatcagaaagaaaaaagaaatgaaagcaaagaaagagtaaaaagaaaaagggagggaagacagaataagcaattaagaaaatttacaaaattaataattttctgataccacactaaaacagtaaatgataaaatttatataacttctattttagaatagtgaaaaacaaatacttgcataaaatcttcactgaggataaacacattggtattaaaattgtgatgagattaactgaagaattttggtgggaaagttgggaaattttgtggtggttgctccatgagtgaggtcttggtcagggagatgatctggggaagtgttatgcaggagacctctcttgcaatgggtctacacaagtcttattcagaaaaataacagaaaataataggctgggcgcagtggctcacgcctttaatcctagcactttggcaggctgaggcaggagggttgcctaaactcaggagttcgagaccagcctgggcaatatggtgaaacccagtttctactaaaatacaaaaaattagccaggcgtggcggtgtacacctgtagtcccagctactcaggaggctgaggcaggagaattgcttgaatctgggaggtggaggttgcagtgagccgagatcacaccactgaactccaacctgggtgacagagcgagactgtctccagaaaaaaaataataataataataaaaataataagcgtttgcaattgcagtaagttttcagagcaagccataagagtaaatattattatttttattaattttaattgacacataattatacatacttatagggtacagtgtggtgttttgatacatgtacatgtactacagtgatcaaatcagggtaattaccatagccatcactttaaatatttatgagttaggaagaatgagtttcgtggttctattataacatagggtagctatggcaaataacaatgtagtatatatttagtagtgcatatacgattttgaatattatcccttcaaatattattttaactgttgtgaattaatttttatatattttattgtaaaaagtcttcacatttttaacactataaaaaagcccaagggcacatgaattctaatttgatgggatcattattatattacctaattaatatcttaatcattcatggggggcatggattctagtggctatgaagtcaccaataagtattgtgggccagtcaatgctttatgaaaagctagaaaccagaatttgtctgtgaaactttaaatcatagagaagaagccaaattcatgtagccctggtctagtcttcagccatgctttgtttgtgccatgtagcatttcaacaaaataatgtcattttcttttgattcttctacttccccctgggaggccaggtgataaaactaaggcactgatttgcccatcaaatgagaccactgaagttctagccaaaatcttttcccactattgtccttttactctccattaccaaactttccttctagtctatcaataatgtaaaggctatttggatcaaaacatgatggtggcttgaacaggctgagaaatcttggttaatgtcttttgaacatggtagcagacgtggggagtaggtataattatagacagccttccagggatcacaccagaatgacagaggtatcaagggtaggcaggccaagtccttgctagaacaaccatagcctgacatcaccaccactctcctagagatcattctcttgatacctggaaattattcttcctcagcccaaggagctacctgctgatggcctggagggcaaatgctgtccaacagaaaaacaatgtcagccatgtatgttatttcatcaattctagcagccacattaaaaactaaaaaacagttgcagtgagtatctgtagcatacctgtattccattcatggcattctagctcagacacatggatctacttgccatgctgctaaatattaagacaaatgtaagcattagtgatgctcagaaatatcttcagtttttctccccttcctagatattcagaaagattacacttctcatctcccttgacattaagcatgacgacatgttcaacagaatcagcaggtagaagggacacatatcactttacagcagaagcatttaaaagttgatgccctcctcccctgcagtggtcattctttctggtaattatgaaagaacgggccagctggaggtaatacaagatcaagcccacaggatgagtgaaccacccccatggagaactgccctgagagtcatccatatctacaatggacttagcatgaatatcggtttttgtgttaaacacagaaaactggtggtaactgttagtgtggcacatcctagcccatcgtgtctaataaggcctcagcttgagtgacctacaacaagacagtaaaattaggacaaaaggtctataaaaatgaaataaatcagaatcaaacttgttgtaggttaagttcaaaaaaaaaaattttcaaattactacaagtattgatatttccctaccaaaaagtttttattataatgttccccaaaatattacaaagtctattaggagctgctatttcatttcctttccaggaaaagtcatgtcatatttaactaacatatacaagttgccacaaataaaagaaagaaataacgtgctatgttattcttctttaatacaaaactgaaaaaaaatcaaaacagcagtagggatgatatagaaaaataattatggtatcaaaaatataaaatttagctttcagtagtctagtaatgctatgcatacaattttatatattaaactactgggaaagcagcaagattattgtgttctcccttgtatacattctaataactcaaaagtttttaagctgttcttcacttcattgatattcttcctccaggcatctctatgctacgaaatatttcaatgaaaactctttcttttgacagaatccagctaaaaatatataaaattatcagtgcttaggcagttttgttttgttttttttttttgcagaatgtacccattaacaaattacactgaaatatcactacctctaattaaattagtctttcagagtacaggtggcgtagaagctcccttttcccaactgtatcattattagtctctgaaatttgatgtaatttagttagctccatatttctggttacttatgtcaacaaagaaagaaatctaattcctaatttttaaaacaggtttttgttaactttgaaagaaaaagaagagtttcaacatgaattttactcataacagacattttgctaattggcattttcaaagataacactctaaaagaaaaaaaaacctaaactaaattaaacctgtttctcaatgaatttccacaatgtggcctcaaaatgtgctacagaaaccattgagaacaaatgtgtcccctgagtaaccaacttactaagatacaggtagcccaaagaacaaaagtacgttactgttttgtgaaacttgaatttaaaaaaagaggttcatagaacatgatgtgcattaagcacactagccccactggtatgatgtgataccacactaactaaaattaaagtccactgggctattaaactactaaaccccaaatcatttgctgacagtaaagttacagaacaaacaaaaggataagatttcatcctaaatacttaatacaatttaagaagtgcttattctttaggagaaaaaggtcaggatcatacatgaagaaataatatatataaaaaacaggtcttgaaaatttaccatcataatacataactgatagtttaaaatgtgaattcccaatatttactgcaaattgaacaaaaagatcactagctgctggaaagaactttgtaagctgaaaagctgtactattcaagtaaactataagaatttaacaaaagaaatatccaaaccccattatttctaaaggctacttacattttctgaacattggcaacctgatgtgtattaagtatttaacatatacagaattccatgaaaatttcagcaataatcctatgctttcacaaaggcaatgaagatattcaaagcaatgacatgaaatctttaagctgccaatagaatttaagtactaaaaacaatcaataaattctaatataagttcactgatgccttattatttgtgaaatattatcatgtaaccaggaaaaaatcatggcttcccaatgcatctttttatgattatctcagttcactactttccaacttttcaaagaattattgcataaaccctagaaagctgctctagtagggaagatattcttccaacaatctaaagggataggtagtatttctcagactcagttcaactcactcaggtctaacatacagagccacaaagaaaacaagcacaagtagtatatggcacataataagaaatggattccacttttaatgtagtaacataacaataataaaaggcaatttaaaggttacttaattttatatacatgtaaaaatgtctgactttgggtaagactcttaaaatgccagttatttttatttagaaattacattttatgcttactaaatttttattagtgtccacaactgcagtcatgtcaaaatgccatcattggttttttttttaatcctcttgaaaaatgttccctctctttgttataccctgaaatgaacacttacctatgtgaacacaccaactcagcaatctgaatagttactgcttcaactgacaataataatccttattctcattaatgggctgacatttcctcttgcagaaatgattacacttctatttcaccattctcattaattacaccaaagtgaacaggattaattgccatacactgtaacaggatggccatctcaggtatgctccagctccacatcacgtgttttatctggaaaacatcttaggtgcacggctgctctagggttctgcctaggagaattccacacagacccctcccaaatgctgctacacactcttagtccagctgttaggtgtacttgtaaagggtcaaggtattttaaatttttcagaggtaaagaattttcacatttaattctccctgtgtaaatatataaacatgtattaaaggatttccattacattaactaagatgatgtccaggcaagcatcctgtgcacgtattatttgctccccatttacatttctcaatctgtatgtattagctaaaacaaatcgagttaggctaaaataatattcttataatgtcctgataaatagatgcaataagcagactagtctgaattacatcctttgcctaaaagccctggcattattaatgtttcaagataatatgttaaaaatcctattttttttggaaaactaacttacagtagacatttgacttccataagcataaaagtgaagaaaaacaacagatgtggataattgggacaatgacagaaaaaaacacgcacctaaacaggaataatgaaaaagtattaagtgtaaattttttgtctaaaaaaaggacttttttaaaaaaatgtagggatataaaaccaaggacatatagaaatgaggtatgaagacttctggagagcatggcatggcacaataggtccacactgcagaactatcaccttgttcaaatacacagcaataataatcagatgtaaaagtaaaaacaaacaaacaacaacaacaaaagaaaaaacctggccaggatcaaaaacaagatagtggaccataaatgaaccagtataaattgctgcctggatagggaacaagtggaggacaagtggaagttcagcctttgcagggtaaaggaacatgaaggtgacaggaagctggtacagcagctaggatgccacttgactccaaagaatggggctcgggctggggctgaggctgggcttgagcaaaggcagaatgaaagagagatgaaaacaaaaatcttattcatagtgagcctgaaattcccaaattattacacataaaaaaatctagtgcttaagaaagccaacaaaaaaatcaataaccagaacctaacacactgcaaaggaaattaattcccttgggtactcttctggtttcccccatcccattgatgactccctctccatctccttcagtgccttaaggcttagctcatgaccttccctgatccatattttcatgctaggtaattttaaccaatcttaaggttttaaaaaccacctgtaccaagatgaatcttgaatatatatgtctaaaccgtgaccactccactgagatctagtatcctacatctaactgcctgcttgccatctccacttggaaatctaataagcaactcaaactacagagatgtgaaagccaactctgggttcaccctcctcctgtacaaccaactccattgtagtttcaccctccacccaaatgctcaggctacaagtctaggagttgagcttaactcttgtcttacctaaatgtaatctatttgcaagttctaacagctccacttccaaaatatatcatcaagacgaccaattctcatcacctccacagctaacatcttaccatcagtcattatccagcataagtcatagatagaagactctaactgatctcctacttccactcttcacaacatctacggtggcctttgaaaaacaaactggatcatgttcaaaaggttcctactacacacagaacaaaatccttaacaaagcccctggccctttaacctcatccttctttcctcttctcctagctcactgggtctctacagttacatatgttttcttgtgattcctccaacaagctaaattgggtcctgcttcagggccttgtttgtatatttgaaatactgaacaatggacgagaaggaagaggaaagaacagaggaaaaggggaatcacgagaacttggaaagccaggcaggagacgaaatccatgttaaaaataagagattaggctcatttttgtcttttatagatttcatagctaaagctatttttccttagtttttctaactttcttcctttttctttaagtgacactgctgttcaatgggtgatcagagccgacttgtccagtcaaatcagataatgaataaaaggaacatgagaccttgttttatttttcagctggttttactagaaatgagtgatgtgaatcacaaactgcctaggggaggggtgtagtatagtactctcttcaataaaatctaaaaaagtggagaagtggcagataaaagtgttttgatgttgcagtgtagttattggtctactaaccataacatgtagctatggccaagatgccccagatcacctacagtctgagctctgactatgtatcacactccctctcaaacagcgctggaatttcttgcacaaagaatgaacaaattccaactagcttctcagtaataatatacaaaaccaacaacaacagtctggtgttgagccacggttcattcatatatgtattacatcctctcaaaactggggactaggcacaaagaaatttgtgggctcagcatctgaaccatcaattataaccctgcttcaacgagaatgtgtgttgaatgattcataacataagaaaacaaagacaaaggtaaagattgcacccacttcctcatatccaacagcactgggaacaatattacattaacatgttttttacatatgtgtgaattcatctatgtaaatataaaagtgtagcatacagtgctatactctgaacaggataagtaatcaaatattactctcattactactgtttctaagtcatgagttcagaatgtttgtgataaaatatctcatttggatatcatctataatgattcaaatcctttaagtacttttaaaaaatttatttgctgtttagacaatggcttcccacctttacaagtagcaaaacaaaaggtcacagagtgtaagtttcctggtcacattgaaagtggtgggtggtactgatgcccaaagctctttggggcgtcctgggaagcacccattccattttagcaccaagggaaatttccatttcttgttgaactgccccacactcaacgaaaatgaactacatgattcctaatctaccatttacagtgagtatagagatagacatggcaaggtccctgatctctaagagtttaaatttagggggaaagggcttaaaaataagtaacataatgggcaaaactaaagtgcttaataattacatttcaagggagaaagggaaataactgaagattcaatggaaatggcaggtggcttgtgatctgagcaccaaagaataaacataatcccagtagggtatagacaaaagatggcagcttcggaataaacaggggcatggacgccaggcagtgatggtacattcacagagatatcaatatgtagagaaagggtggtgtctggatcagcacagcagttcttccctcaatgcctttgtcaatgattagtatttgggaagtattttttcaagggcaaatttgttcggcaaggttttaggatgtattatttttgtagggagggatttttatggactaatgtcttttattgagaaaaacagtctctaggtagactgaaatccattagtctgaagggagaaatgtcaacagaggcacaaactaaagatctaattactgatgcacacgaattggttcactgaatttaggtgctctgtgtgtgtgtgtatgtgtatgtatgtgtgtgtgtaacagatgtatctgacagcaggattaagtgttaaaatttaaattccattgtaggttttgtacaaaggcttagaatttccccattttctgatcccattggtttgacatattaatatgaggaagaccattagtggcacttttgaaacacaggcatcattcaaaaatacacaatataatatacaagatgtgattataaagaaataggattcattccacaagtcacacagaaaaatcagattcattctattacagtcatgccttgtataaattatagtccagccaacaggggcactaaatatgcactttaatttggagtacagtacagaagtaacctcactatctaatgagatgaattattaataaatgctaaaagatactaaaaaaatgcttgtattaaaaaggccaatggtagtcttatgtattttacaagcaatcttcaataagccactatcattttatactcaattgagccatactctcgattagtctgatatactatacttttctttaaattggaagaaattacattgataatcatttttttatcaattctttctggtttggtgaaaaaaaataaaaagagcaatgaactaaaagccagtaaaccgagttatggtcgtggttgcgctgataataatctctcaacagctttggatcttcatttcttcagctgtaatatgagggactctcactagatgactactctgctaatatctcatacggcactaaaaccatgcatacgctatagtctcagatttgatatcttaacaagtacccgagtgaatatcaccagtgaaagctctgctcaagttctgtttgcttttgttcatgctgagcagtcattatgaaaaatacaatggtttttctaagaaaaaaagcaaaggcgaaaacctacagggataaaattgttttaaatatattttttttctggtttttaaacagttatatatcccaaagcaaagttaaaatccaaatatcacattccaggaactacagatgaaagagcagcaattgctgcagataaaaatcatagcaattattcagttgtcatttttccttccaatacgttaaaaaattacataggccttaatgaattttaatttataatctaggtgtttttcttttgctaaagttcgtatgtcatcacaaaaagaaaacaacaaccacaataaaaaaaaacaaaaacaaaaacaaaactcaagcttttgaaacacgaaacacaactccctagaatagaccagtcacctttttttgcatgaaacagatttcagtcatttcaaaactacggtgttacaatgagtataaatccttgaagttcaaacaatactacccgtacttcaagttccaaattctatatctcatcccctctaaaagtaatggatgtcaaatggtaatgggaaaactctttagagcacaattctttaaaatagttttttggaactacctaataaggaatacaaaacaggtgtaactctggaaaagaaaattaagctttcaagacaactaaggacgcaatccattatttctctcgagtttatcattttggtaggataaatgctcctcaggaaagattaactgaagacctacaaagttccttaggagatatgtggcaagaaaaccagaaaaggctcttctttaactttacatgacatactttctttttgaaagtttctaataaaataaactcattctttattcagttttcttatcataatggccatacacagacattccactccaagttttggtttctaatgagcagcattccttctctcaggttcagagtcatttgctttaatagcctattttacatgcacatactaccttttgataattcttttcagggactacagtttagaatttaaaacaagcaactttgctgaatatcttattgtttctcttggtgttttcaaaccccttgatgtttggcgaatttttacaaaattaatgaggttaaccttcatttttcagactttcaaagttactttatgttaacagagacctctcatttaaggatgactcatattcatcttgtttaactttatttttaggaaaatttactaagctctgcgtagatacaaaaaaggagacgtatgtaacacaaatgacatttattagacaactaaatacaggttaattccacttataataaatgagagacttatgaaaataaaaacctctgcattaaaatttaaagagctattaataatgtttttcattgtataaagttctttgtcatagctgcatgagagtctcttgtctttgtccattccatgcctgaatatgtatgtctcattacaaggcaggcactgtgagcgagttgaaaatataaaagtgaattgggcatgtatttcaccagcaaggaagacacacctgtatctaagaatttctctagtaaattatatgaattaagatgaagatctacttagtggggattagggaaattaggttaagaaatttaaaagctgaagttgacatttatataacataattaaatagagtatcacagaaagtataaactttaccacaaaaaatatttggcttgtaaatgttaatttgcctgcagtttgcagaagaatgtctgctataataaaaggtgcaaatacagtttgttgttaagtattatcagctagatttgaaaatgtatctcttgttttgaaatacagatgtacaactctctaagcctacaactctagagaagacaagagtgaaatacagcttttgtaacattcatttttttaaatcatcaccatcccacccccataaaatacatttgcagttttctgtgattatgttttagtttgattttaggttaacagaaattcacataagcattaaattccttgtttaaaatataaaatgtactttgtacataagtcttctcattttatgttactttgttttccaagttaactaaatcaccatgttatggaatgaataaggcaatttttgttacctgaaaggaaaacatacaattctgcttggttctttaatttctcagtgaagatacacacataacgccttaataaaaacatgccatcaagtttccatttcccataattccttctgcttagtgaacaaagtcataataggtatgtcagaatgaaagcagggataaagttcttttgagctgacggaaatgccgatgcagctttttataactggaatactgaccgtcagcaaaacagagattgggtggctcaaacagagcccttattacatctgattcactgatccctttcaaattcttgcccccaaccttgggcacaacacaaaaccttcctgagctctactggtccttttgtctgtttgcaaaacaaaatacaacgtaagaataaactttaagggggtaaaacagcacttctgtttggaaaaatctttcccttttggttgtcttagatgcattttctatctagtgttttcagctagtaacaatccatcacttgtcatttagcaatctgttcagtaaaaacatctatagctgtcccagctttctctaaagaaggaacttgggtgaaaagtcaataatatatatgctttgcatactcagtagcactcaaagtgcttacaacataattaagatttgtaaggagttggtttcatatcctaaattgggtatgaatccaagattaaatgtcaaaaaaagtgttatctgggagtacttgttaaaatacaaaatctcataaataaagaaatgcattttatgtaaaatgaaagatgctctaagtgcaaaccatgcctatacataattttgctaatgggtagatacaagattcccaaagagtgcttcttctcccagatttttacacaccatgaaactttctgaggattcagataggttgccagcatgaaggcagagctacttttaacaatggattgtcagatgtcttgtttttaaacatcccccttttaacaatcaactttctagttcacaccatatgctaaggtgtttgatacagcataagaatattgtgggaagcagcgagaaaacttacagaaatactttgagacaatgctgaaccttaggattctgagaggtgagactgggaagaagcgagttccagtaagttgcagaaataacccagagcagaagaaaggaggcaatgacacctccaagggaaagcaaagctaaccactgcttaaaataaggaattcatacaagaaaaaaaatctgtaaattggatatgggcaaacttacaaaaacttggtagacaagtgtcaaacatttttgagagggggaagtaatgttttgggacaaacgactcaacttaaatatacaggctgaaattacaaatgaaaacctaaaggctagcaaagctctcaagaggttattgtttgaacatgaactagagatctagccagagtaatgggaacaggaatctcaaaagaagaaacatataaaaaaagatgatgaagaaagaatccacaggaatgggtagctaatagtatgtgggcatagaaaacggtaattgaagggaagtaaggagtcaaaaaaggatgccaatgttttgaatcttgttgacttgggaaaagaatagaaacaggttaaacctcaaggaggaaacagttttatgaaagactgtttttcagaactgctgatttaatttagcattaaaaatatatatgagggctgggtgcagtggctcagacctatagtcccagcaatttgggaggccaaagcaggcaattacttgagcccaggagttcgagaccagcctgggcaatatggcaaaactccgtatctaccaaaaatacaaaaattagccaggcatggtggcgcacacctgtattcccagctactcaggaggctgaagtgggaggattcctttagcctgggaggtggaggctacagtgagctgtgattgcatcactgcactccagcctgggtgacagtgagaccttgtctcaagtgtgtgtgtgtgtgtgtgtgtgtgtgtgtgtgtgtgtgtctatgtgtgtgtatgaaatgtgcctgttctgagtgctataaaggactcataaactaccccaaaggccttactctgcaggagcttccccagttcaattataggaaccaatgcatgcattttttgtgcagttgaagtcccaggaatcaagtgaaatctctcaggtagaaagtcatagattatcttgtttacttgtcttattgacagaaaacatctgatagccatcttgtatgcagacatctcttcaaaaaggtattttacaaaatgtactgatgtcagccttgtttcgtgttttctccttattgaatttattagtttctttactcatggatctttgataatttgtgtgtttcctctgcaccacattctaatttgctaccacctttttcaaacgtaaaactcacaaaactaaattttttaagagcacgactgctggtgcaaattactgtcatcacaacaacatttgagtacctactgaatgcaaaatactttacagcttctggaactcctgtgaagatttggcaatttcttgtggacttaaaaatctttgaatgtattaatgataattgaaggatccacatctcatctctgggattgtacacaggatagtgaactttatgtgtcttccttcatactcttagttccttgtttaatgccctgccacctgactgggtctaatgtcatgcaaagtcccttcatttctctcctttccacagctattggaagctagcaagtccataacctactgcttagctccttgcatgaatccacatttctgacgtctcaggattgcgcggcatagggaagggcaaggatacatgactcacaggacgtcctgtgtttgaggtcagggcagggtgctacacaggaactctgattggctggctgcattccttccatgctagttccagtcttctcttggacttgggagactggtattgatatttcactgatttcgcatacaggatcatatctgatccttggaactccaggctgagtaggcagcaactcacatttccattttataaatgaattaattatggctcagggagattaagcaacttgcccctaggtcccacaactgtcagacagaataaactgccattattagggaccaaatgaactataaataatgataggtttctagctcacacttactttatgggttgttataattacctattttctgctctatcagtgccaagtcaggatttcacagtctgtatcgtgtgttttttttgtcaaattctccttaccactaatttgtaaggatacttttcctccaattttaaaagttgtagggttaggcaattccacacaatttggagttctgtgtggtttataaaacagatcttgatattttacagtgattagtataaacacaagaaagcaaaggttggtcaacatttatggctcaagaaaaagagagtattacataaccaaccaacagttatttccttttaactatatgctgatgacaatgcatgctttaatattggcaacaactgaccggcaatgccaaaatcagaagcacatctcattttgactaactgaacacaaataaaatttgcaaatagtttgtattatgatcgtatcttaaaatggtgctactgacgaatgaataactatttgtttagttagaggcaatgacacttactgaaagttgattgagcatttgtgcacagggcctcagagcgaatccaaacaagtgtgtggcatgctggggtcctaaccactcactttacagccaaaatactactcttattaaagagaaccaccccagaattcttgtatgatcaagatagtaatagtactcctaacttatagctatgaagcacgttaaatgatgcaaaactgccttcatataagcagaaggccaattataattcctgacatggcagtactccaaaaactgtatgccagtggagcgagttccatcacatcagcaaagtaattaagtcacttccaagtaggtaaaattccatgaacagacaatgttaattttcttaggtcagcatcctgataaaaattatgttccaacaatctgcagtcaacacaaaaacctttaggtttacctcctgttaacagaaatgttcagagcaaaattaaccacaggcagcaaaaatggcaactgctggaaaaataacagatgcagagagcagagcaaacaatataaagtagatgctgaaaaaacacattccagccaagcttcaatgtagaattctacaaacccttatatagcaaatattgccctactaagtgcaacaaaaatattatacacagaataccaaatgggtgactcccatcccagcttactggagactcacagtgtagtgagagcacaacaaataccaagtattctagtttattattctcacatggaaagatctttgattcactgactggatgtttatgccagacacactccacagataatctcattttatcctaagaactctaaaaggtagatgttactttagaaataaaaaaattcctgagtcataaggagataaagtaccagacccaggatgacacagtggtggaactaagaatgtttgaacatcactctgtgattccaaatcctggtatggttcttcaaaaaatcacactggctttcagttactggggaggggtccacaatgagtatacattgagagaaaaacataaaccatgaattagtaactttatgaaaaaaatgtattttccttaggagcagcactagattataaatttagaaaataatgaaatctttatcatttgatacattcttcaaacaatcacttttaattggcatgtttacaaaactggttttctgaagtgaaaaacattttacttagaaataaggtatacatggggaccagggctacataaatgtttttggctttgctgaaaacaagcacaaaacaaacagaattcaattattttctcattgtaatcacatacggcattttatataaaataaaaagaatggatttctactgaatactttctactttaatcaaagcccgaaatcacactcaagcctcaccaggcaatgtgcaaagatgaacagtcagcaggcaactgtgtttttaacggataagtgtccatgacaacaggaaaaaatgccacagcagtgcacgcaacactgttagcagactcaaagagattagggtagaattagcctagtgattccttccttctttcagacgaatcattcttaacagaattaagaagcagtgcaggcagtatgggcctgcctcaacattgtttttatacctattcctgaattcttagaggacttatgttctacctaagtgctgccactattcaacattcctacagtatcaatattttcttgtaccttataaacaactttacagtctacaataacataaacatgtaaaagtataccattacaataaataattccaattacctaagaattttaccctgatttcatttaaatataatttatttattaaagaaacaaattaatgcccagccccttaaatagcagtccttaatttttactatgcccactgtagacaccactgagaaacagtcatatattaagagggtaatcatcaccataaaaacagcaagtatgaaagttgtaattggtacatctgaaatgccgaactgctaataagcacttttcatttacactatgtattttttctattttactagtacattctagtcttaattttaatataaatgtaagaaacttaaaattgttagtattattatataactagaaccatttattttgcttattcatagacaagtttttctacttttaaaatacccaataagatagcattggaattagggaaataacgttttattactttagtagcattccagtttaaaagttctttggtaattgcgttatcaatctgactcagatgacatttaaggtgatctgtctgatgtttaaatccactctttacagaatggtattatggctggtgtatatacagtgatggtcttggtattatactcccaaaatatttacaaatcttgaagtttgataaattctgttctaattttcatgttgaaaacaaggagacaagttgtctcactttaacataccttataaaattattcattcattcaacaagcacttactgggtacctattatgttccaggcactgttaggggccctagggatactgcagtgaacaaaagagaaaccataaaaatatacacacacacaagtttatgaaaaattaaagcaagatttgcatcgataagaacaagttactacaggaaattaaggatttaaaagtacaatgttagcattccttctgtttgaagtctataaatttaggatctcgtcttttccagcaaagaaaaagaataataaaaatcagagtaaatgcttctagctggaaactaggcctcatacagggatggaaggaataacaaagctccttcctactaaggaaacataatgttgatatttgaaaatcgaagatatggatcataataaaaactatttgcaaattttatttgtattcaatcagtcaagaagagatttgcttctgtttctggcactgccagtcagttgttgccaatattaaagcaagaattatcatcagcatatagttaaaaagaaatcaactatttgttggctgtgatatatatatacaccatggaatactactcagtcataaaacggaacaaaataatggcctttgcagcaacttggatggagctggaggccattattctaagtgaggtaactcaggaatagaaaaccaaatatcatatgttctcacttataagcgggagctaagctatgaggatacaaaggcataagaataatattaatataatggactttggggactcacggggaagggtgggaggcgggtgaaggataaaaggttacacactgggtacagtgtacactgcttgggtgacaggtacaccaaaatctcagaaatcactactaaagaacttatccatataaccaaaaaccacctgtaccctaaaaattactgatataaataaatatatatatatatatatatatatatatatataaatatatatatatatatatataaacaggtttgatttgaagtagttgatggggacttatgagctttaaggacacttaaactagacccctagtggctgatggcactgagttttcttccattacatctaatttcactccaaactttatggtttttcctcttgaaataaattccccaccagcactattcttattatcatcctctttgaaaagtctcattctgagttaacaagtaaagaaagaagaaaatgattttctaaggtcaagagttgaacaaaagacctaaaggagctggagatgttgtgttacaagtgaatgatcacagcagactgctttagctgtgagtggccatcctcaggctgggccactcatctcagtctcatctttctcagaatctcggatttttttttttttttttttttttttttttttttggagacagagtacttctcttgctctgtcactcaggctacagtgcagtggcatgatctcagctcactgcaacctctgcctcccgggttcaagcgattctcctgcctcagcctcctgagtagctgggattacaggcacctgccaccacgcccagctgatttttatatttttagtagagataggttttcaccatgttggccaggctggtctttaactcctgatctcaagtgatccacccgcctcagcctcccagagtgtcaggattacaggcatgggccaccacgccctgctagcctcttggacatttgaacagaggtaaataaagacaagaaccagttggcagctgcgctaatttgctggctgtaccctggaggtggaattctagaaactgttcacattttgcctgttaaccccttacattgtttctccaaggttttcctggtatattcttccagtaaacaattccttttgcttaaactgggttctgttacttccatccaaaagaatactatcacaccccctcccactgatccattccccttttctattcatcttgctaaaaactttcaatgcttcctactgtcaataagataaaattaagactataaatattccaatattctctgttatgacacttctataggctttcaaatccaggcctatctactcaatgacatgcgaagtgcatacatgccttgcttcccattctaaaacactattaaaaataataatggaaaacacagtgaacattattttaacagtatgtttgggttcaatggttcaatgatgggcctgctaattattagatgtggaagcttgcacatgttttcaacttctctaagccttagttacttgtcaaaaaaaaaatgaagataatatcttgttcctagaattatactgaagattttaaaaagataatatataacatcgtgtgtgtgtgtgtgtgtgtgtgtgtgtgtaaacaggtcctggcacatagaatgttttctataaatgagattcattatatttcattatgacttaaattcattatctctatcccagaactttcttgctattcagagcaatagatctaagtagctacatgaaattttcaggtagatagacctcaaattccaaattcaaaaagaaaaattaacacccacattcctctgagcctgggttctcctacaccgctcaccatctaccagtacctcagccgttaagtatgataatcttatagttcttcctcatccaactggtcttcaagccctctagactttacctctaaggataaaggttatatcctctccacttctcccaggcacatagattctctaaacctcttatgaggcctctagtaatagcttcctaactgagctagtttgtccttgttgtactcaccaaatttaccctcccaacagctgatgaataagtctttgtaaaacccaaagcttatcaggtttaaacttataaatagctctccattgattagaaaagaaagacctactcctttgagtgttacacatgtccttcaacaatgtggccacagcctaaaagtcaattctctcatcatggtcttgtaaatgaacttcatttccattgtattcaattgcttacagtttctggaacacatccaactgtttcaggcttctgccttgctcatgctagcctatctgagtggaacactcttacttaagcacctgggccagtggctactcatcttttaagggtcatttcctttatgacgtcccagcagacaaagccctcccccacatgtgtgcttcaactgtactctttaaatgcttccatcacagcactcaaagctgaatttcacatgcctgtttacatattttcccaaaccgaagcttcctttagaagctctggtgctcagctcagagcccggcacaaaacaggctcttgagatctgcctgctgaatgaataaaggtagaaagcagaaaaagacaactgagagaactgaataattaacagtaaagttcaggttattttctggagtctgtagacattcagctcagtgactatcactggaccgacaatgatactgaatacagtaactgttcatctttatgatttctgctcattaagaaaacactccatcagagttgtgcaggatgccttatttaaggtagtcaagtatgtgataaagctgatgcatcattccaaagggggctgagtcaagcattcctttctataagatggcgtttgacccttaaatgacaatttgagaaacagaaaggcttcacagtctaaataatttaaatacggtgcattacagagcagcaccagaaaaaaagctattgttatctagtactttgtgatcttctcctttattattaggaaatgtaggcacttcaatacatttacacataacttccttagtaggtaactaaacttttagaaaaaatctggaggataagaatatattggaagaatattttaacaagctcattaaaacagagaattatttctttaaaaatgttgatagttatgctataataaaaacttgagaataaatgcaaagatgtggtcagaaacccaaaaagtaagaattttttggcataaagtgatgctttgggtgggaaagaatataaacaaaagtcataatttagagaaaaatcatatattactgaatcaaattaagttacaagactcagtgctgagaaaaatgctctgcaaatttatagaatgcatcctgtgtaacaagtcttctatgaaattttgtcacagacctgaataaaatctatgtaagttgtcaagatttagcctagtcaattaaataagtaaatggaatcagtgaccattttatagacatttagatgtgctacttattttaacttttataaatagtcctttaaaaaatgtgggggactttctaatgaactttgctctgagcaaaaacataattttgcttttcagatttcactgatgttcaattggagtaatggataaaagtgacagaagccatgactgattaactggaagtaaatttcttcctctaaagcagccttaaggcaggtatgcaatattacctttgtgaaatctagtggagagttggaaaatagagattctatgaatttcaagaattatacattactggaatgtgctgaaaaccaaatggatgtatttgatgtgattcctagagggattcctttacacttcagatcttctacagctttgtaatctgccaggctccaggcagttcacaaacaaattaccgtcacttccataggaagcagatttttagctgtagagaagcaactaagttacaaaaaagcaccaagagatttaaatacctagaagcttgctagaagccaaaaagaaatgagatactgattaaaattagatatctatcatagtcttggccctcaatattcaaggctaagcaagaaaaaatatcaaaatactcttcattttacatctgaagatatcttaaggacagaggttatgtttcgcctgtcaagcactcagccaacagacggccatacttaacgattttatccttttaaaacaaaggaagcaacctgccctataaagctgtgctagatttcacttcagtaggtatcagaacaggaaaaagcagagtgttcatttgatctttcaagttctgatctcgtaagatttgagactgacataaagagattgcttccatataaagaatgaaactggccgggcgcggtggctcacgcctgtaatcccggcactttgggaggccgaggtgggtggatcacgaggtcaggagatcgagaccatcctggctaacacggtgaaaccccttctctactaaacataaaaaaaaattagccgggcgtggtggcgggtgcctgtagtcccagctactcgggaggctgaggcaggagaatggcgtgaacccggaaggcggagcttgcagtgagccgagatcgggccactgcactccagcctgaacaacagagggagactccatctcaaaaaaaaaaaaaaaaaaaaaaaagaatgaaaccttggtaagtttgaattgtgatatgtttttgcctctatttaatgttttaatatttaatgctaaatattaaaagggaggggagctacagtaaacttcttcattacagttttgctttatctatctgcttttcatttgaaattatgggcagagatcttattagcagggatctgctgccatttaataaatacaatgtctcaggcactagagcagtcactttctattcgattcttaaaacaattcctgtaatataaatattatcctcctttcctgatgaggaaattaagcctcacagaggttaagcaatttatcagatcccacagctaatgggctgcagttctaggtttcaagataagttctaggtttattggtaagtttgaattgtggtatgtttttacctccatttagtgtttaatgctaaatattaaaagggaggggagctacagtaaacttttccattacagttttgcttcaactatctgcttttcatttgaaattataggcagagatcttactatattaaatgtgtatacagaaacaactctgcaaaaatgtacctcacaagggcgataaataatgattctggttgttataaagaataactgtattcgatacgtttttgatatgggtcaaatgctcccaaagcatacaaagtgggcacggagagactggcattaaagttttggcatttcgtcaggactacaatgctattcaaaatgctattccccagctttcatgaaggtgtttcttttcaataaatctgaagcaccataaccatgacacaaatttgaatgtaaacaaagaatgctgatcccgtaactaaatgcagcagtgcctttacttcagaacaggcaaacactgccagcaaaaacaacaaacaaaatttctgttgaaacagaaacagcagagcgtgaaatagcagcctgccatcagacattgggagtttgattttcatcaatggcagctgaaacagccctctccacccacttctgcatgaaaaaagaaaagaaaagaaaactgataataccatctgcatgcaagcaggaggacaaaccttgtgggtctatttgctgcactccagcatgaacctagagcagccacaaactcctctttaggctctatttcattccgtgaacctaactgatactcccagttattgtacatttggaggaatacacagtgattttattttttaaagattctggcggtgtcacgacatctattggaaaacttttcaagcagagggcttctgattgatttgcttggggtcatgtggaggtaaaagaaaaagtttaaaaaaataagcacttacaagtggcaaatggcaaatccaaccagcaaaggtgagtgcatttcaaaagcttcctctgtgatgactacacagaaacgtgctatgggcatgtactatgtgcgccaaaataactgccgatggttgcgatatggctatttccaattcatgtgttacaatgctaaacacgctcctgaaacactaccttctgcgagagaggaaactttcacacagagacgaaatgaacaggacaaatatacactgtggtagtactaaaaggaaatttagaccgaataaagcagattgataacacgggtggaaaacatcctcggctagactagattattaatgataccagagaagcaacaatgtgctttataattcttatatgtatttgtacatcatgaacggcatattgatcataaggaaacaaagcaaatggattaactcaccactgaatagtatctatggcaaggccacatgcacattacatgtcaaaagacaaccaacctccacaacaacaatctcagccacatcctgcagacctagtcactgctgttagaaatgtttggtgcaatttaacccgtatgcaactaataattattatgatgataatcatttaaatagtttagattactgcatagcaaatagtcactaccctcttactgccactattggcagaatatactttcccatttcattgatgtttagtgtggtgagatgtcttgctttggccactgggatgttggtggatataacatcagtaaatgcttgaaatgtgcctgccttcttggagtatgctaccaccatgcaaaagaacatgttctgcctacccaccaaattaaggatgaaggcatgtggagcagatctagaccaaatctgcagcgtggatctaagcccagcctggataagctgagccccacttggctcacaaatgcaggagcaagaagagtgattgtcgttttaagccactgagttccgaggtggtttgttatgcagcatcactgtggcaaatgctaactgagaacaatatcaacaacacatcatcacaaatagagcccatttttaattaaatggtatagggtaaaattaaaatacagacattgcagtattgctgatagcatatagttataagccttagtattatacaattggaccttcttttagttttacccccttctgactcttctacacccacataagtagctgctgccatttaataaatactatgtctcaggcactagagcagtcactttctattcatttcattcttaaaaaaaattcctgtaatgtaaatattatcctcctttcctgatgaggaaattaagactcacagagtttaggcagtttatcagatcccacagctaatgggctgcagttctaggtttcaagaaggtgcttctttaatacttaccatatttcagagtaagatttttttctatttaaaaatgtttaaaggggaaaccagcaggctgcatagaggagatataatgcctttttcacttttgttgctctgcagggactcatctagcactgaaatagctctcccattcccacccccagatggtccacttgacaaggagaggcctctggggatgcctgaaagctctcttcttgcacaggagaagtacagcctagaaaattcctaagatagtcataagttttagctcaagaagattctttttaaaaagcttatttcttttaatccatgatcattaagataattcagtcttgataaggactatacaaaggaaaaatcagacttttatttttaaaaatatgtatttccttaaccaggcatattcctaactaatccatgttaccaactgaaaagaaaatatttaattctctcaaacaatttttccttctcaattctaatccatatgcatattgtaaaaaataggtaactatgaacattttccttgaggtagcttttagaagatactgatgaagagattaaatccttccaggtattatattattgttaatatttctgttacacttttatcagatatatttcctagtacctcagggtagtcgggatttctctattttatagtagtgaaaactaaagtatagctaacatgatactaggcaaaaatcattcaaaacctgaagatagtgtaataccacaaaatagatacaatgattagaagtaacaatgaccttgggaaaatactaaatagatttcaaactaatccctgcataattaataggatggtgttatctctacagtctgtaatactagacttgcaactaaaaatgtctgcttgtcctgggaaatgcagtgtataaggtaagagaaagtgatttccatgtaagatgacagactccttgtcagaatcattcttatttctatcaggagtgctgaactttttaaaattaagatattaaatgtcaaacatttttattaaagataatagaaccttttctgtaaattaaccttactcaaaatatgtctcttaccaactatagaactgtcttgccctggagtgtttatgagtagttttccaacctacatcctataaggacagctaagaatgcctctaaatctatagggaaactacatgaatcaaactcctgaatgtgctaaagtgtactgttatatcttttactacgaaatcactacgtaataatgataattatgtcatagcactaatttttactgggaatgattgcaaaatacacaaaaagagagaaaagtacaaaaaactcataccaatcatccaggttggatagctatcagaattctgccacgcatgttttatatatccattttattgcagttgcataagtactttacagcaaataccagatcccatttgtatgcatctctacaaatgcagacacttttgtaaaacaacaacgatgtcattatagcccaaacgtaatgaataactgttatgagatatccgatatatgaagttaaagcaagcttgtatattttacaaagacaattctttgtatttcccagctctagagtacatttcctccaaaaaattaagaaatgaaaaataattagaagagtcataatttcaattttcaacttattccacatgggaagtaatttgtgtaagggaagtataactgaaagaagacatggtatcaatatctgtatcaaacttataattaaatagatgaagaaaaaggaattattacttgaattttagtttatatttaagccgtagtaacagcaaatgaaaaaataaattttaacttctcagtgtcctttgtcattgaagagtatacagaagaaaactctgaaatgaaaagctactatattttatggttcacctctctataaggtcttatgtgtatttgtttggaaagggagagagaaatttcaaagacggcaaagaagtatttgaaaatcattaaatagtactttaacttcagtgttacatgggtacgtgcatcacaagtatcaatattggggaaaattaaaaggaaaacagtattggaacaaaatacaaaccaccgaaggactggaagtgaaaatgtaggccatgacgaagtggccagacattctcaggtgtgcctacctgctcaatatcacgaaacagttcattgaaacaagatgccttgttttatacagtttaaaaattaatctctccctcttcaaatcactagaaaattatattctgtgggtaatgggctgaatgtgtccccttaaaattcatgcattaaaatcttaactcctcagtaccttagaatctgactatatttggagataagtcatttaaagaggtaattaaggtaaaatgaggtcgtatgggggggtcctaatccaatatgcctggtgtccatataaaaagacgaattttggacacagacatgcatgtgcacagagggaggaccatgtgaggacacagctagaaggctatcggggagaagaagccttcaaagaaactaaacctgctggcaccttgatctcagacttccagcctttagaactatgagaaataaatttctgttgtttaagccatgcagcctgtggtattgtgttatgtcagctcaagcaagccattccaccatgtaattgtagagtttgaaaatcgtcaaactctgcaaattattcactgacttcttagataaccaggcaagttagtaaaaccttaattttttaataagtattagacatttttaaagatatcttttaaagattataaaacctattatgcttaagaagataactataattcattaagattatcaaacatccagtgagtaatttacctgtcacatgttaaataaaatttgtagggcccaacagaccaaaccaagatggggttattcatgctaaatgaaagtaatgaacttaggagtacactcatgtaacaactcgctgagttttggttagttacagcagctgagctttagctagtcactggaagcagccaactgattcaaataaccaattaagtcctatacctcacttctgttttctttctgtaaatactgtctgaacaggctgcagccccagagttcgttctggttctgagggctgcccgtttcaagattcataaatataaacgaattaacatctttatactaaatttgttttttaagactattggtcttttgtcttttaagactattggtgcccagtgtggcactggaaggacattgatggtgaatccaaacatcccttgaggaatgcaggagaggtaccactgaatcttttttgaagtcctctatctttcttacgggctcccgagaattttaagttcctcttgggttggactctgctctttttgcatcgagcccctaaccttttaggtttctgaatccagggttagtttgtgccatgggaggctgcataacctggggtcaggtaccaagggtgagtctgtgctgtgagagagcacacaaactttgaaagtcttgacaaaaacaggactggatcctgtagggaggagtcaggtgtctgagtcagattaaaagtggactggcttccataggtaggtaaggttactagaatacaaggaatcctgggatcatctggatccaaggagtctagaactccagccaatttcatgcataagaaccatggactcagaagctgtgccttttttatttttaagcaaaatgggtaaaccttaccaaaaatagttagactggccacagtgaagttctaacctagataaaattgttcacttgtagggctccttaggaaagaaaagatcagaaccccacaggaacaatgacatgcatttttgtttggaacacagaggctaaaagattaaacaaatcaaaaactgcctccttaccaaaggcaaacgggcatgtcttgacagctacaacacttacagaaatcaaaagaacttccttgcacacattttaaaccaaaaccatgatgttccaaactaaaaaactctgtgcccaagatgtctgcctttattgtaaacagccaggccattagaaaggatattgtccacttttacaccagccacttgatgaatgtattctctatgacctggactgtttccctactaatggaagccccgaaagactttacttccaggataataatcatcaaattagcactctgtttgttttttcctgtttgatcctgtaaaatgggaaactttcagctgactgaaatccctcctctcaaacctttgttgccatttctttcttgtcataatctttgctatactcctaaattttttcttggtgaagaaaatgcatttatggcataaggattattttcagctggttatttcaagacccttctgtaagaaaaatttatatctataaagaaatctcaatttgtaagtgtgtctccctctctatactgagaagacagagagagctaagtcactagaaacttttacaatggagaagccaaacgcttaaatttatataacatgcctcacttaggaccattttatttactggactcacagttccacttggctgaggaggcctcaaaatcatggtgaaaggcaaaagacatgtcttaaatgggggcagacaagaatgagagccaagcaaaaggggtttccccttacaaaaccatcagatctcacgagacttactaaccaccatgagaacagtgtggggaaactgcctccataattcaattatctcccaccaggtccctcccacaacatgcgggaattatgggagctacaattcaagatgagatttgggtggggacacagccaatccatatcactaggcttattatgcctttgtctcagaaaataatggtatttaggcttgaaatttgactacagtgagcaacctagctaacaactgcttagggcaatgaaacaggtaattgaaagagtgatagtgtaaagggtgaagaagagttatttggagactggcaaatgaaaaatcttaatgatatttctaggatacgtttctgtctgtatggctgtgtatatctatatatgtctgtatgttatatatgcgtgatatttttctaaaatttataaagagctttaattggctttaaaaagtaatttaaacatttaaatctatgttaattagtatttatgaaatgtctgagtaattttaagtatgtttaaacactgaaactaactgctatatatatacttcggcatcctgtttttgtatggtgcaaagaagctacatatattatatttgggtctattagttgaaaaaatatttttctatggggaagccccatatgttgttagaaactctgaaatgtgtatacagaaagtgttactatatgacagaaagttcaaaactgctttactttacttcctaggtttttagtagaaattaagattactaagagttaaatattctaatgactatatggtaactgaaactggaaatagtagggcaaatgactccatattcggggaaagtaaacacgtttttggtaagtgaagctatgaggtataaaagatttttttttttttaagagaaaaagagtaatttttgtcctaaaaggactggttgtttcaaaatgagaaagaagtataaggccaatgatgaaaaggatattagaaggttgtggaggatttgtagaacatggattttgtgaagggaattttaggtatgaccaagctggctaaaattagaatggaattatttgtaaggctttctaaaaattgaactttactatcaaaactacactgatgcaaaactagaacttggtcctttctgtcaaaacaaataggttttcttgaagtatttatttgctcttaacaggaaatggtaaaaggcttttatcttttaggtaattggcctaggaaacaaagattctatgttttatcacgatgaatccttgcgcttcattttgtctttcttaggtctttgattatgtaagaaaactgggtcctctctattaaaaataagacttttcctacaattatgtaactttctttatttgtctttgaagtctttaatgatcactctggctaaataaacgactattatttcacagtgacctgtgatcccattttgatcaagtgttttaaacctttgatcaaacttcccaaaaggaaattctaacaaacttcccaaaaggaaattctaaattaagactttttgccttagaattaactctggaattttcctattgagtccctgaaaccctccaaaaatgtgtctctcctcttgtaaaagagatatactcaactaattaaggttatttgatatattaagttatatgggaagcactgtcaaataaaagtgattctaaaccttgaattatatttgcatggatatgttattggtatgttccagaaactgtataaaattcttagaaatccgatgttagccataattttggttattgtgttgaattattgtatgacacagaaataaccaaatttccttgtcaacggcatcattattttaaggagctctaatcagatctttaaccaggaccatttgaagtcttgtcattcacagatggttatgtactctggtacattcctgagcaagtataaatatttcatcttcaaggaggttcatggaaagaactctgacaagtacaagtttctgataattttaagaacctatcattggactgggtaagaattctcagaaatctaatgaagaaactgatttgttttataaaactgctaaatgaacatcaagcagaacaagaattatttaaataccaaggaaatgctttggcagactttcatgctaaaattactgaaatttcatgctaaaagtactgaaattgctaagaaatgaaatttgaggccaggcaaggtggctcacgcctgtaatcccaacacttcaggaggctgaggtgggcggatcactcagggtcagaagtttgagaccagcctggtcaatgtggtgaaatcctgtctctactaaagcaatacaaaaatcagctgggcatggtggtgtgcacctgtaatcccagctactgggtagtcgaggcaggagaattgcttgaacccgggaggcggcagttgcagtgagccaagatcatgctgccgcactgcagcctgggtgacagggcaagactctgtctcaaaaaaaaaaaaaagaaatttgaataaactgttagattgatcaaggtcaaattacctatgataacttatttattaatagtaagcagtcgaatgcacctgaattggacaatcgaagttggtatttaagaggatataaatccagtattaagtgtaggctcatgaagaacctgaacagttgcctggtcttgagttcttaaagtttccattattaaaagttctatacttcatcactcatcatggagtagaaaaaataatacaagtcatggaaaaaatattggtttggtgattgttctagaattgctaaggtggtttgtgacccctgtttggtttttcaaacccatcatcttgggaagataatcaaaacttcaagtcatataattctgctatctgatggaccatttacacatgtatttcattcagttaccatttcaatgggatgtaaatatgttcttgtaacagtgttctctggttggatcaaagcagtacatgcaggaaagccaatacaataacagtaaaacctcatgtatcacccattcttataaactttgataccaaggcatatttttatagctaaaacaagcctttcataatccattgatgacaatctgacctttggtgatctggaacccaaagactggatcttttggacaagacatgacagagagagacagagagagagactgctcttgaatcccagtgggagggaccatagagttcttctccccgtatattgcagtaaagcttaggaccttgccttggttcaaggttaaaatggcccctccaggctcacgcaactgtatacctattgaagactttaaggtaaagctgattagggaaaagtttccctaggaacagatgacattttagcctggatggtgttttctaagaaatcagaacaaaactcttcatcaaaatgtgacttttatccctcttaatttttccttgtttatgcctacttttttcacttggaacttagaactttataaccagtatgaaatgtcggatctgttatgatctcagagattccttagtatacttagtgttaatattagcaacatccctaatccgactgtttatttaaattttcttagtgttctgttttatagatttggacttctagacccacttattttcacttcctgctttgatttggcccagtcatggaacgctagattgcttattggctaagtaggagtctgtgcagttgctagtattttttgttgtgcataaatatcttaagtattgtagacacttggttacaaaacaattaaaagaaacaggctatttggttaaaacaggtgaactcctcatgtagcttatctatttgattttagttggtttgattttagttggtttgatttatgggggcccttgctaaggcactaactccaaactcttggtattatcctcctgagagtcataatggcaatctccctgggtatgctgtactttctcaaaagttttaaatgtttgcctataaccaaccatcaaacaccaaatggtctctttggttggaatgacaaaaacccaaggaaatgcatgaacatgatgacactgtaacttatgaataacaggttaagactggaaatgtaaaatgataagaattgagagtagcactgatgacctaagttgtggtcatactctcacctaagtgacagcctgaccaaaaagggggaaataccattgatttggactaggctcctgtacttagtccaacagaccaaactaatatggagtcattcatgctaaaggaaactaattaacttaggagtatactcatgagacaagtagctgggtttcagatagttaacagcccctgagctttagttaatcataggcagccaactaattcaaataagattataaccaattaaactctataactaacttccattttctatccataaatactgtctgaccaagttgcagccccagagttctccgaacctgttctggttctgagggctgcccaactctagaattgtgaataaaagccagttaagatctttgaataaaatttgttgtgattttatcttttgacacatacacataggtatgcagatatgcaagcatatttatgtatgtttcatatatgtgtaaatgtatgtatattatatatctgaacacacacatacacatttgtttgaatcagattccaatgagattggttgataggtctcttctttaatctatgtattcttcatcctctttttcctttcaaacttttttgtggaagaaactggatcatttgtcctacattttcccctgcgatctagattttgcagattcaaattctctaatttcatgtaatatgatcctctgcactctgtattacttagaagctggcacatctagaagtttgatcagaccctggttttttttttggcaaacaagttcctatcaggagtacataacaacgcataacagatagtcttccttttagtcactgatgatcatcacttagatccactatttcaataagagatgcaaatttctataattcctcctttacttatcatcatcattattattatttttgagacagagtctcactcttttgcccaatctggagtgtagtggcacaatctcggttcactgcactctctgcctcccaggttcaagcaattctcctgcctcagcttccgtgtagctgggactacaggcgcgtgctaccatacccagctaatttttcatatttttagtagagacgaggtttcaccatgttggtcaggctggtctcgagctcctgaactcaaatgatctgcctggctcagcctcccaaagtcctgagattacaggcatgagccactgcgcctagccccttctttacttattaactgcagtatttctttacagaagaacctgcctatctaatatagttaccctaaagtacagtcattctagaaaaagcaaaacaagcacttgattctttctctttatctttttcaaaaccataaacaaaatgggataggttttgttcctcatcttcaattagtaaccttgttagtaactaagttggcttagttttgggagaccatttggtaagactagtaatcttgtaagataacatgatattccaggtcatctcatatacttcctgccttggacatggaaccagccatttctttaaagaaccctggctccttctggtgaacctcagtatggaccctcagggtattcactgctattggatactcattgttttcgggcatttccaaaggataaatcaacaaaatcagcattttaaaaaaataaatcattttgctacttctcatgcaaattcatttttttacttaatcataccaatcttacacctctgtgtttcttccaaaactagcactaacactaaaaatgactgtgagacaagttaaactttcttttgcctttttttgaacttcaatgtatatcccactaaggttgtactatatagttaaaatttctgtgacataacatcatttaaaatggttcttctcagtgtggccatgtataccagcaacatgatttacattgggacttatatattgtacttttactagttgtcttcattatcttggttttgttttaaacttaaagcaaaatttgtacacatttccacagtcaagtccacaaaacaccctcctttccacaaacaggaagcattgtttattaagtgtacttccctcttctgtgctgttttcacttaaaactttatcctaggctgggcatggtggctcatgcctgaaatcaagcactttgggaggccgagacagatagacaacttgaggtcaggagtttgagaccagcctagccaacacgatgaaaccccatctttactaaagaaatacaaaaatcagccgagcgtggtggcatgtgcctataacctcagctacttgggagtggttgcagtgagccaagattgtgccactgcactccagtctgggacacagagcacgactccgtctcaaaaaacccaaaagcaaacaaatactttatcctagcacatgagtctgttctcacactgctaataaaaacatactcaaaattggataatgtctaaagggaagaggtttaattgactcacagttcaacatggctggggaggactcacaatcatggcagaaggcgaaggaatgtcttacatggcggcaggcaagatagcatgtgcaggggaactcccctttataaaaccatcagatctcatgagacttactatcatgagaatatcaagggaaaaacctgccccatgattcaattacctcccacctggtccctcccatgacacatgggggttatgggaactacaattcaagatgagatttgggcagggacacggccaaaccgtatcacctagagatctctccacagcaatttgtacacagccctcattccttttgacagccacatagtacttccttagatggatgtaccacatataccataatctattcaagcaattcctggttcaaaatcatttggtttgctccagtctttaagttttacaaacagatacaatgaacagccttattttttgcaataaatttttgaggtatttaatatttttctagccatttatctctttttaaaaattgaaaagtggctaaaattatttcaaaagaaagagaatataatgcaataggaaagactactggtaaatatttattaatttgtccaataaatgaaacaatctgtcaattttccaacagaaaacatataacttcttcaactaattaagtagaatttataatccaatatattcagctggagtcaataatagagttttgcctgtcctgtcttcattatttttatagcatactatagatgaaaactgttatttccaagtgtttttaaaacaataaaactatttttataacagcccttattctgtgagtcaagtaatccatgctgtgcaactgagttcatgatgcaaatattcaccacactaacataaaatcaggcaactgcatatattaaaactttccaaattttaatgatgcaacattaagaaaaatggaatgaactatcaccagttgagaaatacaccgtccaggctaggcgtggtggctcatgcctgtaatcccagcactttagaagtccaaggcgagcggatgacttgaggtcaggagtttgagaccagcctgccaacatggtgaaaccccttctctaccaaaactacaaaaattagctgggagtggtggcacatgcttggagtcccagctactccggaggctgaggcaggagaattgcttgcacctgggaggaggaggttgcagagagccgagatcacgccactgcactccagcctgggtgacagatcatgactctgtctcagaaacacacatttcataaaagcctaatatgctcccaaactgttaaaactatgttataatagcatttttaaaaagcagtaatttaaacgtagctacttaaacattagatataagtagcactgtatgtcctcataagtctttgttatggtgatttttttataataaaagtatatagctttgtaaaatcctatttgttgcattaaaaactatttgggaaaaaaaattattatgggacaaaagaaatgcttatactgcttttcttgtatcttgaagcttaaccattttactgaacatttcacattactactggaacatattcaccaattggtgtttaaaaacaaaacaaagtgggtagaggagtcaacaaccaacaatgcaggaagtagattaactaaaggcagaagaataacacactgtttcagggaatgagaagagacggttcctttgaggaattgttctgtgaaggctatggaagtctttctcagctggagcaaagaaaaatagggaattctggcaggttatttatagtggcacacacccacaacttcagcccatctctgtcagccattgtgtagagcactaaagcatcattaacacatcctaataaaaacttttcacaggggctccctttctcatcaacatgcaaaactaaatgtcagcaggaggcccatagcttcaggaagccataaagtgaagtttgaacccggtaatgatctacagcagggtgtctgcagagacaaattttcttggttaggacagatgtgacagcataactgtgtatgtaaaacttcataccatttaaactacatatcctgggatttgtagacaaaagtatcctctttcatgcttcagaaagttatgaacaggcttttctatattttcttcttcaagccacttcaaaatattattggctactgtctatattctgtaatcttcaaaaatcaccagcagcacagtatattgcaaataataaccagccccaatttattctacctttaagatcgacttagacacaggaaaaggtaatagaatatttattgcctgcctgcaaggcgttaacaaccaaaacaagttaaaatatatgctgtccttcatttatttctccagacatgtctggatgagaaacatctggaaatctcttaaaactatgaattcctcaaaagaggggggggtaggtggggatggaaagagatttttctctcttctgtctcaaaatgactcccatctctaaacatggtatctgtatggaggcaatccctggggagtgggaaatttttctcatctctttttaaaaattttattaacagtttatttttttaagagatagggtctcactctgtcacccaggctagatgcccaggcagtctctcaccctgaaactcctgggctcaagcaatcccctcttgcctcaccctcccaagcagctaggactacaggtgtgtaccaccacacctggcatcctcttttctttcactggcttcctgaacttcatttttccatgaggcatcagccaaagcctatggggtcataccagccagtggggagaaaggaaatacaagagtggcaaaataagaaaaaataaaaaataaaataggtatagagactaaaacagaatgatggggatgaatggaactggccacctacccccagttctgaggtggtttaaagaaatgcgaacaaaaaagccccaattaaaaaaaaaaaacaactggagccctatttaacaaaagtatgaactataaagtgaacagtcacttaaaatgagaaaataaatcaccaatgttactggagccttgagagaatcaggtccccttcttcggagatctcttgagaaaatttaccagaaatgttttcaaattgcaaccttgcttctactctcctcctaggacacttaacataatttccagcaaaccccattactcagggcctgaaagtgagggtcctgaaccttgaacttccctagcttcatgataagcctgcctctctcagcttgtcctttccaaggaccataaattttccctttccttccccaaagctgcttaccatcataagatttctcatgcccaaggaagtcacaaatgaagctgtggtacaagtcaagtgccatgctcagtggctactaaaaaactctagattcacagtaactatcccagtttgtagctcactgtaatactcttcagtccttctgataaagggcaactcttgggaactgagccagaaactcattcaccaagggtttttatcccctgttgacatttcattgttaagagatgtgacaagatctaagccaagatctaagctagggtcccaactctatcaggcatcacagctgataacctatacaacataacactcgtatatcaggatacaagtggtagggtgatggacgagtatccaaaacagaattttaattaccaaagaagtaattaacaaaaacggcacttggttcactacatgttaacaagaatcccttctatagcaactgtaataaaaagatttttcaaaaggactgctttttcaacaatatatgcttccatctcctaatatggaagagggattactcctctacattcccagacactaactcaagtgccaggaatgctacactgataatccagtcattgtcaaccttcaaggaaatccatggtaactagccgtagaattggtttcttgtttgcccagagtcctgactttgtaagaaatgttacatcatcccttttttcctctctcattgtcatctttatcatcattatcatcctgtctaattctccaatattaaattctgcaggagaacataaccaatgatatctgagaagtatacgaagatctcagtagtcccttaggtatgaggtgatacagcaccctttatttcttattggcaacaccaaacttaaatgctaggggttctaagaagaccacaacattaaattgcactctccctgggctttgaggattatccacccagatatgtaccaattctgacaaagaaagcatcctggagctttctagtggaggtggagctagggggatgacaggtttctggctgcattctgtcattctccctatttgtgcatcaaatattcaagagctggccacattctacgacttgcgtgttcatttgtgtcacaatgctctctgataataaccatttgaaaagttgttggtaagtacaaaacatgcatctgaaattacaatggactgaactaaacaataataaacaatatttcaattgcacacaggaagaagaaaaaaactagccaaagcagacacttactaaatataaaataattgtaccttcaaaattaattacatataaacttcaaaatgcaaatatttcataaagagaaacactgattttacattattaaagtaaaacttgggtgtctaatcagagtatttttagattttaaggttgccacctttagcacaagagttcgaacaaaggctcttatgtttaatgcattaagaattaattttcagaataattcttgataggaatgcatggaattgtattgacaacccccttctccaaatagaccccttttcacttttcaaaggcaaaactctccttttcttactgcctatcaagcagacaagcatgtaattaaaaccattttactaattctctttttagattaggtgccactgaaaagctgctacaactctactgttggaataatgatttctattatagtcaagctgaatctgaattgtacaaagggtaagttttaccactggattagatggaaaaaagttaatctgtaaattacaaaaaaaaaaaggttattgtcacaatttgaaatccacaatatgagcacatttagtacttactagactcaactcttgcatcatttatgtatatactcctccaatgtgaaagaattggcaaaactcacaaaagataaaaaccgaaagtaaattttaagtaaaactcaaaataaaaccctaaaataagaacatatagaaatttagttttctatttgggtctttctcctcacaaacaaacctataaaaacaaaacttcataacgtacaggggaaaacaaactctataaatgtactaacaaatagactgcagggatttatatacttcctggtaattagcagcttataaaaaaaccttcacaaaatctgaaagtaaatatctgcatgctcatatagattatgaaatatatatttttgtgttttgggttttgtttacttttggtttattttctagtgttactgactaacagctttattcagataattcacatatacaattcactcatttaaagtatataattcaatggcttttagtatattcacagctgtacatctattaccacaaccaattttagaatgttttctttgcccgaaaagaaactctgcccctcacagccgtcatctcccattccactcacccctctccccaatcccaatcccctaccacccaaccttaggcaactactaatctaccttctgtctctataagatttacctaaacatttcatacaaatggaatcatacaatatgtggtcctttgtgattagcttctttcacttagcacagtgttttcaagtttcatccatgtagtagatgtatcagtacttcattcctgttcatgactaagtaatattccattagatggatatactgcattttatgtatccattcattagctgatgggcatttgggttgtttccaattgattcatttttttaaacagtatctcttattttgttttactttgttgactaaaaatattcatccaatcaaggcatataaagcaccatctcctcaaagtaaaataatttactttgtgttcaagaccatggtcaaaagtattgaatgtcccttagggtcaagttttaatattcttaagtaaggtatatcatcttatgtgggcctcaaattttctcatttctataatgataaattatctagttataatgagacaagactatttctgagtgtaaagttttaactatttagaaactgatgtttataatgcaatgtaagaattatcaaaataaagctgaataaaactccaaatgtagtacagtgacaccagtgtaaaaccactccatagggagaaaaacagaataataaatatcctgatcctcccctcttccctccctccaattctgccaaggctctcactggcaaatccttccgaaacacaagggaggatcccaccgctgagtccatacaaatcagcctcctgaagcaaggagtagatgcgaaagagcaaagagaagatccccgatccccaaaccatttcaaacagcttttcagacttggaaagtgaacagtaaaagaagaaataaaaatgtcagagctgctagttataaggtctcaacattattagcatgaacaatggctatctataaatataaatacaaaggtgccaaacagtctaaatctaagaacttgtcagtacgcactgctgaagctcaaaggttaagttaacaaacacacacacaaacactcatgtcactatcaacactactttgaacattctgagatggaatacatgaataaatgttcctagctagtacaaaacatcaacaaattaaaaataaactgaatttactcatacagcttataatgcagatattctgtattaaaagtggaagatgtattaacagtatgaccaaaagagcttcactgagccttgttcgagactattgacacttgatgttcacatataaaaataataacattagcaaccatcacgcagtgctagcagatttaagagtacacttggttttaagaaggttgacatgaaatcccttcttgctgaagaagatatacagagtcaagaactaactcattaaggtgaattagatcccatgctattttagatacaacccgatagggagtgtgcatttgaaaagctattcaatcttcaatctatttaataacataaaaaccttagattacatagaggacaagtctctaccacataataaaccatctttattctttctcttttgctatttttggaaaacagaaaaacacaatgttgtcacatattatacaggggccatattcctggagttcccccttaattccagactaaacataacaaggaatgaaaggtatttctgtttactctatgaagtggaatatgaaaattaattcatctcaaccactttgaaaattatagtaaacttgacaaagtaaagatgcacattatttcacaacttgtgcacaaagttttacacctatctttatatgacagtattttcagttttggaaatgtgatcacactaatgccaacctttccttggtttgtttatgtagaatttgacatggttcttcaaaatttgtttgaggcaacaatctaaaaaggtctatatgattattctgtaagtggaaaaaataatcaattttattctgaacttgccattatcactctggctcaaaggatgacaaatttctatcttccagaggaactaccctcctcattttgaagtctttctataatagtaatcccatgttttgtttcattccaactttcaagtacccagaaccaacagacttggtgacaaccaattcacattaacattgctttccagggtaccttagcctttttcaggtggattaccttaaacattcctccctcagatcttaaaaataaaagagaacatttactatctcatctatatattatcaggatgcagtccttgggctctcccagacttgtttgatacctgtgttataagcacacactgagagaattagctgccccaccagaatgcgggacacattaaggcatctaccatattttatgtgggagatggagtcaccaccataatgaccctgagctgcattcagagctgacattgcaacttttctggaggcatcttgggaactggttgtttaaacttccaccccatcagaaactcccctcaaggtaccatttccctgagaatgccataaaaatgtaatgcaagtaggctcctcccaaccctcaaccaaaataacgtgataaagttaaagtccactttaaggcctccagtgtatcgacctccataagaagcctagtaggcagaggcgaatcaatagactaggaaacacggcaactaaccagacagttaatccaatcttcacagaatcatagatagggtgaaaattgggatgtgatttgggaacacggcttagaagagagctggaattctgtaggtcaagaaaacatatggtaaactgatagttataccaccctgtctacataaggaagtttgccaagagtaaaaagttgcatagaaagtatagtattttcaactactgttattccaccttacaagttcaactacaactaccacctttataatttgtaaagtgctttcacagttattatctcatctgaaccatattacaaccctatgagataggtataattatccctgttttagctgctaaagcttgagaaagtagttgctaaggagcagaggtgggatttgcactggtatgtcactgattccaaatcagatgctctcattccatggcaccaggttgtctcctgtagcatgagactataatcgaccaacacaaaaaggagacagggagaggatgccgaccaaactgccaagctaatgcatctgagaagggaatacatacaactagcctgtcctccattcctgggctggacgcttcactaaaccagacgacaaagccttctggaatacctgctgtgagttgggcactgtgaaggcagtatgcccactcccagccctcacagagctcatggtgtaactggggacaacaaagtgtaaacaagtagttaaatgtcacaagataaatgtaggggagacaaagaggtagtaaggcagcatgtcaggaaatggtaaacaacacatcatgtcacaccacgaatcatgagcaatccatcagtggtaggattcgaattaaattacaattcgattttacttatttattatttaggagacattctgtttttcaattttttttcttctccacatcagcccacccattttaaagccccaagcattgatatgatttcataccaataatttggagataatgatttgtgtctcggttctgcctgcatggatctccttctgataatttggggaaagaatgatgtgtatctcccctcttttcagagagtggccttggggattttattctttgttggggcagggtcttagcttttctgacagatttaggaaacaggaagacagacatccagaactgaaaaatctgtcaaactcattttctttcacggttttctgccaatttttgctccctccctttctctctctctttttccccttcttttgagtaagaggaagagttgggaaaatacgtatgtgccggttcctaaagggacagactaataagtgctgctgagcaaaaatgcaggtgcgtactagtcagaaggtcactctctgctccttggagatgaagcaggaagtcaagcaggaaaagggtaagtgaatgcaggcagtagagaaggctagtgggagggacattctgtccgtaactgtcacaccatcatcagagcactgaggacagaaggctgatttttgccttcccaggactgcacaagtcagaccttttcccccttcctccatttctcatctccccattagccagaaagcaggaaagaattaaacctattttattgctaaataattaacaaaccactggcattctgacaagttggcatgcattttcttaatcagcaacccagtaattttgtttctaagctacttaagataaatactgtcacttaagtattctagatgagcctatgtccactatccatttccttgcagtagcttgagtaatgctttctctcccttcgagcttccttctaacccaagtttggtttcttttcacacttagggattacactattaaccctaaaggtagcaataatatgcctaggatagttccatcagaaaaaaatgacgaggtttatgcgacttttaatgatacaattactcttcgaagatcctaggaactcaagttacaatagagataatgacattgctcttgataaggtcaccaatgacagcttaagcctaattactaaagtcaatgattctatagaattcttgtcaaaacatagcaatgtttgacagagaatcacttattctctctgccttgaaactccctctccccatgcaccttgtccccaactatcaggttctcattctctccttctcctctcccattttcgtgcgttttccttatcagtctcttctacctctctcttgggtatgggtgtgttcctaggcaccctggatgaattttctttatatgccataaaaagccctttcctaatcacctacctgtccacaacactagccttatgtgaccgccataccacatgccttccagcttctaagcagtgctgtgcttgtcctgcactggagcgcctgtattcatgtggctctgtctttcctcttcagtgcctcctatccccttcgacaggcctactcaacccggaagatcccacctggcatagttgttctctgtccttttccttaccaccatctgtaatcatgcacttgttaactatctgtcccactagttccttcaggtcatggactctgttaaacacttgtatcctctacaatgcagcaagtaaccaattaagagttctgaataataaagtaggttagaacatcatgtccaaataatagagactaaaaaccaactaaaaattttccatacaacttttacataaaacacaggaaggctttctgagctttatgatgtacttcctattccaatgctttatttttcaaacaaaagtaatcaacaaaataaccttagttgtttatacacaaagcaataatttctgctttacgcaaagagtagtatttgaacatgaaagcgacaacatatgttcaaaataaaaatctatcaatgttcaaaagtatataaaccctagttggagtcatgggttacacacacacctttattgtatgtgtagatctatatacacacatatatactcacacatacatactcatctagcatccctattactgtcttagctgtcagaataccaactgtcaataatgtcacataaattacatagacggtggcacagaattttttttttcaaaatataatcattttatagatgcacataatacagaggatactgcaagaataccaatgagaatcatcatgccagtaatttggattacatttccttcagttctctagtgtaaacaaatcttcttccaaatagccctattagtaaatgaaatatttactacatcgataaatttgccaaaaaatttactggcccaacatgttttcaatgtagagaagttcatttcacaaggtatttatttcatatccattgtcaaggttcccatacaatgagggcctttaaaaagcttaaacgggttcaagttctaatgacattttttgagtttctatttttaaaaaatcaatataaagataggatctcttagttgattgttttttccttgcaaattgtaaatcaaaccttgaagatatagaaaataaagatactattttaaattctgcttttaaaactgtcccttacaatgagtctttacatttttacatctcttaaggtggggggatagtgttactaaaagggtgaccttgagccctcttagcttactaaaggcagatgatagaatctactctgctgagattattgtaaagatgatgatgtatgagaagcatttggactggtacctggtaaacagatatgttaaacacatttattgaactgacaaagtaatcaagctactagtgggggtgttacaggctctggagtgagaatatctgtgttcaaaatcagtttgatattctactagccatgtgaccttgggaggcatttacttaatatgcccgaggtccactagccttatctgcaaaaaagtgttaaccagacaaccttgctcctggggttgctgcaagattcgatgagataatgcatacaaagggctcagcacagtgtttagccattcactatcttgttatttacattgtattaatatcattagcacgtcagaggtggtgggaagcaggaagatttgcccaaaaaattctgagagactacaaattctctgcaagaatttttaaaattaatttttggtttttattcatataataatttttgaagttaacaaaaatacttaatgacaacttgtatttacatgaacaaagaggtacaaagtagtcatgtaaaggtgaacttaatatgtggatgacactcacttctcaagcaaagatcaaatgaggccattccttgctgtatgaaggcctcagctagtttgaataaggaaagcagtgaggaactcagctgtcatgacacatgcatacatgagaatgctgaagccaccagcataactgtgcaatgttatttttaataaaacattactatccacgacattaaattaactctctaattccagttttaatgggtctttagtttttgttttgtatttttagtagagatgggtttcaccatgttggtcaggctggttttcaactcctgacctcaagtgatccacccgcatcagcctcccaaagtgctaggattacaggcatgagccaccacgcccggacgggtctttagtttttttgggtgtgtttaaaattattttgcttttaaaacttatgagccatatattatagtaaaggcttaactagttttatattttacatgtttataattatcataatataatttaactcctaactaaaggaggcccttttttttttttaactatttaaatctttttattcatctttgttgaacagctttctccatctggtttcgagaattcttggctaaaaattatggggttcagcctaatcattaaaaaaaaatcttgtcaaattctgccatatttcagaattgagaaacttgtgaagtaaaaataagagtataaattagaacaatttaactgacctcactgttaacacactgagttaacagtgtgtcaaaaaatgagtattggaaagggaatcatatatttgagattctggacattctttgactcaaattagccactgtggggcaattcacatcttctttgggcttcaatttcctcatctgttaacagagtatcctattaatagagtttattcactcattctatagttttgttattttctttcagcacctttattctagtgactatactgagttctacagatacaacatgaagtaagacacaaatagttctctgaagcagcccacattctatgggaagaaagcacataaagtaaaaagtgctgtgatagaggtatgtccagagtccatatgggatcacatacatctcaagggatgcatacaatatgagtgcacagagtgctagatagcaggagtgtgggaggtgtgtcccacccgtgtctgagctcctaatagagcttcagtttctctggtccagttctgtgccctagcaagactcatccttctatttccagggccacacacccgattccagaggcttaagagtgctctgaactattgaaaatgggtggaaaaggtctccatgggatgaacaaacagggaactgacatgttgctgggcaatgggcaatgatctagatattgtcagcaggtcatcctcatcaggctacagtgagaagggtcatctaattttccaagcgatgcacagtgctttctcaaacagaaaaggctggtatcccagaaagcccttccgtggctttgtgctgctccctggcactagcagctgcaggacatttgctcccaatgagtcagcattctccctttgtagactctatctctgcctatctgctttactgtggaaccttcagatagtcaagggaaggaccagatctcttgctcttaacaccttgaccacagatctttaaattgaacaacaaagaatttctcatacggtactctggttctgatctaaaaacttgctttgggatgaggaatacagaaagaatggtaattcttcttatttaccctaccaagggagatagggtaagtaagaattgaacacagtggtcaattccaaatatcatttcatcatacgagctgttgttatttgtgatattactagcagccagatcacaccatcttctttagcaatccattctgcccctagcatcaaagctttaaaatggaatgaggtacctttcatagactcacaaaaatccagccttctttatgtagcaagtttagataagtgatatgatttgttcagattcatacagcagaaccaagggtagatgtcactttcaagttcaggcttcctcccagaccaattactattttattttatttttctagactaacattttgttacctgctgatgtcttgtttgttgcacaatctttaaagtcagattgttttcttatcccggccttactatttgctagctggatgtacttgagcaaggcactttacttcactgagacttatattctaatctgttagatagagactcacatctgggggaaataatatatgccccttataatcactgtgatgattatatgatttaattcatataaaggttttagcacagtgacttgcatatgataattgctcaataattttttaacattttagatacagttttttttcctttttttaaattatactttaagttctagggtacatgtgcaaaatgtgcaggtttgttacatatgtatacatgtgccattttcatgtgctgcacccattaactcatcatttacattaggtatatctcctaatgctttccctcccccctccccccacccgacgacaggccccggtgtgtgatgttccccttcctgtgtccaagtgttctcactgttcaattgaacaatgaggaggcccttttcatttatcaagcttgagaaacattgttttcaggaaatgtgtggattaatttatcagatctctcacaaaattataaccaaataaaataactctgcaaatctgatagatggaaaagcaaaagagtatgaaaattaaatgctataatgcataggaaatactctatatagtagctgtcacttgccttgataaaaatttgcctttatcattagcataattatcttaatcattagtcatcatcaactatggaagcacctattcatcttctactttagtaccagggaaggaaaagtgggtactaaacaattttcatcaaacagccaaattggtaataaatgttaattttgcctttcctattttaaatagttactgttgtctggaacactggccacactgcttgctgttttaagcctactaaaactggtaaaagccaactactgagtaatggcatagtattctgcttgtttacaatcagaaggttgtaagcagaaatcataatctttggagttaacagtcaaataatgaagtacatcaaagattcacagaatctcctaaacgaacaacatgaaaatttacaaaggaagatgttaccggatcagaaattaaaataagactgaatgaaatcctttaataagaaaaataatcagtgcaagaacattcaacattcctgcatatgttagaccaaggcatctgtcagtgtggtctgaaatcccagaaatgtcatcattttttaactctaaaagtcctccaaaatagaggactaagcagaaaaaatgaaaacaaactgcaaaacacgtatcctattcccaaagaaaaagaaatagtgagggccaggcacagtggctcacgcctgtaatcccaccagtttgggaggctgaggcaggcggaacacttgaggtcaggattttgagaccagcctggccaacatggtgaaaccccgtctctgccaaaaatacaaaaattaggcgggtgtggcagcgtgtgcctacattcccagctactcaggaggctgaggcaggagaattgcttgaacccgggagttggaggttgcactgagctgagattgcgtcactgcactccagcctgggcaacagagtgagaccctgtctcaaaaaaaaaaaaaaaaaaaaaaaaaaaggaaagaaaaggaaaagtgaacatcattaacatttaagctttgcaaaatctggataccaaatcgaatctgtggctattgcaaggacgtgtttttaccacagctttatcaacatcaaagttggacataaactttgtatcaaaagatatccctcccacagaatatattctgactatttgtaaaatgtccttcatgcaggacagattacattccttttgcatttctgcttgtcatgaaaatgaagttcaaagttaaaattttagagtatgcttctcaagatacattctgtgcctcagaactctctaggttaactgacaggatcctccagcgctgagagaaccccaatcagctgttgacctcctggaactgtgcaaacactatatgatttaatatatataagcaaagtagtgatgtacacatataaacgaaaatggagattcattaacctcaatgtcttgataaaaataatagggtatctgaacttcagcaatgggaaaggtagagtgttggggaggaacttaactaaagatagattaagacagcagagaccatagttggtgactcattaggatactgaggcgatggagggcaatgacgctatttctgacttcaggacaaagtaccaactcctaacagtggcagtgtcggctcttcctgaccttgcctgcctgcctcaactccctcatatttgatattccagctatactaaattctcccttccaatacagtgctcctccaagcacccaggcatttgtacattgattttttttttttttgcatgaaatacccttctctagctgaaaaacttctacttaccttttaagaccctaacatgtccacacaataacagttttctatactcctcgccccagcagtttaatcccagtcatttatgcagacaaagtgtgctgctcactcttccactgtgagcatgcttatttcacatttggttgaacaatcaaattcgtgctaacttagaaagggatttttcctctggacattaataataacctcattcctccacacactaatcagagtagagcctactttcaactgtcattatctgcttatcttgttttactaatgggctgttggttccttaagtcttcaggaatgtttctcatttaactctgtacctagcaacttagtaaatcctcagcaaatatttgctcaataagatagtaaaatcgtctaacatttagccatctaaattgtctacaattccaacctatgcttatcatcatttctcaagataaagctgtggtaaaacataattccccctcatcatcatccatgaatgggataagtgttttttctcatcctcccttcagattacaaaaacccttgctctctaaacattttttctattgctttctttaatttctctattaatttttaggatgtaatacatgcagaaggtaatattttacaatagagcacagtgtaaagtttacatgactttcaatcctgtgtgggtcttagtcctgtctataaagaatcagaatacatatgcagctgtatttgggtctctccaattatttgttattctatagctaagtgtcttcccttgatgcaaattattctgctttttaagagatcacagttttgtttcataatcccactgaatgaaatttttttcctttgcaggataaatttattttaaaacaaaaccaaggcaaaacaaaaattgatgttacggttaatggtttaaggggtaaagattctcaattccagttctgctatcaaatcagaggcaagccaacaagcccctgagaaggggagagccctgttaagcaggacactgtcctaaaaccacggaactgcatcatcacggtaatgccctatggtggacactttgttctagcatgtgtagtgggtcactgctttttaaaggtaaattccaccccccctcagaaaacgtgtcatgtgaccatagggacttaactgatttttttagaaatggcccattattttatgagcaattttttaaagcagcaaaatataattttagcaagtggaaacatgaggccagaaaaacaccttcttaacatttaacacatgaattgaaattctccagaacagcattactagagtatgatccagagaccctgaggagctttcagtgactaatgagaggttcctcaggaagaagacacagtgctgatattcaaaagagaaacaggaatgtgctggtaattaatttacctgaaggtggaggaaagacaagaccctgagggcaaagcaaaaactaaaatgacactggctttaagggcaaagagagaattagcaataaagaggaaggtcactacctgtgaaatccaacacaagcccgaagcctcacagcaatgatctgaaaaccacgaataacaccagaattcagaaatctatgttttcacttcctatttaataaggcaatttgaaagaacctctattcccattcaaaaagaaattaaaattccacagaaattatgttaaaacacaagtttacagttccaatgggtttctgccataaagctgcctcgccttctaaattttgaggttgtgagatgacagcacccaaatttaataactaggtctttcaaaaattaacaaagcataagacaacagaaaaagaaatacttaaaaaaacctggaaacctttgattatcaaaaaatgctgaaataaattaccataaatcttaacagagtttaaatttattttgtttgtataatgcttacagcttatttgtgaaatcatgctcatgctaagatttaaacaaaagaccaaactaagaattatacagtaaattgggaaagatgcaatactccttcactcaatcagctaatattactgagcaccgtggatcctcagtaacattccaccttcacatacaatcttgtgaacggcttgtaatacaaagaaaaatatttaacaaaattgaaaaaggcccatgcctctgcttacaccagatttcctgtgatatacagatttcctataaacttagcacctattaactactggaaagcatagttgtgcctgagtcagcacctttccttccatcttgaaagtcttctctgcccagaagcaagcagcccactgagcccctagctatgggatcaagagtaaatgattaaactctcggtcttggcttcctcatctgagaagaggcacctgtgaggctcaaccatatgcaaaggaccttgcctgacttcctgtacaccacaggaattagttacacagagtctcatcattcaagatccagcccaagatgtgatgcattcatctaggtcaggataagctctccttttctggattcctttaactcttaagagtttagcttatcactgctttttgaaattgtttacttatgttagtgattctccctagctgtacttcataccatttagggcagatcccatcatatacactgaagcacttcctaaagcactagtcaaaataactgaccattaattcatttatccttgaaagcctgagaaaatccatttttaaaaaaacagactgatagctagacagtaagagcaacttttagaaaatgttttaaaattataagaaattcccctacaaacaggctaatttaaaagtcttttataaactagctgtaatattttatctgaaaatatttagcaagtcatgatattataaatctatttcttggacatccaacaaaagtaaatttttgccatatataaatcaaatacataattacttgtattattccacttatgtgtaacaatgcttgatggataaaataccatctggcttcaggactgtccataagacttccctgaataatgatgatgttgcatttataaaactgaccctttcttatgctgcagcattatcataagttgacaatggtttaacggttagcccagaggctgctgaacttcatatataagttagcattaaggtaataaaatatatgtgaataatgcttatcaaaggttacacattttagaacagggtatttcatctgatcaaattatataacataagccggcaaggaaggaaggagtatagcattttcctcgtcatcttttgaataccatctttttcagtgtcagctcttcaagtcacataataagtccaagcttaagttcatagccttgtaaaatcttgctataaactactgagaatctttttgtgaaaaaatgactgatctaatattttcttgttgtaaggatcacagtcaatttaggatttctaaaaagtgtttaaattgacatcagcctgtactcccaccattctgggaagcagaggcaggaggactgcttgagcccaggagttagagaccggcctgggaaatatatggagactcttgtctctaaaaaaaaaaattaaacgattagctgagtgtagtggctcacacttacattcccagttactctggaggctgaggtgggaggatcacttgagccccggagactgaggctgcagtgagctatgatcacacaactgtacttcagcctggccaacacagcaagactctaaataaataaataatagggaacataatacttataggcatggatacattccttcactagagacatcataacaaagattggccagcctaacaaaaataggtcaagttcttgagtatttttgccaatcagagattttaataggtaccccccattcaaaaattaatttacatttttttcctacaaactgctcaaagatacacaaagcaattcttatcatttcattaatcctattttatattagatcataaaatggtgcattatacatgttgttttatgaccacacagctgttccttaaatagttgctgccttaattgaacttgagatgtggtttcttgaatataatgaaaatatactttcaaaaaatgccttatttgggagacatggaaaaagaaaaggaaaatgctgtcaatacccacagacaagagttaatatcatctcttaagaaaagtatttcagcactggtggaaggctggattgtaccaactagaaggttctttcccaccctcctgtgacaacagggttagggtttgctgttcttcacagtcaacgaaagtagcagagtttaaaaataccttttgattaccctaaaagcaagtaacagttgatgccaactgagcaaaaaagaatgttgatattcaatttcctgcctatggacttcctaggggagagacttggtaaaacatgcttgttgctgttgatctggttgcagagctattctttcaattagctactggagacacagatagtataattaaataactaaagataataccccccaagaaactcattttcagcaccagaccaagattgcagtagtgccttgcctgaattttgtattttattgtcccagtccaccctatgctgaagatactaatagacaaatagccaaaaatcacttggaaaacagaactaagaagaaaatgaaaggctttgatccaatagaaacatggatagctagactgatcatagcactgttgtgccaggaaaaacctggaccacactggactgaatagaaaacatcaagaaagaaattgttttaaaaatctttgaagtacaatttaattaattattaaaatttgaaaaagaccttagagatcattttatgattaaggaaactaacatcccagaggtacgtgacttttctaaggtcacaaagctagtttgctttgtgaataagaacttgctgaataagaactagcctacagatttttcttatttatattcaggccaagatttagtacactagttccctataccttacttaagtttgatgtgaatatgctctttcgatcataaaaggtatgatggattttaaggtcgattgaaaatataaatatacaccctatagttgactgaattcatgtttttctgctgaggcaaatggacataagactagttagccccaggccagggctgacaatcactgttctaatccagtattttgagaaaacactatggtggcttgtgagcaactcctcacattcacattttcacatgagggtgggagggtaagtattttggtttaatgagttctacctctctctgagctcagtggacagcaattttgccgcatttagagagctgtgtctaacttggttcacatataatctgaagtctgtcctgggtagccagtaagcaaatcagccatgaagacttttgtctgacaaattcaaatgaacaaacaacaacaatacaacacttggtgacaggagctggcatacatgaatctgatttatttaattctccgtatacctattagcctctgagcttttagaaataatcactcaggcagtgcgtatcacttttattttgcctgagaactcgcaagcaatactgaggaaaaatccaacagggcagagcctctaaaaatgtcactgaactctaacacagcagggaagggatttccttatttcatgttattgtttctttgctattttgtttttatgagaatatacaacagtacaaaatagtacaaaataacaaaaatagttaagagtcaccaccatttcaggagttgcttatttgtcttcatctgtggtcaagcttctgaaaaatggccagagaatcttcctctttacctggtttctccaagtcacatagcagaagaaagccaattttaacactgtttcaaagaaagggaatagtacttggaagtaacatgcagtgcaaaataaaaaaaaaaggatacacacacacacacacagcataaaatatcaaaagtaccagactgctcttaccagcttatgggccagctaaacaactgtttcttccactttgacctgttccttcaacctcatccacccagcaaaatcctaaacttgggatcaatacagcaaagcacgatctctcattcagatgcaggaagctgaaaacttctgggggaaaattgtgctgtgcttctcctccaatccatgacttaaatcctaatctggtaaccagtaacaatgaacttttttagctatccttggtacagctctttctcaattccctcagagactattctagatcatcactaggctctggaccaactcacaggtgatttatctcctgctctcctgaaaagatgaaggccaccagccctggtcaaagctgaattccccactctactcttctatctaaaatatattatacgtatagacagccacacccatccctaactctgaactcctcctcctgttggagacttacttcccaattgagttcttgaccctgacttcctctagagagacagattatcctcagtcctttccttttttcaatttttctctttaagctttccttgtacacagccataaacttaaaaaatgggtcattcctcccgccaccggccttatcttagtgttcgcagctctacttagcagtctctttctccgtctcttttctcttacacttccacaaacacacactctctctatctcctccaactcaaatatattgagaaaagacacttccctagctagcaagcacaggaccgcaagcactgcattctacttgttcacctgctcctctgcacacgcgtgattttccacctcagtatcctcatttccatcctgcccctcaaatcttaactgtccaaggcatcattcccatatcatggctcttctcattcaccttgtatggttgcaaccactaccacatagtatcaacaaacaactccccactgttgactgctacatctgcaccttctagccaagattcaacctccatcttcagaaaatcatgtttaaatacctactttgtactgactgacattgtcatgtccataagcatctcaaagtcacacatcggatggaaatcttcaactttgttctcaatctggtcccatactctatattcctattctcaaccctagagtcacggtaatccttgaatccctagtgcaaaacactgtgtttgggacttagtaagtacttaatgtgctgaatgaatgaaatgattaattactttcaatattataatttcctacaaaattagtatttaggtcatgtgaactaatcacatgataacgccacaggacacaggttattaactaccactgtacccatcttctctaaaggagaataaaaatattatccatctggaatcatgctcaccactgtattataaacttgtttttaaaaggaatgacatttagtgaccagaatacaagacctttgagaccatgttaattttcgcctaacacaagggagaacgtcaaccttctagcaagcagcaacagtacagctaaattcactctggaacaacctagtttgcaattgagaagttgatacaattaagaaaatgtgtttatactgttctaaagaagggattaacaggattattatactattttattatcctaaagaagtggctttccagtgttataactaccctatagtcctttccaacattagaactctatagttattcagttattgttatgcttaaacatttcctctactactgtatagttccgtaaatctctcggtcaaactttgctaatttcctttatttattaagccttcattgtttttaagtaaaaggtccatttatttatcattcaatcacactacggtctcccactgagaaagactgtgtacctaacaaaaatcttcagagtgtactcgggaaaagagactatttccttctgtgtgggtcagcatcatatcctgtcaaaaatcaggaccctatgagctctctggggacactgaccatggttctaaataatatatgaatctggacaattacaaatgtatgtttttgctttttgctcacacacaagacacactaggggcttgcctctagttgaatggcttcttgttttcactcagtttcagcctatgctctcatctcattagaatttcagtatcctctggtcttgcagagttccctttaccttcttttgtatcagacaaaagatggtaatttacgtctaattaacggaactgagtcataatgagttcttttctcttagacagcatttgaatgtccaaaataaccagagagattgggctttttaagtcttgctccagtttaaggttttataacacaatgctctcattcaggcctcctactttgcatacagtcagagggctggaggttatccacattgtgaaattctttggctagttatgcccagagtgactgaatggcaggcaggctgaatttaatattttctgctaagcagctctgttgagacagccaagcttacgactgcatccttttcatgtctcttacttatactttgaaatgctatcttttgcctgttgatgaatttgatagcattctttatgagatcaatttccttgagaaagatacaaaaggcaggatgaaagacaagtttgatgcaaaacacacaaagggctgtgcatctgtgtgaagagaagcatgataaagcataaagcggttctccccacaccatgatgagggacaaagatgtaaacacaataagcccgcctaaagaaagcaaaagcacatgttctaacgggagcagtaaccaggttaaaatacttgaagcatcttcttcctctcttatgccagagcattttaaaatgccctctatacatgacggcatgccaacacaaacaaactgcagaggctgaactccactggcatcgtgccgtcctgaaatgacaccagttagataaactgggtttttactcctgggacagtcttcaaccaagctttttattacattgggttaagaagaaaaaaaaataacccttgtctccacacttcaaaatccaaatgtgtattcctttgataggatattgttatattaaaaatactgtggcaatatcacttgtcatcatgttctactgacacacatattcaccaatgctccaaatttcagaggctcagccactcaaaagaaaaacaaaacaaaacaaaaaaagaatgaatgaaaataaaaaacaaaacaaaacaaaacaaaacaaaacaaaaaataaggctgaccaaactttcatgatgggagccctgggaccaagaaattatagctgtattataaaggacaggcaaaccacactacagatactcggttttttactctctcccgcctcatttttttcctccccctcaaagagggagtgaatgtgaaatttacacagacaagctcctcaatagatacacttgatttgtcaaatggaaagatgacccttcagtaactaggctgcttggtgaaaatattaaaccagacagtaagtcagagaaaattaaatactaccttgattaatcaggcttaatgggtgagaagcaactaatttataacactacattgacaaaaacagggtaaagaaaaaggaggctgtttcacatcagattaaagtataatttctttttctacttttcttggggaaggaatatattgatactcataaagtcaactacatttttgaagatataaacaaaaatcactgtagacatagtctttgccccttgatactcaaaatctaatgtgagaaataaaacatacgtaagccctgaacacgcaaatgagttttaatgttaatttatcaatctgacacttgaaccataatttttttcattcgaattaaattgaaaatcatttggatgtctccaagttagctcagataccctttctaaattagagcagagtgaattaacagcacaaggaatcttgcaatcttgcctttcagcctcatgtgcttgaaggctttcagaccctgaaggtgatggggaggaaatgtcctggggcctatgtaagtctgtccgagaggcatctggtgagctaggcacctcccaaaggaggtggacagaggaagagggtttctagcacagcacctgcaggggttttaaagggttcctaagggggcgggcatgttccctgacagccaccttcccagcaagtcaagtgttgctaaactgggggccttctatgcatagcaaaagatagacaccatacaaagaagccaaagtgtgaaatgagtggaggcagatattgcatatcaggagagaaaatacaaattctacgctgggtgtcacaaaaagactacagtgccaattcaaggggaaacaaatctgacttgaaaaaatattaatatctagattattacactttagtataatttacaaaatagccactcttaaagagctttggaaacaaaagcctacacactgtgatttagtttcattcatttgctctttctcataactgaatagaagtataacagaaaagagaggaggaacagagctcatcaagagtacgtctcctttacatgtcattcaactctagcacactggaaaagcctgcttataataaagaaccaatatacagaaacttcagaaaaacctaaatgccaaacctagatctttgactctctaccagatgaggacaccatcaaatgataattttctagaaaaaagattttaggacctcaaataaaagagtgataaatacaatgaaattccttctatataataactacaacagaaaaatcaaacaacaatattcagtcacaacttataataaccaatcacatatatttcttcacattataattataaaatcttcacattttaatcattacagtcagtagtgtttcctagaaggaaatttttaaagggttattatgccttactatacatacgggttatctagtttccataatcatttttttaacaaaaaattgcatataaattgatagtctgtaaatagagttacattttaagtgtccttgaattatttaagtaatttaaagcaatttcaattgcaattttgttcaagtccaataatcttttctaaagcaaatggttatatctaatttatgcatttcctaattggtccaacctgtaactggttttcttaaaacaagattaaagaaagtaaggttagccaaattcataattagtactctttaccaggtcttattccaagagatgcatttagcaataaatatttaatggacacctgctaccctgggtatgtgaacagtgccaggaatacagaggtaaacaggacagagcccgattcctgtcctgatagagctctccacacttcagatccatattcacctgacagaatcttccatatccacgtgaattatgctcttataaactgttttattacatccttagtaaatctatgaggtttcactgatgagaaactaaagtgtagttagcataactacaaaaaattattggatgccacagatgtcaaagaacttggagatcaattagtctggtggttcctttcctttctgaatataagtatcaatttttaatttataaacaaaacagaattatacacaaacacagagctatgtggaccccacatattagtaattgttcttttttgcatctgttgactaagacaatgcctataaactactttgaattcactacgcttttaaatacatgtctattacagtaatctcaataacatctaaattaatttgtctcacagtgacaaatgtgtggcattggctgacgtatggatttgtgtattggacaataattccaagggcctttaaaaggcaataaaggcaaaaatctcacccatctccttcatgtcctcattgcagcacaaatgagggccagaaatgactgcactatcttccaaggtcataccactggctagcgagaacactgaggactacagcttcttccccccaggcagcgtccacaagcatctgctcaggtgttacccatacccttccctccacagatgacaattctcctttagctacaaaattcagaagtcatctctgtgtatgtttattagagtagcttgtactgtattccagcaaactggtggcaatgctataaatgctctccctttccaaccttatggtagataagaactcaatgaaagctaaaatataacttcagggcaaaagacaaattttcttttattgtactgaagaatgttgtatccatcatagcctacaaatacccagaagccagtataatatttctaatacaacatgtatcttactggtttggggaagaaaaaataatccttttattccttttcactctgcctacaagtagaacattgagataatagagattaagccttaaatttctatatccaatagtggttgaatcacaagaggactgaaaaagcatttgtctctacaagataatacctaatatgctagtcctccgggcagtttacattgattttgcatttaattgcataggctgattttctcatattttccaggacaaagttgtcaaaatgaaaggatctagatgtactctgctatgaagccaaaagaagaaagtaaacttaagagcactggtttctgtaataactatatgattgcaaaaagttttgttttgtttttttcctactagaaattgacactggggatcacaaaccaacttgagagcaaaggtgataaaactgtactttctcctcaatccctcatttcccccctctgttcttaaattactttcagaaatgggaagaaaatgaaaacaccccctgacacttaaatacctttcacctactctgtaacgaattggatttaattccctttagttcagttagctagtggactttgtccttcagtctgtctggtaaatatttcacaattctctctgtatgtttttgtaaagtagtgggaaaaaaaaaccttattcatttctcttaccatcaaagaagacaaagacaatattttgatgggaataaagcagttaattctaaatgattaactcaaattattttttagagtatacgtttcctgaagcttcacagaaaatgatactttaaagacaacttactgatttactatttgaagaagctaccactggaaaattaattaaaataccaatggctttgggacgttctcataggagttatttgaaaatgacattaatacaaattttgtttccaaagaaaatggtaaacttatcttttcatttgattaactgagctattttaatcactgtttaaggaacatccccccaccccaccaccgccattagtttgctagggctgccattacagactgcctggcttaaacaatagaaatgtgtattctcacaattctagaaactacaagtctgagattaaggtgttaacagagttggcttcttcgcaggcctttctgcttggcttgtagacaatcttctccctgtctctttacgtggtctttcctctgggtatgcctgtgtcctaagaacaccaatgatactggagtagggcccacctgatgaagatcctctctccaaataccatcacatactggggtttaggatttcgacatatgaattttaagggaacacaattcagcctgtaacacacctacgaaccaaaaattaactcttcatttccaagtggctctataatgtctccttctctcagtctaacatgtaatgacagtcttgcttcttaaaggccaagaaaggcagaccttcagaaggcagagaaattactgaccatgatgccaaatcaacaatagtcagtactaatacaggtctcaccttagcctttactaaagaaatgattaccttcatgtataaatataaaatgcttatttatgaaatgaaacaaataagtcagaggaaaagtagcacacataattttgtttgtcaccctcagaagactattgtaataaattgctcaatccaattatcaaaattccttctgctaccctatttcaaggaataggaatgaaatactgattagaagagagaaaaaaaaaacaaaaggatgaaaagaatctaaaattgtaaaagccccataaaaactctgcagttgaaaatattaacatatactattattttaaataatattattttgtacggcaaaatctttgaagaaaccacagcaagaaaaagtccctaattcagaggtggtatcaaatgacattactatatttctaattttatttacctttcttaaaataaatgagattataggaaaacaacagaattgtagaagtcttcacatctgtccccctattttaacagtgagggatgaggtccattaagaaattactttcttaacaaccaaatggaatccaccaatattccagcctatgccaccccctacatttacattttgtgctctttcaaaggcaaacaatgattttgaatatttttctattattgagcaaatcacaaatgtaggtaacaccgagttgtcacatctgtccctccgaaggacttattaaaaaggatagtggcaacagagcggttggacatttcataagtcatcacgatctagtaggtactgcataaaagattgaaacaatgctactactcatatttttgctcaaagaacaccttttaaaatacaattgatgactatgtgaagcttttctccaagaaaaaaatcatatatagctatacagatagatggatatatacacacacaaaatctggcatttcagagagttgaaaatatcccccaataagtattataatatttaaacctctgaatcagataaataaaaacaaagcccaagttagaagatactgggtaaagtctcttcttcctgatccctcatctcaactaaaagactgtttccatgtaataaaggaataagatgggagtcctaacttgtttttaaaattctgggaatcaataatatagattttcaaaggtttctttctactctttacaccattcgactcccatatggaagatactatttagctttgtctggtatgattaagatatgaatgtctttatcttttaaagtctaagcaaagttaaaaaaaaaaagaaaacaaaacaaaacacattaggatgttctcaaaaccaacaaaaaatttagctataaggttcagataaaacattgcgaaaaatcaccatcactgccagccagttaaatgattaatacattttcctcgacatattctatttcattcttttatacattatactgaaaaactaaaacttgaaacctagtagtaacttgtacatgtctttgtcacaaagagaatcataactaaacctcaaaagtaaatttcacttttactttttaaaaagtgaagagcatacacatataatatcacagttctcagctccctgaggcatgtttggaggtctacacagaatgaagggaaacagcggggtgcctgagcagaggtggtcctcaaattcgactggacacgtcccatagcccacacaccaatgaatctaaattattcttggagcacattaaaaacttagactcaaatgagcaaatatgtgaataaacttcctcatcacatttaggagaaaatatatccttctacaattttgaaataatctccctttaaaagaaaccccagttagcctagtggatgttgcaactgttttggagttcctcaactataaaaatgaggagttaaaagagatgattgtggccaggtgtagtggctcacacctgtaatctcaaaactttgggaggctaaggtgggcggatcacttgaagccaggagttcgagaccagcctggccatcatggtgaaactctgtttctacaaaaaaatacaaaaattagccaggcatggtggtgcaagtctgtagtcccagctactacagaggctgaggcacgagaattacttgaacttgggaggcagagtttgtagaaagccaagttcacaccactgcactacagcctgggagacagagttagactctgtccttaaaaaaacaaaacaaaacaaaaaaagccaggtgcggtggctcacgcctgtaatcccagcactttaggaggctgaggcgggcggatcacaaggtcaggagatcgagaccatcctggctaacatggtgaaaccctgtctctactaaaaacacaaaaaattagacaggtgtggtggcgggcgcctgtagtcccagctactcaggaggctgaggcaggagaatggcgtgaacccgggaagcggagcttgcagtgagccgagatcgcaccactgcactccagcctgggcgacagagtgagactctgtctaaaaaaaaaaaaaaaaaaaaaaattactgctatagttcctccccactctaaatgctacctttcagagacttcacatttttaaaaaatgaaagcaaggattcaatgggccaggccaatttaactcaaaacctataaattggggggaaataaatgttaaagaatttataacatgttatatgacatgttataacatatgttttccaacaatttctgttcattgctgctttaataaggtgtcttgactcatattttttagtgccttaagatccttctaagctctaaaatcagttttcacactctgtcagttaactagggactcaagtttttcctccttgtaaatggccaggcttcaggtaccagggctttttcatatgtatatgctccatgtccaataaagcttcggagagtattcagacatctaataaatgcttgctagatgaacgaacaagccaaggagtgactgcactgctgtgagttaggcatgtggaatttaaaagaaaaaaaagggtcgggtgcaatggctcatgcctatgatcccagaactttagaaggacaaggtgggagaattgcttgaggtcagatgttcaagacaagcctgggcaacatagtgagatcccatctctataaaataaaaataaaaaataaataaaaagttgaaaaaaaaagaatctaactacagggttccactgctcaggatgcatccagaaaaggggacacaggcaggtaaaaaataattaattacaggctgggtgtggtggctcatgcctgtaatcccagcactttgggaggccaaggcgggcagatcacctgaggtcaggagttcgaaatcagccttggcaacacggtaaaaccccatcgccactaaaaattagctgtgcatgatggcacacgctagtggtcccagctgctctggaggctgaggcaggagaatcacttgaacacattaggtggagattgcagtgagctgagatcatgtgactgtactccagcctgggcaataggatgcaactccatcaaaaaaaaaaaaaaaaaagaaagaaaagagaattaccacatactaatgactaagttcctcaatggaaatggagaatacatacaaggtacaatagcaacacagaaagggcctgaaaaaactggagagaggcataaaggttacagcacgaattatggtgcatcctaacatcagaaaacaaactatttgggaattatgcagtttaaactagttctgtttcctttataggtcactgtgagggtgattcagacatgcttttatgccttaacgtgtctggatccaagtggaaacccaacagtatgaggtgctattccctcaataccactgggtatgtaaaagtacatattacagactttaaattttacaaacataaaaacatatataacttggaatgattcctgaaagaatggaatgacctttactgtgacaaaggaaaggctttaccaggcaagtatttgggcaaaaattatgaacaattttacacaagtcaaaattccaatagtaaataatattagaaaaagattggtccatgctagtaatcaaagatgtataaattaaagcaaccttgagatgccattttatggctgccaaggaggcaagttctttttttttttttttaacataacacacaatgatgaagtaactatggtagagaatactattaattagtaacacatttctggaacgcaatatgaaaatacataacaacaaaaaaagtagtttcatataattccactcttaagaacacattctccaaaaatacaccacaagaaataaaaaagctataagcattaagttgtttatttggcattatctgtaaaaatcaaaaagtgaagcaaaatccaaaattatcaaatcagggaagaatgttaacaaactaaagtgtattgacacaatctaatatcatgtactcaatagtttatgatcgtgaaggcactgcataaacaaaacaaaaatttgttatgaggatatgtaaaaaatgtgaaatgccacgtgcactttgtaaataagacttaaatagcataaatcaacatttgctcttctgtagcagcaatgcttaaaataatgacaagctaagcatgctccgtacttgagcaagatcaaaattaaaaatctgccaatgtagtgaaaatatgcaaatttttagcagtagataatttctcccatgataattttaagccatctttcaatgtctagcacacatgccacctcattcagccatccaattctcacagccgcaagtaatattttctcctacctctgtatttccagtacactctgcttagagtccccctgaggcattatcagggtctcccttgtagctgacggtgtacccgctctgatgtgcaggataaaagaaagtagtatcctttcttcacttctgcatctgtgtctacaaggaatcaatgtgtatttgtgtttcttaaatttagatacctgtgtttcaaagctagaaaaaagagaccaaaaagggattgaaaatggagatgcacagtctgagtcctcctacacacatatggttacaatattccaaaggaaatacagctatggagttttgttcctttttttaaaaaaaaaaaaaaaaatggaactcacagccgggtgcagtggctaatgtctattatcccagcattttgttcttgcaagtgcattcatatctaatctgcatttctgtccatttctaaagtacagttgacccacagtacccatggattctgcatccacagattcaaccaactgctaacaaaaaatatttgaaaaaaatgaaaacaatattgcaaaaagtacagtatttacatagtgtgtattataagtaatctagagataacttaaagtatacaggaggatgcacatagcttatatacaaatactatgccattttttatcagagatttgagcatctgcagattttggtatccaaaggggttcctggaaccaatcctctgagaataccgagggacatctgtactatgcattgctacttaaatgcattatttaaaaatgtactataaatggccattgaaataagagctaaaaataagttttataattttttcatgttcctaaaaagattttcaatttttgataaaatggagtttttttgttaatttccttttgttcagaaaaagaaacagcatatttgaaagactatagaggactcttgcaaatagcaaaagtttcaatttgtatatcctgtgtcccaaaatttcattgcagaaaatttatcctaaggaaataatcatagatctgataaagattaagtgccaaggatgtttattccagaattttatataatagcaaaatgttggggaatgggaagttgtaaatggtctataaaagagcttttagtaaatatactaatagcacatctgtatgctgtattgctacacagatatgacaattacattgaagaagatctagtgatcaggaaaaataacttaaaatatatcatttaggaaaaatgcattaaagaggaaactcaatttttgaaaaaataaaataactggagttattcttatcatttgcagtagttatgatccataaagttgccaaaaaacactgaatttgtaaaggctgaaccactgctcctagaagaaatgcaaagttaggttcctatgagcctctggtcacaagattttcatcaactgatcaataccttgttttatgtgcatttctgtttaaagacaccttatttaacattggctgttgatttgttaatattgaccacatggccgatagcactataactcatgcctgaacaaaacttattgactacacgtattttctcggtgaggcacatccagccttcctgtgcttaggaacactagacagcacttcagtcctacacatgggggccattttaaacagtgaaatcaccaacaaaaagcacacaaatgaggaaacatgatattaagtaggctgcaaacaggacatttgtttagagtctgaggactgaaatagtaaggcagagaatctacttgttcattctcaggtgggaaagtgtgtgctggctgactcaaattttttgctactcttcatgtgtctgccaatgaccaagacagtgctatgtacattaattgggggttacaaataagtctcaaggaataggtgaattttcagatatggacttcacaaataaggaagagtgactgtatatatacataggggaaaaactggatggatttaagtaatctataaacagaagtctctccatggagtaactaagtaagtgtgttacaggtaatacttattttctttttgctcatctgctgtttcaaggtaaatttatcatgcatcaattacttataaaaatgacatatctgattacctattctaattatctactgcaaatatttactaacttttgaattataggaagaaaactaacactaacaaaatcctttacaattttggtgtttacattatattttaagaactatcttacactgttaaatagtttgtgatactgagagttatttgccattaaccatttaccttaaccattggcagtatctaattttaaggagttaaaaagaatgcaggtcaagaggactttaactttctgtggtgataatactacatgaagagaaaatggactcaagttatttatagctgatacaattcatttccaaaacaatgatgtcatatcttacattttatgtttgtagtcacactaatatggctgctaaccagttgcaagacttcactgaacacttccacatcaattaaaatataaaatgttataactacacagtaaaaatgacaattggcaagaaaccactagaaagaagtttagtaagggcaaaaccaaccaaacccaaaaggagttagggagaagagcaggtaaccactacatataaagataaaaaattaaatataaatattaaatacaccttgataagaaaacaaggccatggaagtataagaaaaattgagagacagtgtgatattagagaaagcaaatagcaagtgaaagcatgtgcaatttcagatagaaaaatatttgatctcttttgaaaatcttactttcaaaggtaggtatcacctttagagtggcctaaatattaaatacgatgatcaaatattactatatttcagacaaacatctgtgaagttatacatttttaaccagcaaaaacagaagtttttttttatctatgatatgaaaacttaagtttgtttaatttctatgatgagcattcatccatccatccacccatccatccaatatttactgagtactgatgtttacaaagtactgtttggggcactggataaacaccacatgtgacggttaattttatgggtcaatgtggctgtgccatggggtgcctgggtatttggccaaactttattctaggtgtttctgtgagtgtgttttgggatgaaattaacagttaaatcagtagactgaataaaacagattgctctctttaatgtgggtgaggttcatccaatcagctgaagaccagttgaaccaatcagttgaacaaaagcagaccctattctgagtaagagagaactcctacctgactgcctttgaactcgaacatcagcttttttctgccatcagactcaaactgaaacaatggctcttgccaagtgtcaagccagccacccttcagattggactacaccatcagctctcttgggtctccagcttgctgactcaacctgcagatcttggatcttgtcagattccataatcccatgagctaattccttagaaagaaaatcctatggctcggtttctctggagaaccttggctagtataccatgctgggctaccaggatacatgagcatgtcagaggagtcctgagtttctccaaacctggtgtatggcacagtttacctgtggtcttcagtctagcttcgcagatttttcaaccatgaaaatcctatgttattcacatacacattgcattcccaaagttggaaggaatttctaatgaaacctaagaactttttgttggaacttaaagaaacgaattaatagaatcttcacagttattagtgtaaatatataaaaccaactcactatgggccacatcaatgcaatgtgcacactgcccaactcactagctgaaacattacatcttcctatcccactgaatagctaataccataaaaaagagtgagttagaattcactctgacatatgcttttaaaatgtgaagttctgcaaaacttttaaacaattatcagtattatataacttgtgacccttcatatttgttctcaacacacactttcttgaacaccccagtggagaactgaccatccagtatacacgatgatttaaacacgtaaaacataaaattttacctttaacacagatactgctaatgactagaattgatgttaatggcttaaataactttctagttgcattggctctagaacaccttagcagtttgcttcccacttagtattttatgtatcttaacttttgttcaagagtatagtatttcagaccttcccatgccctcaaatgttaaagtatacacaaaaactctacctccctagcagtatcagtcatacgacccctgtagctatttatatgactctcctgactaaacacaacttaattttcatctgccataatgaagttagtggtgaattctcctgcctttcaaagtcatctgcacctgtattcatttatttaacagcaccttattgacttatatttctccaaaagccacctggggacttgactgtaactacacttgtgatttataaacaaatacatcgtcacacatttcagaatttaatctcaccaagcttatttcatacctatgtgcaatttaatttgagcaaaatgctatgtttgctgaaatagctgttcttgtggatcagttttaaaaaagaaaaaggattgattgaagtacaagcataaacttttctgccatccaggaaactaagttgcatagtttgaggtacacaatagattaaaaagaatctaccctaagcatgaaagggcttctaatttccttgattgcttaagaattccaaatataagaaagaaaaaaaccacttcaccctacaaacacaccccactttggtcacagtgaatatcctaccaaaggcaaaattaaccacttgcgcacctgtttcagtttttctctgccctctccatctctgcctacatctcttcctatttctcaaattgctcaagagaaaaaaaacgaggaatgtgctggttgagaagttaaagcatgttcctatttcccacagccacccataaagaaatgcccaagtcgtatccactcaccttaatcatggagcagaaactttgtctcctagaaatttgcctgtgtcctacttttccagttagaagacagagcaaaaataactgtttcctccctctctttgggacaaagtattacattctccgtaaacccaaaaatcatgagttaattttagtagaaaaaatcttattttttttcattatattaaatggagaaatgaaatcccaagtgtttggaattgattgactacaaactgcctaaagaattgttaataagaaatgaaaatttcaagcacagtgagggtattctgacccatctctgcagaatcatttcttgaaatgttctggtgttttttaactggaaacacagaaggcaatccttatccatatccttgctttctgattctatatatccagccctgtgagcaaagctatggactacgtgcaagaaaagaggtttcttttcacactgactatccagtagtgactgacagtagttggtgccttgggaaagagcaattgcagagcagattatttattttataatgaatatgcaaattattcccttgcctttttaagtcaagagtttagccacttaatgtaaattaaatatacaaaatcctaaaacttatcttgtggcttggagcaaattattgctattgagaggccttatttacttgacttatttgtgggaggaaaggtggcaaggggtgggcagtagtggttcaaagtacttatctgagaaactgaaatggaaattggaagaaaatataaagcataaaaataggctacagtttatggtgagcaatgctaaatatctaggaatccctaacactgcaattaaaactggtttcagattatgaaaaaaaaaattagggggtaaatttgaagtcaggtgaagtacttcttacgtatatctgtgctgatttaaataatcaaagcctattatttgcctataaaaaatactctgttttcactagttacttaacactaggtactcagagtaggctgatactcagtaaactgtcagtgaagaaacaaatgaagtaatgtaaataaaacacttatgcccaattaataaactccttatatatatatataaactcctttatatatatataaagtatatatataaaaactcctttatatatatataaagtacatatataaaaactcctttatatatatataaagtatatatataaaaactcctttatatatataaagtatatatataaaaactcctttatatatatataaagtatatatataaaaactcctttatatatataaagtatatatataaaatacatataaaggatgtatatatataaagtacatatatataaagtatgtatatatataaagtatacatatatgaagtatgtttatatatatatatatacacataaagtatgtatatatatacacacacacacacacacatatatacacacacacacatatactttaagttctgggatacactgcagaacgtgcaggtttgttacataggtatacacatgccatggtggtttgctgcacccatcaacccgtcatctacattaggtatttctcctaatgctatccatccccctagcccccatcccctgagaggccccagtgtgtgatgttcccctccctgcatacatgtgttctcattattcaattcccacttatgagtgagaacatgcggtagctagttttctgttcatgtgttagtttgctcagaatgatggtttccagcttcatccatgtccctgcaaaggacatgaactcatacttttatatggctgcatagtattccatggtgtattatatatttatatacacataaaaaaaatcaccagaaattttaaatactattaattttttttggttctacaatagaaaaatgggtgacacagtatgaataccactggcccaggagaagttggggcaccactttttctggcaaagtctgccagctgtggccagtggcattgagctcttgcagtaattcctgatgccagctggctatgactttttcctgtctgcctatccaagaaaacaatcagtgttaattccagcaggttgtgttattgatttttgttactaaaacagacttatgatgaagaactactataaacactcttatcaaaaatttctttaggttctctaacatatattatgaccataaaagtatttaccatatattcattaaaagaaccctaaagtcttttcttctgaagaaactgactaaatcaaaatgatttaaaagtgcacaggtatttgttctttatcataaaatttgataacaggaaaatggagattgttgtaactgttgatatcttgaaatcaaggataacaaacagatatttaatttttctccttcttcaaatattttttaaaaaccatgaagcaatccaagaattcaaactaactgttttacatagaattcttatgcttttccattattttatggagctattcttattaaggagtaatagtcctaaaaatgggtgagaagtgtaagtaaaattatctttatccaagataatcatcttcattctcatgattaattcacaaacagaattaaatgtaattcaatagacaaaaaaacatttgattacctaaacatacatatagatgcaaatacatatctatctatctatctatctatctatctatctatctgtaatatatatctatcttctatctagatagatatatgttccatctatatgtatgtttaggtaatcaaatgctttttcgcctactgaattatgcttaattctgtttgtgaattaattatgtgaatgaagatgattatcttggatgataattttacttgtagatagatagatactcaccataatgaaatacatgtaaaatatatgtaaaagttcactcctgtctagcttgataccatgatttttttttagaaatgttatatcatgtttattgaagaaaattttcaatggtaaaacacttgatctagagccagatttcttgggtcacaacccttcttatactattctagctgtgtgtccttgggcaagtcatttaatctttccggaactcatttccttcaactgtaaattgagaaggttgtggttgaaaagctctaaagttccatcctgttctaaaaatctatgaatctgtgagagagaaagttcataaatattccataatcttccttttaccaaaatgttacttccaaatatagataaccttccatgacacaaagcaaatgttgtgacaaggtacctttcaattaatgcaaattttaaagttactatttaaaacaattcagaaatagagcaaactctatcaagatgttgtgatttcagataattcagaacacaacatagggatcacatgccaatcaaaataaatctgaatgaaacaaattattaactatgaattttacagagttctggaatacttccaaattcctgctatcattttcaaaataagcttttcatgagaaaaaaaatacagtctcaattaaacagaacatatcaattatacataaattaaaaaattattattattttttctccaaacctagaaggaaagttcaaactgacaacaaatttatatcagtcattcagtaaacctttctcacacacctctaatttctgggtcatggaccttaaactcaaaaataaaaattcaaattcagaaaaatatccacccacatcaatgtatagttcttaatttaaaatataattacattcattaatagaatcttaataaccaaagtatcctaatacgtcttacaaagatgtttgaaattaaagcttcacattaaaatgggtttctggtaaactacatgacttaatttaccagacaaaaacctctctactatgcagattagttaattgaggatttattgtaaaagcaataaccagaagttgtaatagatacgaattgagtagaattcattctctttaatatcctcaagatgttacttaactcacagtgcttattcacaagttctctgctcaggcagttaatgtgagattcttgaaaattttaatatcctgccagtagtcagtcaccattagcaaatgtgggataagaaagtgttatatctggccgggtgcagtggcttacacctataatcccagcacttggggagcccaaggctggtggatcatctgaggtcaggagttcaagaccagcctggccaacatggcaaaaacctgtctttcctaaaaatacaaaaattagcagggcatggtggtgtgcacctgtagtcccagctactcaggaggctgaggcaggagaatcgcttgaacctgggaggcggcggttgcagtgagccgagatggcgctactgcactccagtctgggtgccagagtgagattgcatttcaagaaagaaaaaaaaaaaaagtgttatatctatgttatggacatcaacttaccagagtttttttttttgtttcttcccagatggatggtttgtctttatcatcaaagaagacaaacattatccagtacagttaaaaatttctaggtatgatttaaaaatatgatgtcacatgtaaccactgaacagtgaggaagaccacaagatgagctacttttctgtttgtaaatttcagcacttctgtcccatttaatagaccttgtttctgtcttaactattctttaaaacctttttactatatgatggtaaatacgtatgagcatttaaaagaaatcaaattcaagtctttaaaataatgtataatttataatttcagtttagcatctctaattgtattatttatgtcacagatatcatgagataattattttacagtttacctagttacacaaatgtttagtgaaaattattatagatataagcaaggaaagtcaaaattatatacaaagggacaacctaatctggcactgattaaatacatactcacacacacaactgggcattcattaccaattccatgaatattttgtgagatgatgagaaacttgaaaacagtgaagctgaaaaactccacaagtttgacaattaaaatcaggcaaaactaaaatatactactatagtccatttactgcagcaatatttctggaaattctcgcaccatttcagactacaaaatcaacgttaatcatttcaaagatctaataaatttcttttcctttatgaaacaatatacatataatataaataatatattattgttatgtaaagaaagaagacacctacagctttaaagtgaagtctgtagtactgtagtgaaactaaaatactccaaactcaaaacctaccaatactgtgtttaaaatgttgaaaaaattagttggtgtgaccacagaatatggagtgtatgacggtatgcatattaaaatggaaactgttgaatccgtgatatattgtaatatagaaaactgtatacctgaggacacttaaaatgatgcaaaactaaataataaaaagtccaatgtagaaaatacgagaaccaaataaatgacttaataggagtataatatgtatgccataacactgataaatactggtacataccttacatttacaagtaggacttattctcctaatatttaaaagttacaaataagcatattagagctcttctcaactgtataaagaagcagtcaataaaacacagagcataccaggaaagagtgcagcaggtcaaaaaaggcagatgtcaaaaatagtatgttttcctttggggacaaaaaagtggaaggttttatgcattttaattagccatttaaaaaaaaaggaatcaggtgaagactaccaattatcaccttctagccccgctaacactttgtagtctagcggaaaagaaaaggaaaaaagaaaaaagaaaaacaccctcccattctaggccattaaaaaacattcacagtttcctccagtatccttccaacagctactgatgagatttatcttcaaagaactttcttgtttacaatacaaatcttcccctctgttacaaattaaacccaattatctggcgaacagtttccataataaaacctggtagacagaggaaacagtaaccttcccatttttttttcctctctatttgatagcctgcaggtttcaagaagtaaaaactacccttacttatcccattaacagataggtgttgagagggcatggaaacccctgggaagataaatggcctcatttgctttggatcaggatttggagacaacttccaaagatctgaaaaagtgtggaaaactctcagttgcttattggatctataaatgtttaaactactatgagaaacattctacagaaaagcatcattaactctttctggtcactggaatctacagtcattggtatatctagtcattgctgaaggacaaactacaaatactcaaggaaaagatccatttgttgagatagcaaatagatgaaatgcaatcacatacacttgagtcctggccaagtctaactcaccctgacacactggggctcagcttttaatcaagcagctgctcaaagacacatttgtgtccctgtaacagaacccatccaatttatgaggaatttcataaaatcaagtttattctaagtctccaaaatgcatttgcgcatgctcaatatatgtaaatttcaattacaaaattacaaattcaagtttattctgtgatactattttgcattaagcagagctttatcaggtgttactagccatttcctaaagatgtaaactgtgctttgcaaaaaacatagatgtacctaaaaaaaaaaaaaagacagaaacagctttccccaaattttcttaacctcacgtagaagcaagggtgtctaaataaataaaaaaacttcccctctcttccctcctactctgcagaattccatttacctggcaaatcatgaaaggcagaatcataaaactcaagtttagtcatacctcaacaggctgtgttcctgttgaacattaaatactttgacaacacaacagcgccttctccagtgctaaaagcagcatgattaatcttattaaaccagcatctgaaccacagccaccatgccatgggagaataattaggctgctaatgacctaaatactgtatctacaaactcctattactggagctagtaagaaataagagagaatattcacgcttaaaatggccaatcaaattaagaatattttccatagaaacaaggtatctatgctgcaaaataaatgtattttagtagactggcctgtgaccacaagtaagctttttctgtttaaaacaaatgtttaacactgttatgtcagaaaatgttttactaatttgcaaagaagtggcaaaacatgaaatgccctccaattttaagtggaggaattcctacatccctacactgttggaagtaaacagtaaagtttttctcctccttacacagttcatgcggtagttaaagaggaagattcactgaacataatgaaaacttacagctgaattctttggccacacctctgttacattattatagtaatacatagaaacaagacaataggaggagctggatagggaataaccatacaaataagaaactctgcactgttattctcaaaaactggagaattatttattattgcaaatttcagtatcattcaagacaaaaccaagtcttagcttccaggtgaattcacaaataactggtgtcaaaaatctcttgacacttttctctaacacttaagtatatgaaactcttttttaaaaattccacgtccaggtaatctgaagatcaagaagaaagcttttcttacagtttatgaaattatagattcttacaataacaaaaagcacatagtgtcagcatgtataaagtgttattgattcctctttcatatgccaaaatagtactttcaaaaatgcgggttaacaaaggctattcctttccttttttgaatgactgcccaagaatgtacataccatacttttggagaaaatcacttttgacagaaggaattgtcatggcaagagcatacaaatacaaggccatatggtgtccttttctgaggtaagaggcaataacccaacacacttaggagtttattccctttctgaattaagaacttggtgttgcccatgtaaacacatgaaatgagaacacactcatgctgtactaattacatacagggacctctgctgttatctccgctgtttagcattatcccgtagttaattctgctttgctttagttgcagccaaagactaacataacaaaacagtgtctccctacatgggaccctctgtcagccacatgctttcactgcataaattatttcttgagaatgaacctgagccctttgtgagatgctgagttaaggccaggagtaagagactgctgcagccacttcagccaggaattcagtcagaatcaaatttaggaaaaagggagtaatgcagacagaccaagaaaagaagtcagttgactgcggccaaatgcacacagcaatggccaattctcattgcaaaagcctttgcttttgttcctcatgcctgaaataacgactctgttctgcaagctactgggccaatctacctaagcaatagcaggagtcatgagaagtgggatcatgaatatagatgcttttgggaaactaaaagtagactgaggatttctttttgccactaaaagaaagaaattaatgatcgtgaaatcaatgcatactgtaattgctaaagtgaatatgttatttactgcaacaagaattcaaatgaaaaagacacctatatctatataggctgcaatggaggccaaagagaggtggtaagatgtggccaaaggtatccagctgcacaggacaaagatggctatagaacccaaaccactattctctaaattgttggttctcttcgccaagccacgctctctccggggtccacttctagatcaagcaggactcggagtacatcaagctaaatgaggttagcatgagaaaggaaagaggctgaaaaagaaagaaaatgcccatccagccatcggtctgtgcagagtcatggaagatgggccttcttgctcagtgttgcaaaaagagagttcttatcagctctcctatcgactcccaagcccagtctgcagtggcgcccctggcctacttacaggcattggaaagaggcaaatcaaatgctgccagggaagaaaacaacagaggaggacttctattatcaaacctcaaagcctccgcagcttagcctcagccttctcctctgtcccggagcccacttgctgacctagacagagatatttcgaggcatgggtgtagcacgtgcatacgtgaccccaatcccaaacccccaagcaatgaaatttcatctggattttcaatattagttagcataactttggaacagaagtggctttttaaaagactgaaaacatgtattcgaggtaagaatgttgtccacatcaaagaaaaagaaggaaagcactccgtcctataatttgtgggagcaaaacgataatcttagaaacgatctatccaagacctagcattttataaatgaactgagaatcagagaggcaggtgccggctctctgaaattcaaaacactgagttcccagatgtcttgatcaacctgaaacttttgagtgaagtcaaaccctggcagaaagaacactcaacctcaatgtcagagtgccaaattttgcgttaacccatgctatcaattagcataaagattgaaaatgtcattcacctgtttaaacccagtatactaatatgcaacagggaaagattaagagcttgaaacacatgatctttcaagttttttttctcagatgtaaagttctatgattctgttctgaactgaataagaataaataacaagaaaaaaatgtaaacagtttaaactgcagttaaaataattactttcaaaattttaaactaacaaacttttacaagtataccctcattttttatagattttcttccctggcctctgccacacatattcttctatctacaaaactagaaggacagtctgaccttagcatttaagggtaacagacaatgagcccgacagacaattagctgttaacagttagatatatttagcatttaagaaatgtactatcagtacactgaaagtatttggaaagtttagtcatcagcagatagagcatgaatcacgtccatgtcaccagcagaccacttatctaatcacccccactataaatgcaagactctgtgtctccagagctggtttgtttcatattttagctccacggtcacaggcaaattcactgaaccaaaataaaaccttctgacttgctgttttcactgtcctaaaatgggttagtgatgtcttgcccacagaattccacaccatgatctgaatgagtggaaaaagattctgtctggctcacagcagagatgataccaaatggccagtaaagaggccgactcaaattcctttgaaggaggcaccgaggtggtggattcagcaaaaggctgtgaagtttatgtaaaatttcactcataacttcaaacgcacttaaaataagttaacaggcaggttttctaaaagaaagtttcttaaaactacattatagttctcatgatcatctttttaataagccaataacctttactaccatgaagtatgtaggctcttataaatatcttctaattagtcattcaaaccttgttttacaggaaaagagaaaaacaacaacaacaacaacaacaatttcccgaggatccctgcccacattcagagtagcagatttacctacttcaaagtggagatcaaagccacactctaaggctccttatttccacaggctggcaagcaaacaaggcatacaggctttgcaagagtgtatcctaattctcttactgaagaaaagtcaacagcagagacaacacagaaaaaggaatcaaagaggccaaatctgtggactcaaaacaataagaaaaaataaatcaactttgctaaaatttaagaatgccaggggggtaggtaaatgcactgggaagtatgtgtggactatgatgataataaatctcctttcaatacaactgatatttatcagaccttgaataaaacactgaatgtggatactatagtgcaaagcatctatataggaattaggacagtggaagtatgaggtaagctgcaagtgtaatttgaaagtttccagcagccagattaaaaaggtaaaaagaaacaggtgaatggattttaatagcatattttatttaacccaatatatccaaaatattatcatttcaatatataatcaatattttaaaaggagacattttatattctttttttggtacttggtcttcaaaatccaaggcaaccacattaaaaatgatcaatagttacatatggctactggctaccatattgaacagaacatttaaatacctacatagttaatcatctggaatgcagaagtgtcaatatactgaggtaagccagcaaaaggaaaaaaaaaaaaaagatgatgaaaaaaagaaatatgtttaccaaagacgtggcacaaatattctccactgcctaagaagggaaggcgaggtagatttagcataactaaaataagaatgatttggatttagatagcttcatagctgatgagatgggaccaaaacatttctactactatgggcatttttacagaatcctcttccttggaatactgtataaaatacacatagtttaaaaaaataacagaattagctctgaaaaaaagacagggaatattcaatactgctataaattcctttgagcttttaaagatgactcttaatgtatataaagttacactccataaaaggctgagtaatttataaaagactgagtaatttatacaaactcccaagaggcacaatgaaaatatgcattttccttttaaaaatcgtgaaggaaaaatgacagtatctggagaaagaaaaaggaaaaagactatctaaaacaagagcagtcatttggaatgaaatcagatttcatagtatttagtagtggcatcctccaacaagtaagatgttaggtgggagaggatactagaggctggggagggagggatagagagagatttgttaaaggatacaaaattacgactatataggaggaataaattctagtgttctatagcactgtaggatgacactaacaatatttcatagtttcaaatagctagaaggaagacactgaacattcccaacaaaacaaatgacaaatgtttgtgcgtgctaatgaatatgctaattactttgatctgatcaatatacattatatgtatagaaatatctctatgtagcccatgaatatgtacaaccattattggtcaaagaaaaaagatgttagatggggcaagagaactggatcttagagtacttccaattgattccaagcctctatgcacacagtacactattttttctattggtcctcatataaacagtatataaacagaaacatatatccaatcggaaaaaaaagtgattcaatattttatatctggattaaacttatacttgaatttttcctaaattggcctgacaattgatgagcaataaaatgggctttagtttcatttaaattatgttcttctcctttaaattcctttgccatggagcagtcaaaggtggtttttaataatgactcacatatcaagctgtagttcaaagttgacgttgtctggacccggtgtcagtaaaatacttaagttactaagtcatgagagattttagttatagggcttctaaattttcacatccagaatctgttattaatatgccatgaccttaggcacactacaaccttagactcaacctgtccatcttcttaaaaaaaaatgaatgtattcttctccatctaaattgtaggctgcctacagaatgcaaaaaaaaaaattataaaaaaaagtcttacaatgaatagctttaaggtttaaattcagtttgtcaaaaattgttaggctccttgttgttctcaaccgttttcttgcccagtccagctaagtgtaacaggggttcctaagtcatgttccagtgatctccaagagggaggagaacgtttcttgcctacagaaattcagtgggctgagaaccttggagtggcaggagtcttcaacctgtccttaaagcctgggaaacaaactgatatccagaaagacctggcgttactcagagcgctagctcctggggtaggtgttgaggctgcagctttttatgaaagagattcctgacaaagattcctctgcccacaggggattgcccatagcaactacttccacaaaaaatgccttgtgggaagtggggcatgagtcatactgttttagttactcccctgttctccagaccctccaaactggaagatgcaggaatatcccagtgtgaatcactgtgctgtcctggtgctgaccaccacaacatccaccagtgacttagcagaagtgaaaccagtcaaccctaaggattatcaaacatgggccagggcaactgtctcctactggctggtgacaaagcttccactggttcctggtatcttgctcagagaaattcctgataccagggcccccagctacacaatcctgaggatagacagaagatggctgcggccctcatccagaaccacacaggaaccaccacaaccaatttattatgggccagctttccaattttccaagattattccaaagtcaggaaactgaattaaaatgatgacttccatttatacaaacatgtctatgtgaattttacgacacttttttttaagtgacagaacacgtggaatatccgcactctacttcatctcatgctgttctgaatttttcaaacagctatcaagaaaacaagcaaattcagtaaatctcatgaagtttttacactgcatttttattaggtcacctgaagtttgccacgttattctttcttggaaaagcattcattcaaacatttttctatgttaaacagtgataataatcatttgtttatttaatgaagtggttctcaaccaggggtgattttggcttctggtaaaatctggcaatctttggagaaacttcggttgtcacacctgtgaattctaatgggtagaggtcaggaatgctgctaaacaatctataattcacagaacgacgaccctatacatcaaagaattatctggttcaaaatgccaacagtgctgaggttgaaaaaccctggcttaatgtcttcggtaggtgtattttttttgaaattttacttttcaatccatatggcctggcatataaaaaaggcaacttgttagggagaggccactaggcaagatagtttaataatcaaacagtttctgggctttgaagcccaagcatctgtaacaacgaaaataataatgtgacatttttgaatcatgttttaaattttactgttttagcacattttctcctcagactctaggtattattttgagtgtccttttataaactatgttgagtcaagccacatgaattttagcttagaacaaagcaaagtttcttgaggaaatcactatttcaataggaagtcagttatcactgcaagattttcagtggagagtgaatgaccatggatgtgcctattttagaaacaactcccaaaagggtagactaagccagatgataccaaaggtcactgacattcaaggtttttatacaaaaccagctaatgattgtcatttccctgtttgtctttgatcttgagcacagaatcagtgtaatacaatgaatgctcaaggtctgagtgcctcaaagtgtgaactcctgacttagagaactgacccagctttactaaagataccggtgctacctgaaagaattaacactggcatactctaaaggaatagctgcttgttttatataataagtacctgtctcagtaatgaagggagaagaatcagtattttatcttttaaaaaactagattactcaaattttgtaggcggagtagggttcactaagcagcctcatctcctacagatgtgcccacgatctgatttttgtactcttcctccctcacaaattacaatgtatttgagataaatcttctaatttttgaagtttgagaagtggcttgctttatcttactgatttttatgctgctatttaatattctctttaaattaaaattgctgccacaaaaaggggatgccatggcacacaaaaaggcatccactcacatacttgtaaaaaaacaaattgctctaaataagattaactgagactggatataccaatctcaaattaaataaactaaatccatatggccagacatgtgattgcaggggaatatggctaaaggaaaaatatatgacttggataaatgttcacaactagcaggacatagatatcccttccaggctggccacctggcccacgctgtggcatatacactagggttagggctgcttacaccaagcacacaccaacagcttcacttgtgagctggttcagagattttaagtgctcctacaatacagtagaaagaggctccatgctgtaccacagacaccagagcctaggatcactaggtcacaaaatagattcacaaagagtttaaactatcaagaaaagttcatagcctcaaaggaagatgaattatacagatgtgtgcacaaatcccactttgcagaaggtggctcttgaaaaatgctcattttttgttttactttatattggttttaagacaaaagtggccagtaaaatgataatcacagatctaagagtaatttcagtaaccacgtagtgcaaagcctgcaatttacagacgagaaaatggcacccagaggtcgtacacaccaggtaagtttataatgaagttagcagctgagccaaaccccaatcccaagttgcctgactcctagactattactctttctagtatgttaggccacctgtcatctaaatgacatgcaccaccctgggaaaaatattaagagttttcatatatcagaacttaagggcttcatctgacttaatttattaaaaataaaagcaaagagcagtgatgttccatctgcatccttatttaaatattatctaccctcccatcaagtttagggcaacacacactttcctttttttctgctgagttctgtttttttttttaaatatatccccaatgatgttctatccatacaataaaaccgaatccttcaaaagttatctctatgataattaatattcacatacacctgtgttaaagaaccgagagcagtttgagatggaaagaagagtaagaagtgaggggacagaaatgcaacaggaaaaaaggaattaggaacaaatgctgattttgccacaaatgcactgctgcacatttacagccaaagtgctccatcttctattatgtatgacttttagtaacatcaatattgatcctcactattttaatgcaattaaataatcaaagaaaataatcaacctattttcaaagaatattgttaaaaagaacaaattccacagttctcattaaaaagaatgacacaaagcaagacaaaactgggtgagccaagtgttctttgttgttgttgttgttttataatgcatttacagtttaattagtctgtttttaaatttagttcagtgtgtgtgtgtgtgtgtgtgtgcgctgactttaggttgtgagcagtatgggaatcatagcaaaatttactgttttggattttaagaataaaaacaaaatagtgcacctaaggaaggaagacttaggccgtataccttagtagttattgacatattccactaattttatatcaaaaccagccttttattaagattgttcattctaaaaagtccccaaattacagtctaattaaatgggaaaatatgaactctgaactgcttatgaaaggaaacaacatatataattactagctaaaagtatactttgttatgttaaaaaataactttccaaatcctgaaaaatctctaattaaatagacataaataaagttattttccttgctccctgacatgtcctatataccacagaaaaggttactatacaatccattggaaagttcaaaaccaaaagaacaatccagggaacataaagaacttgagtcttcaaaaaatgctccccacagcagcaaccaagtccaaagtgggttatgttcagggaaaatggtgcaaagaagactcttgaacaaggaggaagaatcctttgggaaacttttcctgtgactcggaccaggtacagccactactgtcaggactgcttttcataggcatgtaaacataactgtaaatgccttaatgctagggcctgtgtcccattcaggtatatcccatgcacagcctggcaaaggaccaccatatggggagcttaataaagagccaaaacgaatgtgtgaatagaataatgttcaagaagcaatcagacacagaccaccacaacctgctagaaaacaaacagatctccatcagtaattgtcatctacatacaatcagatccttaaagattaaaattctagaatttgagatcatcaggttttgcaaatttagatgttttatgcataatttataaagcattcaataatgccttaatattgagcaatattgagtggacattctacaactgatcaattataatgcaaatatagaaaatatatgtctgctatttatatataccacctctattgtgccctaggactgaaactgtaacccaatattcattctcgtcttctcccacagtaatagatgttttagctgggcatactgccactcacaataaaaagtgcatttctctgtctcccatgaggttgctgtgccttttaagaaacctctgaccaatgggatacatgggtaagtgatatgtgtaccttccaggtcatgcgtttaaaaagaagagggcattctctgcctgcctgctgcttggacagtgaacttgactgttggccatctcagactgcaaatgagggcaatactatacgaggaccaaatgacaatgaaggaatcgggatccctggatgacttcatggaacaaagtcatcgtatctttcctggaatgccagcttccaaatggttacatgtgagagaaataaacgtcttccttgtttaagttattgttttttctatttcctgtttcacacagccaaaactgcattttgcctaactcataataaaccaagtgaacaaaaaccactatgtctaaattatccctaagtactctgactaaattctgtcatacacacatacacacatcatgattgaaactacacacacaggcacattcatatgggtcataatgtgtgtcatatatatatattttgtatgtatgcatataggccccattttcagatggcatatcatttcatcatgctgataggtccaagatacttcctcaacttcctctcaagtcattcaaccagatgttttaaaatatgaccaactgagaacttgactaaagaaatcacaggatgttcaataatatatccatatattttgatatataaaatatatacatcacttagttttctccaaaaactttgctattacatagtcatagatataaaacaaatatatgtctattcatgaccagaattgatatttcctgtaatggtacatggccgaacacgctgtatgtatttagaagatatgtcaaacctataataaagaagacagatgaacagtactataaaacacacagatataaaagggaggcatgatttatgcccaagtcagagagaaaacctatggaacttcatcgaccccatctatcctattctacattgtaaacctatgaatgaaagaacagtattgaagaaacactcagtcacaacacacatgggtcacccctagacacagatatcacccacactattaagttgtttgttgttgtttttatttcctttgaaaatgatcttaaactcttaggtaagggtttcagccctactcaagagaaagcccctttggccacaggtgttaagattttacttagggaatctgactctactcacaggcactgtaaaagctgatatttgataggctccttccaagtcaaggacaaatacagaaatccatggaaaccacagtgaaacactaatgttattctgtgcggtttcacattaagtatccagtgcttagaatatgttttacccagtaaccagctttcaatcaactaaaaatgaccgcaagaaatccttagccttctggttacccaggggtttagggtcaatagaaaacacctaaataaactaaattgtccaagagatcattacaaatgacatgagaaaacatgtgattgttttcttaaaggaacatgcattttcatcacaaccactctatttaaactactctcaaagggcctcaaaactgcccattcactgaatgcaaccttttcattatgtctcatttttcttggcctccctgcagtattctaactccttggtcattccttaattcttggaattttctttgtctttagcttgtgtggtactgacttctcccctaacctctacatttgggtcccacaattcaggcctcagctttctttactcttctctatattctgcaccaactctcatgcattagattccctaacttcttccacaaagctagacccaatctccagctctggatgtcctccctgtagctacctttccaacaattcaaattctttatcactttcatcaattcaacactcatctactaagtattgactgtgtgctggggattagggttaccaaaaaaaacagacactgtagtcccataaactaaaaccacactcacattggtgcgatagatgataaaagtctgaaccagtagcatagaagcacctgtctcagtggctgtgcacaaagctgtgatactttgcctgggttttgtaaaaaccccaagcagcgaagtgagcagggcagaatgggacggtggaggtgagatgagtaagtgattcatacaaagctgtacagcccagagagtttgggaactgcaatgatttccttcggtagagaaagaactaaaggtgatagaaaatgagggtggtcttcccttctccctcttgacacatggtgttggtgcctctggatttcatttggtggtactcgcattcttctaattacttatattcaaaaccttgaaagttttaggctcctttctcttcctggtaccatatgcccaaaaaatgtcaagcaaaacatctcaattggcttcatctaatttatacctatgttttaaggcttagctcagatgccatgtctccaggaaacctttttcaacctccaccacagcaaaaagtaatcagtctttcaaggatctactaatattgtctgtatttgtatcaaacaacccccctttttaatgaaaagcttatggaaagcaagactatttctattcagtgttgtactatggtatttgtgcacagcaggtgctgccttttttctcctaggagttttctttttgttttccctactcattattacatactggcttttgtaatcttcggtatttcaaaaatcacattttacgctattagcaaagtcaacataaattaagttagctaagttgggtttttcattttattaattattggactccatggtaaagagtggggtggtgctatgtaatctgaaaaattccttccaagtctagaattctattagtctttgatcatacaaaatatggttaacggaaaaacaagttagcacgaagatttctaattataaaacactaagaaataaactctttaaatcacgaccttataaggtgattccatcaaactttcttaaacacaactcttttagcagactagaggtgcttcactcttaatgcctacgaatataaacacttattgcctatgagtataaacattttcttaaaacacttagtaactaaaagaaattctccagtgggcctcatatgaattatttaacagtcatgtattaaaaatgagtaatttctaattaataggacaacctttatcaagatagatgtttctagtaaaaaacaatctcgagacaattttagatcatgatgaaagtttgtgaaaaatgttaagatatggtagccaacaaggtgacaaattgtgttttaacactttttatataagagatcaattttcaggcctcagttctgcctatcttgatacaagtgttagaaagctgatatcccaaatagtctaaaatactactccaaatatataaatatttttaaagataaaaactgcttaaaagtctcactaaaagcaaatcctgaactaagcataacaattcagaaagaaagtacaatatattccaaagtgttttattcatgctgcatacaaatgtatctgtagtaaaataagagttgacagatcacctctcagatgctatgatgatccatgtatttttgataagcatgctgctaacctgcaggcgtagtttcataaaatgaagaattttattcaaaatcatttagcagcaatcatcttatgtgattaagtcacagatattaactgaagcattattttgctaatactcaattttcctttcttgaatcaaatgatttctgttcactcattcttcattactagagagaggataggtttttggatgaacccaggagcaagctcttttcaggcttgtttggagggggttcaaatgcattgctccatcctggctcataagaaaaaacctcaaacataattttgatcgtgctttagaaagaaaaacagacaccttcctaccctggcagtgatgcttggaagggaattgaagcacaggcttcattccactgtatcgatctcactaaataaagggttctgaatttattgatcagctcagactaaacccctaactgtttgcaagaccatgcatgatgtgaagccctggttcactgaagaaggaagaactgaaagcacttttgttctcaggcagccacagagcagcaatttacactaagtagtagatgaacatgattaaaataatagacagcattcagttacaggatggcgggaggtgggggagataaaacttatgttaaattcaaagatttctcaattttaagaatgatgtagtaacaagtgaaaggtaaaactatctttaaaagaggaatattttatttgcatgtttctaagcagaaaagcaactcagtctctaacacagttgtttccttcaaaccccgaaaatatgcctgtagtgattttttttttaaggctacacagcagtttcttccccaccctcatcactttcactgactgctaaatgatgcatacagggaggggtaaatccaagattaattttaaggttcattttgtacatctgctcattttcattttcatttggaaggacattattttctttagtcaaactcaattctcattcaaaataagcctgaatgtgctgcgaattgatcttattataataaaatattgctgccaaaatttacagcaggcttttatctcagaaaaaggaaaaccacacccctttatcctggttttcagaacacaggccaagcatgtgtttcccaatttctgttagcacccatttttacacattcaaagcgttctcaattttaaaacaaacaaaaagaaagcctagttgttttttctaaatattggccactggaacatctcccaaaaggctttccacctagtctttcacattcaaggacttaagtactctgatctactacttcgatatcttggtatttaaaagagaagaaaacaatgattttgtattcaaccactgcattaatttttctatttcttaactcttttcaacttaaaacaaataaagtaattgtttccagtcaagagggagaaaactctagcccaggaactgaattcaagcttgaatgcaatccaaatatgggtttggccactaaatagctgtacagtgtggtatcttcagcaagttgctatgcctctcagtttcaagatatggagtacatgctgcctgttcactgggttggttctcacattttacgataattatttgaaaacagcattagacacaaatatgagttattttttaaactgtgtgggatttaaatgctaacatctttatgtccactttatcagagaagactacagctgtcacaaagaccttacgtactttttagttgggcagggaaaggggacagacttctactttacaatttacgttccagtacgtgagacattagaaaacttctaagttccttcctctaaaggtcaagaagacagaaactcatgacagatggtcctcaacttctggtgggaatacattccaatgaaactcactgtaaagtcaagaactgtaaattgaaccattgtaagccgggactgcctgtacattattacacagtcattaaataacttacccaatatttacaaagtacctaggatgaataatacattaagcaatgttgctgcttaatacagcaatacctaatgtaaaaactaatatctgctggcagtgattccaaaggcagataggagatggaatggagtaaaaaaaaatttttttttcaaaattcactttcttttaaaaaaggaagccaggatgaagtggaaatgtattggggagggaaaaaatggcaaacctaatccaaaaaatgtgttctatgagaatggacttatccaccctaacatattcatgttttacatgtaaacattaagcgtaaattcacttgatttaagaaaatgcttcattttgaaaaaattgggttaaaaacccctaaatcatcataatgagcatttactgagcatttactatgtgctgagcttgttctaagcactttataatattaactcatgtatgcaccctaacaggcacgtaagacagtcagcattagtaccctcagttttcaataaagaaactgaaggggttaatctcaggtttcatttacaatccagagatcagtactcctgattacaaaatgcgttaagtttacatttaagaaatattttagggtgtagaaaatacacaaggtggtttcatcattttccttaattttgaactgaaaatagtataaaaatttagaaatatgaaagcttacctcaagtatagtatttttacaggaaaagagtctatggtcaattgcattatctaatactttgaactgctggacaagggttcacatttaaagaaaaacatgatatttaataaaaatgagattgttaaaagtttatagattatttattctataggaaatatccagatgtatatgctttaaaatcaaatgttattttgaagactgctatcattatgagaaaaatgaactacagatatgcatgactgttcgctatatattattaccaaatagatatatggaataacacttaaatagattaatggggcagggtgggggacagttaatatggctacatcataaaacttccaaaaatcaaagtgaactatttatttaaaacatagcacataacataacctagcttaagaaagatggcatatggcctttgaaaaaatacatcatcttctatttactcattgggtgcttgtgcaaactccctagcttttctcaatctgtttactgaatccctttaaaatatacataaaatccactccaactggctgtgatgctaattaagctaagtaatacatctaaaaccccgagacattatctggaattcatgcaaatttgatatacttacataagtataataaaataaggtcagggggcttctaatctctcatctacaaataattaactttgaaaaaaataattggggtaaattgctccaattttctattaaataaagagagtgagtgcctgctatccattttttgtttcaaacattcattgagggtgctgtgcttgacacagaagatagagatgtgactgagacataggccatcctggcagaactatcggtctggtggggaaaagtgacttcctaaaattgaaaggtggacagaggggacaagtagtctccagagaaacagaccagaacatgaaaagatatgacaatgtgatcacatggtgcagccgggacgcatcaataaggaagcgttccatgtgaccctagaatgtccagagggatgatgaggcagagatgctggaggggtgctccagagccagacccaaaggtcccacttggccaggcaggtggacttcctcctcaaggcactgtggacccacgcatgagttcttaagcaggagaaagacatgctacctgctgtgtataaagaaaccaaatggaagacagcttggagaaaaactgtattaatttttaaaaatgatgagtattgtgttatttatgaaatcactttcttttgtagaaaaaaaaactaattgtcaaatcatcctatccaccaacctgatttaggggaaataatactaaaatctacctggcttttctcctagttcccacaggagcagttacggattcagtggatggattcaacttctgagtggcttgggaatttataagcttccccctaataatagcaaattttccaattctgttagccatagtgacaggctgttccagccctatctgaaattgggacgcagccataagcgcaaggccctgcggcaaagggaaaatactttccttatcgtggcgcaatggtcaagccaattttcctaggcaaaaatacatttaagattttatttaatgttcctaaaataatgctcatttcactttttaacaagaaaatctattaactgagcaccaaggctgattacaatatagcaatttaagccatgaccaaaaaaaaacctgcaaatacttatgaatacaactacatcagaaaaaaacagagtttattacagctagaggtaggggtgcctacaagtccttcaaggctatttcaagacgaattcaaatagaaaactctttcataaagggacacaaatgtgtgacatttcttgcattttatatacacacataaactcagctaattgtatggttaacatattgtgaagctttatgtgcacaggtatcaaagcacatgggtaatactggccaagaatggcagtggtcaaatattttgcaaagctaacctatcaaatattaaccagaaatcctaaaagaatgctcagtggcaaacagtttagataacaataaaaagataaacagatgatccattgatcatgacaggttggctgtcatcctgggacacctcccacattcccaggatatttgattaaaggaagtggttaaaatatggttagtataccactaacaacaaaatggagtctatggtaactcatgatcacactttttaaaagtgtatcataaaattccctgtcagtttttcaagtgtatagtaaaagtgaaataggtcacatcagaatacagaattatgttctgaaaaacttgttcaatttggctaagtctcataatctcatcacttacataaagtcacagattctgcatcaataactctaggtgtacaatataatattgtctgtgcacctaaaatatcagatatacgtgtatttatttctaatgatgtggctactgttcaaaaactagtgactgctgacagggcacggtgactcacaccttaatcccagcacttgggaagcctcagcaggcggatctcagaagttcaagaccaatctgcacaacatggcgaaaccctgtctctacaaaaaaacaaataacaaacaaacaattagctgggcatgcctgtagtcccagctacttgggaggctgagatagaagagctgattgagctcagaaggtcaaggctgcagacagccgtgatcatgccattgcactccagcctgggaaacagggcacgaccccgtctcaaaaaaaaaaaaaaagtctgactattcaactgtaatacctaaagttttgtttcaatgtgcttcagtggcattcatgaattaaggagctaagtgaatgctgggtttagcattaaccccatgattaatgaggctaccttccacaggacacaaaaaacacaaacaggatgcactcggccacacaggcaacaggcatcctatttatttttttctggtagatatgccagtggtacaaaccaaaggcctatttgaattgctcttttgcttacatttgaaagtcaatatgtaaactactttcagatgcaaccaacaacaggccacacccataagatctaagtacatcaaaccttcctatatagttttcagatatatcccagtccactcaaaagcattaggcatcgtatgttaagtaatttttacccctgatatatgcaaacaggccttagaattgctttgtgtgatcttctggttaatagctactccactgaaaattataatctgtctttcaaaataccattgagtcaaaaggtgatgcattgctaatgctaaattatttttctctgaaaaaatttacttccatcattctggtatttttaaatcacagctgtaaaattttaaactcacaaaacataaccacctgcatataaaaacctatctataatataagccatcacactttaattgtgctgtcaaaaaatatttgaaaggagtttgcattgatatattaggtaaacatgaaccaaaatatcaaaactttattttccttaatgaaagcccagcttacgatttccaaaacagatgaatatcagttagactctaggcctagctacaacttggaaaatacaaataaataacttataaaaattgggtctgtgtggctcacactggtaatccaagaactctggcaggccaaggtgggaggattgctccaggccaggagtttgagaacagcctggacaacatagtgagcttctgtctctacaaaaaattaaaaaattagttgggtgtggtggttgcatgtctgtagtctcagctactcaggaggctgaggcaggaagatcacttgagctcaggaggctgcagctgcagtgagctgggatcgtacatttatctccaaaaatcaattaattaattaattaaattttaaaaaactaaatgactctactgtctatgtcccagtaaacataatttatagatctttcttattattcatttttaggacatctagaactacataagaaaagcgttattaggccaccaaagcagaactgttgcaataatgtgacattaagcacagtgtccctgctctgctgcttccttagcagaataatgaacctctcttgtcttccgtttccatttgtaaaacagatacacaatcaccatgcctgtacctcacagatgattgtagagcataaagaaactaattcacgtaaaacattttcatgtctaggatacaggtttcaataaatattagtcagaagcatcgtgatcattttgtagttggctcaggactaactgaaggactgtgggcatgagcaagtcctggctggtcatcagaggtccacactgctgcaggaaagacagaaacacttctgagagactcaggggctaagtactccctccacccaagaaagcaaggaggaggaaatgcttttcaaagtgcagacagcaacgcattattgctataatttagaaaggaatggaatggaaaatggagtatatcacagtcaaaagtaagtctcacatcttgtgaaatacacatgtaagtgcagtatcgtgatgtaaaatgtatttccgacataacattctgacaactactgctctgaaagacataggtatatatccactccaaatcagagacacctgtgaaaccatggcaccaagcctagctgagatgcagaagacagaattcactggcacaagtcctgagaaaatggagcgcatccagatgtgcgcatggctgctgagcaggcctcttccagggagccctgcgggagaggatttgggctctgtccccagtgactgaagttgaaaattctgttacctccttaggggcacagagggctgtaatgctgccaagactttctgaagtggaattagactgtcagagcaataacccctctttcaaagtggtctagagtagtaaaatgactaaatttccataggagggtgagacttattaagttttggcaatcccaagttttgatgaggtacccttgaaaaagcaaaagttaattaaaaatttagaatcagacaccacatgcatggacacgcacgctaatccattcaatggaatctttatttttattaataaaaacagctccttacaccatttcctcggctaaccagacataaccaataaacagttccaaaaatccaagagagcaaatgccatgtaggaccaataaataccacataatttgttcgtaaaataacttacaccaaaaaggacaaaaaagatattttaagttcttcagtatttgaaagttataattcccttagaagtttcatctggtctattcacaaatttagaattatatcatcttgattttttttcaaaaatactaaaacatacaactgctaggaactaaaaaaaaattatcagatagtaaatattctgtcagttttcaataatctaacactctgagtaattgttataccccaactttgtgggaaaaagaggccacaggagtaaagaggtagcgagatctcagtgcaagctcatcatgggttttaattgacaccaccttccctcacatctgggcaagttacagaacatttgacagaatcttcacacagaacatcaatcactgcagtggtgattttatattaagatctgacctagaaaaagcccttgatttttttcctgtactctccatcttatgtttttatgagaaaaccaaaatattatggaagacatttagaagaaaattggtccattttgagagagggagaaaattaaggataaaagagagaagatactgttcaaaaagcatttgtggtgtgtgtgtgtgtgtgtgtgtgtggcctgaaatagtgtgatcctacagctcagttaaaatttcatcttacctactattttccactaatttgcaagctagcatcccatttccatctttctaaattacttaacgatgtcattaaaaatatttccatactattctctgcaatagatattactccccttcaccttattttcttatttctcaataaacatccaaacttgtgttcacactcatttaatctatcaatgagtatcaaaaggccaggactcgtcaggcattgtgctaggcattgggaataccgggcaaatgtgacaaggtccctgccttacaaaggtgacctcctctcaggctcattgaaaaagcacagcagtatggaccccttgttcaaaaagaaacaccttttatttctctctaaggtgatacttcccctttctggccttcgccatgtacaccagcctctcattcccccaaagttatgcagtctgcgctcacatccttgctgagaccttcagtgaaacccactatcagttaggatgcaactcactgcacggaacagaaactcatctcacgctgccttacacaatcaatggtgcttatcagctaacgtgactggaggcccagggataggaaaagcttctggattatattaattcagcagctcaatgatttcattaagggccagtttctttccttctctccactctgcctggaagtggatgattgacaaggattcttgagattactggcttccctttctccagtcaaggagtgagagaaccactgagggaaagggaaggaggtgaggagagaaggacggaagggggcaaaagacagaggcaacgggtgggagggagcaacaattccctaaatgtgatctcactgatccaaaggggttccactgcagtcagaggaacaggactttgatgcttcatccctagaaccagaggtggacttagcccctcctaaagctatggatggcacaggagcagcagggagcagatacccaaacactaatttaaaaaatgaatctcaggggaggccaccatagtgtcccctatgcaactgatttcacacaaaatgttattcacagactgcttatggcctttacagtcagcttcatccttatcatcctctcccaaatccataactgcttaattctcctgcataggtctagatgactcgcaccctatcagccaattctaattctccctctggcactcaactcaagcatcctcaagacttagtctcaccaaatagttcagatttggggggagtattctccaattaaaatcttcctcccatgtcaaaccaatctcacacacattctccttatctatatctcttccttatccattcaaactgcccttcttgaaatcagcaatacctgtctgatctggttcctcacttactttgacttttcaggcaaatcctatggagatagcatggtatgtcacaaaaagaacacgagaggaaatcccacaggccatttgctaatgatatgctttcagtaaatcactttaaaactgtttacatctgaatttccatatctgtaacacaggattaccacttttgcagggctaaaaactaaagaaaatttataataagaacttggccggccgggcgtgatggctcatgcctgtaatccgagcactctgggaggccgaggcgggtggatcgtgaggtcaggagatcgagaccatcctggctaacacagtgaaactccgtctctactaaaaatacaaaaaattagccgggtgtggtgtgggtgcctgcggtcccagctactcaggaggctgaggcaggagaatcgcttgaacctgggaggcggaggttgcagtgagccgagattgcgccactgcactccagcctaggtgacagagcgagactctgtctcaaaaaaaaaaaaaaaaaaaaaaagaacttggcatatataagttgcttaataaataaaatctattgtcattatagagccatgaattctcttgtttgcgtgcagtttttgttgctttctagtgctttcatatgctagctcttaacaacaagtattctggggcaaacaagaagatttatatttttatatctgtatttgtgcctaatcaactgctggccactgtaaactgcaaaaccgtgatgctgcttcatgatggctacatttgtcttctatcaccatgcataggaatgtatttctgggccaggcacagtggttcacgtctgtaatcccaacactctgggaggccgaagcaggaggatggctggggcccagcagtttgagaccagcctgggcaacatagcaagacctcatctctaaaacaaaaatttaaaaattagcgaggcatggtgagtcacgcctatagtcccagctactcaggcggctaaagtaaaagaattccttcagcttgaggctgccatgaacaataatggtgttactacagttctgactaaatttacaaaaaaaaaaaaaaaaaaaaaagacttgggaggctgaggcggaagaatcacttgaacccaggaggcagaggtttcagtgagccaagactgtgccactgcactccagcagtgacagatcagaaaaaagaaaaaaagaatttatatttcttaaatagaagacattcgtggcttaaagtatgctgggaagatggctgatgataccaactacctgtccccttcccccagcctttcccccacaaaaaagaactaaaaattgctcagaacccgtcagggttaaaaaaaaatgttgagcagctagactagttgtctcacacctgtaatccccgcacttggggaggccaaggtgggaagattgctcagctcaggagttcaagaccaatctgggcaacatggcataaaccctgtctctacaaaaaattaaaaaattagctgggcatggtggtgcatgcctgtagtcccagcaaacttgggaggctgagatgagagaacggaatgagcccaagaggttcaggttgcagtaagccatgatcgtaccactgcactgcagcttggggaacagagcaaaatcttgtctcaaaaaaacaaacaaacaaaatgttcagcagcacaaccaaaacttgagaagaatcctgtgtgcacttactgacacctcagagaaaccaagcaaagttgtgtgatcattcttgaaaagaggatgggaaaattgatgtgtaccctgactagcaacatggactttaaaaacccagataagcaagtgagtactggcatgtaggggatgggaaagcggaaggtgcccaaaaggctcgatcagaagcagccgttctgagaagcactgacatcatgggctggagggaaagggccctccacagtggacagaagtgcgaacacaataatccagactgcgtacagatacgtattcatctcatgattctaagtgaattacttcagctccgtggactcagcattatgtgaaaatagaaatgccccctgttctacctgactcatagggtgtgggacagctaaatagaatttatgaaattgctcaagaagtaaaaaatgctatgcaaatgtaatacatttataaataaccaatctaaatggcaaaggtaaagtgtctcttacaaatatcaatgtatcattgctgaaatgtccacatgtgaccagacagatgatctaccaataggcagccaaatgaagaatggatcttttcttcatttcctattttttaattattgcttaggaaataataaattataattgttgtttgagatgggttaaacccttaggacatttaaatataaaactactaaaacttggacaatggggtaccaatatgattgagaattcacactctctactaatctgttaatcattagtggagtgaaaataccataccttaggtttatcagtttgagtagttagtgtgagattatcccataagggacaattttcctacaatataaatgcaaagagatgctttaataaatttgtcttctgcatcaatagaatatagatgacaagtcaacaaagatgccataccagatctcagtgactgaactgaaggaataattgcatatatgcataaggtgaaaatctgaaagatttaatctcacaaagaaattaggaggacaaatattcatctgtgttgagatttttctctggtcatttcattaaggtggtccattattttttaagccttgaaaaccatgcagaaattctacaaagagacatttaaatttaaatgattgccacaaattatgcatatttttccactaccacaactagtaattgttagctgggcactggcattttccaaggaaatacatagttacttccttacacaaaacataaaacaagtatctgttgaatgaatgtacagaatataaagacttcccagaacctgagaatttccttatcaacattttctcaaatgcacaatacatgccaaatctgagaatacttaatttaaagttaacttctgaaatgaaagacaaagtaataatgaactggccctgacttatagggtttcaaaatataacccaacaagttgctaactaaagtcaagaacatcaggaaggccagctgatgtcagaagaaaatcaaaggcagtattatcaggtgtttcctctttgccaaaaatgtctgtggtcagatgataacatcagcagtttaatgaaggaaggaaggaggagctttcaggtctaggaatgaactgagaagtagtttatgggccacgttctttgctgtaatcttttttttttttttttaccatcaagtaaagtgaagaatcttcgtcgcaatttgtcattaaactcgtttatcagagtttactcatctccttatttgagcatctggtgaaataaatattcaaatatttaaaaacaaacaaaaatgtactaataatgtatacagacatgttctgatcaattgttaacatgaataaaggtttcttcagtatctgttttagatgatggtaatgtctacccaaagacataaagtagacttctatataaaagacaagaaagaagacttaatttataacctccaaagtacaacacctccaaaaatccatctagactaatatggttgactatccaaacagagtgaacataactgaagataatctgtatttctgttgtggaaatacacgctaagaccaaatatctaagtatagtagaaaataatctaccagaatcactcggaattcacttgagaaaatacatttcttaggacccagatctcaaactctggattggggctcaggaatctgcattttaacaagcttccccagaataactcttaagaactctaaaatttgaaaaccaatgctattgggttagaagagttaaaacatgaggactttgagttatttcctacactttttaatacagaacactagaaaaaaaagttgaactggaaaaataaaggcatataaacagcacagaataaggtagcagtcaatttaaaagttagtacaattaaaatctgatgagtccatatgttgaagggctacttcctcacactaatgaaaaccttcaactcaggtgaaataatgcattgttacaaagaatgactggctctcagggaggagcagcagagactggccctggtgtaaagacacacatcttcaaaagtggctggggctcttagttttattcttcatacaacacagagtataaatattagcatcaaagatgattccatttggaaagaagtctaaaggatacatattttttaatgacaggaaagcatccataaaaagaccttaatccacattgaagagggaaaaataatagatcaagctgttggtgactttctccttataagtgagcaaatcccaaccagagtgatctataaaagatttaacaatgaacaattaaaaaagcaaactttagactcttgcagagacacagttcaaaacatgaaggtattaaaggcaaaaaaacaaaaacaaaaacaaaaacaaaaacaaaaaactgtgctcaaatgtccgaacaccataagggatctttgttctatgttgtataagtttaggagacaaccctttattgatataaaagtcctcaagatgaaatggacactccttaacaactatagatgttctttaataaaataaatacattcttagaaatatataatttttatttttttgttaaaaagaataagatgcttttttcaggagagatctaaagcagtcataactggaatgatctaaatcccgttactttcatatatctgcagtaggccttttctccattgcctggcattaagaattctattttaagaaaatcacaggccaagaattaaaatatagtcttaacatgtgtcttaaagttgctgtaggctgaaattcatggactaatttttgttcatttaattatttaaagaatgtgtgtgtgtctggatgtgtgtgtgtgtgtgtgaaggttttactccatcaatttgacagcttatgtcatctaaaacttgtcgattttattgtatacccctttcttcaaatgaggatttaaaataagtactggcattaattcctagggccattacgtgattgggttgtcagtggggtctccagataacgttgaagctaggaccttaaaaaaaatcaaccaaaaggtctaacatttatgttcaaaaatcaattttacaagtgtaagatggtaagcagtttgtctgaaaaaaacacccaggagttttagttaaccacagacttaacaggagccaacagaatgacgcagccataaataatgccaaatccattctgggctgtactagaagtcccgcatctacatcaaaggcaagaagaatgcctcagtaccatgtatcaagacccacgaagtattgagctcagttgtggagggaacctcagtttcccctatttgaaagagaagagtaaacaagaatcctcaaacatcactgaagaaattgtttgatgtttagcctgcagcagaggagatttaaggagccaaggtgattatgttcaggtatttgaagaatctctggaacataagttcctactacagggattttgcttgtctgttgaccactattgcgcagttccttgagaaaggcctgccacatgatcaccgttcaacatgacttgtcaaatgaagaaataataaaatgaatgccctccgagcaaaaaaggatatgcttgctctgtgtgacgccaaagtcaccagtgggtaaaaattttagaaacgttatgcttcagttaaacttgaatcactttttaacggtgagagcactccaaagatggggaagacttggtaagagagtgatctcctcctcatttgggggaagggagtgacagtagtattcttgcagaaactggaaaaccatctgtcaaggatgctacagcaatgaaaatgctgtttacatcattgaacaccacaaggctttcatttttatcctctctgccatttctgtgaagaaaaccttctgctgacataaaatcatcaagacaaaatgaagagtttttaaccattttaggagtgactcaacaaaatgtgttagagtggttctaaaaatgcaggtacataaaaacatctgcaggatgtgttaaaaaacgcagatttttaaaacctccttgatcttatttctctagcctagtcgctgatattgtcttagtaagtgtctcccctcttctgcaccatcactttttccctccccactggattctttgacctcattacacaaacatattgtaactcccatcttcaaaaacaaatggcctcagttgaccccacttctcttaccaactaccacccaatttcttctttttcttttaatgaagaactcaatctgtatccaaactgagtttccagactccacctgactgttgaacacactcaaatcaagcttctgatccttgtcctgaagagtttttatctaaaacaccagttgcctccatgttgctaaatccaatggtgacttctcagtcctcatctgagtggactcttccatagcatttggcacagatgatcactcctttcctttgaaacactccctcacttaccttctaagacatcacagcctactgattcctctcctacctcactgatcactcttactcagtctccatttctccccttaactctaacttcctaacactacagttctcaaaggcttgatatttaaactgttttttctttcttaggcttctcgtcctcacattcagctccacagtgattttattaccctgtgtcaaggttttacttactgtttgtatactgagtactcccaactctgtagccaagccctttccacagaaccccagactcatatccaaatgtcttcttgacatctctgatcttcatctcaacagattcaaaccaagctcccgatcttctctatcacagtcagtcacatccttcacagtgctcaaacaccacatgtagtcatccctgaacccttcctctctcccacatacacattcagtccatcatatcctgtcaactctatcttcaaacatattcagagaatgaaattaggcctcttcctaacactatacacaacaattttaaaaatagatcaattacctaaatatgagtgttttaaaaccatacaactcttagaaaaaaatataggggtaaatcttcatgaccttggattttgcaatggatttttagatacaatatcaaaagcaagagtaaccagacaaaaaacaggtaggttgaacttcattaaaattaaaaacatttgtgcatcaaaggaaattaccaagaaagtgaagagacaagtactatggtctgaatggttgtatccccctaaatttcacatgttgaaatcctcatcaacaatgtgatagtattaggaggtggaatttgtgggaggtgattaggtcatgatggctctgtacttatgaatgagattagtgcccttacagaagaggacccagagacattccttgcctcttctaccatgtgaggttacaatgtgaacatggccatctataaggaagcaggccctcaccagacactgaatctgcaagcactttgatcttggattcctcagcctgtagaactgtgagaagtaagtttctattgtttataagctacccaatttatggattttgttatagtagttcaaaaagactaaaacaatcacctgtgaaatgggagaaaatatttgtaaatcatatatctgacaacgatctagtatccagaatatacaaagaagtcttacgactcaaaaacacaaaggtaaacaactcaatttaaaaagctaacaaacaatttgaatagacatttctccaaacaagatatatatatatatacctatatatatatataggtatgaaatatcgttagtcattaatgcaaatcaaaccacaatgaggtaccatttcacacctactaggatacaatcaaaataaatgtaaaataagataacaagtgttgatgagtatgtggagaaattggaatccttgtacactgctagtgggaatgcaaaatggttcacctgctgtggaaaacaatttgacagctgctcaaaaagttaaagaaaaaattaatatacaatccctcaattctactcccaggtatatactccaaagaaaacaggaactcagaaaagtatacagatatatacacaatggaatacatttagcagtgcaaaagaacagggtaataatacaagctagtatatgaacaaactccaaaatattatgctaaatgaaagaagtcagtcgcaaaaggtgtatgaggctacagggaagggaaatcagaaggaaaatgcttaatgactagagtgttttctctttactttgaagtgatggaagcattttagaactagatagaggtatggttgctcaacactgtgaatgtactaagtgccactacactgttcatattaaaatggttatttttatgttacctgaatttcacttcaataaattattattttttaaagttcagaatctaatcccttcttctaattccaccgctaccactttgatccacaccaccttctctcatcagattattactagcctcctacctggtctccccttcccctcttgtcattctgctctttcctcaacacaacagccagaatgatcctgttttgaaagtcagatcatgttttacctctactgaaagccttccaatagatcattagctcctcatagtcaaagccccacacaaagtggcctatgacttatctgacctcatctgacctcagacacacttctgcctcaggactcttgcatttgctgttagctctctttgtaatgcttctccccttaatatgtaaggcccttgaaccatcaccaacatccttgaaccatcaccaacatcagttcttactcaatggtatcctatgcaatgacatttgctcagaccatcctatttaaatgcaaaggcacacattctccctatttcccttctctgctttatttttctccatagcatttatcaccatctatcattcagtatattttacttatttattgagtttcttttctacttcctactagacgtttactagagaaagcctaaaaggataaagagtaacggcctgtgcgatcttaaaaggacaggttttaaaccatttgggtgtctgcttgctaatatgtctgtatgcatgcatgatagatgtggagctgtgacttgctttctttaacacatatctcctcgttctaagtttgtgagggaagagatctcagctagtccaaattactgaaggctatgaagaactacaaaaggactttatagaaaagtgaccacccaaactggcttatcttactttgctgcactgcattaagaaaactagacctaaaatacatcgaaagggatataaaaaattccaagtattaaataagcctaaatgattgctatgaaataaggattgaaatagaaaaaaaaaaacaagaaggatggaaagttcttggttcttttattgatcttatcatatattcaattattttttaaaaacaaacaaaaaataccccaaggtttaaaaaaatgtcctccgcccctgagaatgtacaggatgacatttcattttttcctccttaatcatcaatatccaagagaacaatctctgtcttggaaccactttccacaatcagttggaaatcgtaaagtgcaagggcctggctggctttattaacaagatgtttataaacctgccttacaaatattttaaaacatttacacatttgataaaaagatgtatcaaaataaaaatatacataaaaacaaaagccatgcactcattaacagataattcaagtctctttcccaatttagtaatacatcatacaaaagtactcatattattaaaaaatagaagagttgtacaattgtatagtcctactaaactaataaaaagtacttcagttctgttatcttaagataccataccgcagcttcttctgaccatgttaatgtagacaagcctcaatcagtaagcacactaatctaaatcaaattccatctagttgaaaataatcatcatgtgctgcccagagatggtgagcatgaatggattactgaaaatattcatggtaattgcaggttgctatttctgttgaccagattcagaggagtttacttagagaaatatctaagcatgcagaccaccaatgcaaaacacacagaatatcactcttgacatccacactaaaaacagcccaggatcctctctgcaatgtcacagtgtggttgttatttcatagtgttagatacactgctagtgacaaaatgaaaatgtatgattgcagttattttattttcaagaaatatgctaccacaagagatttttttttcctagtcagtggagtgttaagttatattaaggactacatattatcttcaaaagccccaggttcttctgcttgtaaacaggtgtgtacaaaatactaacagtgacaataattgaaagatgctttttaattataaggagttgcttaacatattccccaattcgcaaacatatctagttaacacacaagtcatggtggtaaatggggaataaagacctgctctaaaataaagtggccacaagacacctggatatttaggctggatcctttctctgtgttataccataagttttttatcatcaccatcatcagaactaaattagaaatcaggaaacctgggttctaattccagatctgctgctaacaatctaaagaactatataatcacatatacaccatgaaatactatgcagccataaaaaaagaatgagatcatttcctttgcagggacatgggtgaagctggaagccattattctcagcaaactaacacaggaaaagaaaaccaaacactgaatgtcgtcactcataaatgggagttgaaatatgagaacacatggacacagggaggggaacaacacacaccaggaactgtcggtgggtggagggcaaggggagggagagtattaggacaaataccttatgcatacaggacttaaaacatagatgacaggttgatagatgcagcaaaccaccatggcacatgtatacttatgtaacaaacctgcacgttctgcacatgtgtcccagaacttaaagtaaaattaaaaaaaaaaagagctatataatcacgggaaaagcctatgatctctgagctctaatttgcttatttttaaaatgaagagtttggccataaatgcttttaaaacagaatagaaaaacgcaaagtaaaaatgactgcctaaacatacaaaaattgatcctaatttataaaggcaaacatatatatgccacgggataaaaaaggaatgatttttcaccagaggggaaagagcaaaatgacaatatattatgaaattaaatggtgatgaggatattgaaaagaactaacacacaagccttgtaatgaagcatgctacaaaatgcaaagaaaaaagatactgtcaaactctacattccctttgacctagtaattctatttttgaacacaaattcccccaaaaaaatccctaaagaaaaatcaaagatctctaaaaagaatctccatagcagcactacatataagagaggaaaattagaaacaacctgtatgttcaaaaatagaggcacagttaagcagaatctggttttgctaacaaaatgggacaaaggcctatatagccattttttaaaatacagaactatcttcaaagagtggatgtattcatgtgatattacattaaatgttaaggttgatcacagaacaccctttttatgatttcacaaaaaacacacggttaaaaactagaagataaatggaagctgtacagttagttctttgagtttgttattttgataaaattcattacactagcaaaaaataaagggaaatggggaggaaagaatgctctttaaaccacagtccagtttgtacatttcatgcttcttctatataattttctaacgtgacaaataccaacttatgtctctaccttacattcaatgttcctcaagcatttttgcaaagattatgttaattgttggaaaaatcatcagcgttcatggtaccaatacaccaacatattaaacttttatacaaagtctagtgtgtcagatgtatcctaagaatgtatattgtacatactggtgagccattgtcatcctgtccccagatgccatcaacgggaaattaaaggaagcatccagagttaggagttacgattccaacagggtcttggactctaaagtcagccaatatatggtagaacatgctatgaggtgaatgccttggaaaactgtcacatacctcttatgtacaattactgctttccttaaacactataggcgacaaaatcatagcaaaagtcatcactctggttggcctcgtaatatatccctttcagctgtggcaaatatacagtacatgaatttactgcagtacacagaattcatagatataattatggtgtggtatttggcttcagtgtatagctatagcattggattatccttctaataaaaactccaaaaagatgtaaaaggtaaaaacccagaattatcctaagtagcaattctccagaagaaacattaactggagataacatgcttgtgttgaatagaaatgctgatgttccacaaaagcctgtgtaaattttcttccttccaaaaagttgtttttttctactaatcaatattttaaacagtatgtttcaagctttacgatgctggtatcctttaacatattctgagaatgataaagaaaaaagtaatggtgtcatgtgaaaaactgtttaaaaaaaaaaggctaaaacctaaaattgggaacaagtggatataccaaaactgtaaaaatctaccagagaccattatacatacttttctcactgatggctagagcacaaagtaaaaaatattttcaatctttcacctttacaactttagcaaaaatcctgtttctagttatcctaaaaagacactggcaaaaagctatgtccaatttctcctgtcaccagcattatctaataatgtgaaaacaagctatcattttcaaaactattcaacgcgccaaagtaattaatcttaaatcaatggctgctagtgacacaccatgtgtttactttaaacaacaaattataagcttttagaaaatgaaattacccatttaaaaatgaatctcaaaaatatgctgcagcaatgcaacaaattccactttttattatctgtctgaattattctacagaatcatatcaatatattttatacacatttacaggtcatacaagttctagggtgccaagtaataatttaaagatttaaagaaaatgggatacacacagaagaactccaaaagtcatattaagttaaagaaaggctgtacacggatttaaattaaacctccattacccaccagatgagatagcaattcagtgttgagacagactaactcaaacattcacccattaaaataccatgtaatgaggcagggacaagagaatgccttaaaaaaattaaaaatcaacttcagaaagacagcacaggtgagagcaaatcctaatttaaatagaaattaaaataaaatgtaacctgcacccaagaacgatagtagctaagaggccatttacatttcaaagtcctctgtctatggtattcttaagtactataccactaaggtttgtcggtactgtggagacacttcaattaaggctgtgtggtagagctctgtgtaaattaattagttgaggttacgcagattttctaaaagcagctctctaaaacagcctcagagatatgcaagatttgtggggaattaaaatttaaacacaacttactaatcaattcttcttgctttcacatttcaatgacattttgcgtaataataaataagtccatgaaaatactactaaccaaaattttatttgctttcaattagagctaaaggaaagggctttcagttttccttttgatacttaggttttatttcagattttatctagacttattggcaagagtttccatatgataactataatgaacttgatccatatttaaatgggaaatgagactatatttaaaattcacatatgctacaactaaattagctttctagtaattgctataaacaatgtcataacaaaaatatgaatttcatactcttgcactgagactttacatgttaaattcattcaatgtaattcagctatatattaaagcttcacgttttatctaataaaatattataataatttcctttctttaattcaaaatactaagtaattttttgctgtaagtaaattttaaagccattagaactagatgtttcatattcttcaaaatattattctttaaataaaatgtatacacaaaaatggtaataatcagttacataacggtttctctgtaaattaaaaatggaagaaatctgacgatttcaagagatcaggagccttcaaattatgtatataagagattcataagctcttctgtaatcctaaaataaagtccctacagtctcatcatagtgattgtgaaaaattcatacttgttatacagtagaaatgatttaggcttttttaatggctaatttgtttcatgagcatggacactgcatgtacaaatatatcttttgagatagtaccattgagaagaggctgtccttcatgcacatccttcgataagactgcactgtaaacatcttcaggaaatccagtcttgcataatgcgatttcaccagaagcctctacagacgcctgcaacacaagaaaaaaaaaaaaaatgtgtgcaatgattgctacctccttcaactgagaaacattccacttggcataaagcctcattttttcaactatcttgtacaaacaacccctttgtttccaagtgcttacaattagaatgtagagggcaaagggttaatcattttgataactggagtagaagaaacaaatcccacttgtctagtccagtaaaagcgaaataatacacattctaggttcttctaaggactgaacatttccattaaaatgctcattgtgactgaagaactaccaagtgggcgtggggtttgggggacagccaaatagtctttgggctccacaaatcaccatcactaacttaagttttcatgaaaaatgtatacattcaagtacacagatttttatatttttagctaattttctataaaactggtttcaagatgccatgttcatttaaaaataaaattataatatacttacaacagtgggacagataatattttataccaagtaaaaccaatcaaaactatatatttatttctataatttgaaggacagtgatacattaaaaatttaagtaaagattaatacaactatgtttttacacttaaaattagaaagtaaccaagtatctgtcattttctatatcatcatatgcacagttaatttactcagtgtgcttaaaactcagtcatacctactactgtctagctaaccctccaagttagttgccctacttctttcagccctactgacacaattggaggacagtcagccctcagcagagctcctgtagcatctgcattaattgtaggaaactctaccatgtactaatggggattcaaatacagaggaaggacgagtagaatgaggctacccaatgaagggattccagtggccatagggacagcattagggacagtccaccctagtgagaaccagaaattgagaggaagaagaagggaagtcccagaaacagagagatctcagaacaactgtctggatgaagcaatgcagggcagcttcataattaaatgactacctgaattatgcatgtgaaattttgcaaatactaatgttgcaaaaatctagaccaatctaataaactgttcttttcaaatccaagaaaataagaaataaattaaatttaaacagtattaaatatcacagtatttattctcaaaaaatttttaggagcaacagtgagatactagttcaggcccatcgaatgagtaagcagttttaagtctgttatgtgcaagaaagggctgtatcaagtgaagaataaagaagaaccagtcccctaaaaaggtgtgagtggaagctggtacagtcaccttggcatatattttggcaaactctagtaaagatgaatgtggatatatcctccatattcctagggaaatattacgccacatgagtgctccagttgacatgtgcaggaatgtccactgaaacatgactgtaatagcagagattctgtacatgtccatcaaaaggagaatggactaatacatcatcacaaagccaaaagaagaaaacaacattaaaatgaaagaactggaactacatttatccaaacagctacatctcagaggcaaactaaaacaaaacaaaaagtcagtttctttaagttccatgtatgattaagatataaatttaattataaatcaacctacagatgactatttagtaagttcagaaacccatttgtgtgacatcccaaattcagactgaagacaaggcacactgcagtatgaaatcttgcaaaaaaaagtagaaatcatgactgatgattccgcttatataaaatttaaacacaaaagataacataatgttttgaacacatacttatgtaagaagaaaaggaaaacagcatagtgataaacatgaaatttaggatagtggttaccccaggggaaggaaaactaggaaaggcatcaggaaagattgtacaagtggcttcaattttatctgtaataattactttctttcaaaaagactgaaggaaaccaggtaaaatgtaaagatccgcatagacacacaggtacaaattacagtattcacctcacaaactatctgctctacatatttcataatgaaaaagagaaaatatcagaaaccaattgagaaataagaagtgaggcttccaacacccatcaaatttgggacactgggagacagtctgatacttgacacgtgtaaacatccaggtactgtccatgcctggcacagtgcaggcactgagtaaaggaaagcttttgcttttagctaacccaaacgaacacagggaactccccagtttgccatataaaatggacaaatgtgttgtaaacctgtgtcccaccaacatgttacgagtctgcctcttcacccttctagtccaggcttctaagagcagtgaagcatggcaggtgctagcccatgacaggtcaggccggagcccagaaacgccgtggccagaagccagcgatggaaggcacggagcagacgggggtcacgtttcaaatgggggcgttcagggtagtagagtatgcgggtttgtgggtaagaactcagagatcaagaaagtctcaagactagaggaaaaccgtaagcttttattcaatcttgtttcccagtggatctgccctaaggcaggagaatcagcggcaccaagttcctggtccaaacccacagaaataggacttcagggccatgtcgaagctgtcaggaagacagtgaatgttcacctctgtgttttgttctctgccttatttcagaaaagggaccttctgtcctcaatgtgctgccccttactaaacctctccatgctcattttcctcatgtaaaaaagggtaccaaccagccaggttggccatgagaattattgaaaaaatgctcttaaagcacatctctaatgaatactgactactaatattaaatatccatggaagtcatgtcatactttgaataatttcatattcatcttaaatagctgaaactttcctaaattcttcttccttaagacaaaacggatccacaaaataatataatcctggatccaaaatactaatctataatgtattttcttaaaaacaatctccataaaattgttaaaatatatattctccctatttatttcctctcttaactttcagtcaaaaaatagcaaagttaccaagttcaaaaaacaaacaggaagcactcaaatgaatacaagctcccagctggacatagtggaggcttactttgcaccaagcactgtgttggtaaatcagtatctcattcaattctccctgcaaccctacaaggctgtgactgataccaggtatgagactgcaggagaccaagagctgatgagcagaatccccttaggggggctgactgcactgtggtggtaatccttgttgggcattggaagttctctggtctaacccatagctaatgcctgaatgttctacaacagtagctctcaatcagggacaattttgctccccaggggacatctatcaatgtgcagacacatttttagctgtcacaactgcgagggggtgctactggctactagtggctactggctctcagttggtttctggcattttctctttttcattataaaatacgtagagcagggaatttgctaaccattatacaacacacagcacagcatccctaacaaaggagtgccaagctcaaaatgtcaacagagccaaggttaagaaaacctgttctacagcaacacatgaaaaagaggtatctacctacccattaacactgctatcggtatgaggatcactgtctgctcaagtagcctcatcactcttggaacatcctgcatcccagaaagccaaaacccagcccctgaggcttactcccacataaagtcatcactctgccaggcctaggatgaaattctggaacttccaagaggagaaagaggcatcctaccctcaacaagttatctgtgggtatgaggaggaggttgtgaataacatacatttccctaatatttgaatggtgcatgggttggcaagctttttctgtaaagggtaaactaagtatttcaggctttgtagtccataggatctctgctgaaactactcaatctgctgctgttgtgcaaaagcagtcatagacaatcagtatatgaatgaacatggctgtgttcattctaataaaacttcatgtatcctgaaatttgaatttcattccattttcaagtcttgaaagatattcttcttctttttcttgcttaaaagcatttgaaaatgtaaaaaatattcttggccagacaaaaataatggcagcaggagtgtagtttgcagatccctcgaatagtgtgttaagttccgtatcacattgttatctcacttcattctcacaataggccccttaagagggggttaaactatctgcattttgctaatgagcaaatcgattctcacacagaggtacagtgaaatacccaagacctcacatccaagagagaaagggcaggattcaaactctgtagtctttctaagtacaacaaataattacaatacaatctttcaagaaacatgtactgagtgttcatttgccactagaaacagaaaacaagatacagcccctgcccttaaggagctcaagatttaatgtgggaggttaagatatgcagaggatatgagcaaagcccagggcagggaatctgggggcttcccaagcagagagctggagtagcaaggcgctagagagtggcaggaaagccatcctaggcagtcactgcttgaactaaaacaaggcagcaagaaacagcatagtgcctggggaataacaatgagttcagtgtcgccggagtccaagaagcaaggcaggatgtcaaaagttgaggctggagagttagacagggttagatcacaaatggttgggggcctggggttatcctgttggctgggggagccagggacagattttaagcacagaccgaatgcatctgacagagaattctctgatagttttgtgggaaagtgtgtgtgtgataggggatgacaagtgacaactgggagacaagctaggacacagacctgagtcagggcaggggctgcaaggaatgaaaaaggggcagattttgtcaataccaagatagttaagatcgatagggccttctgaggcagggactcactgggggagggagggaggaaatgatgccttccctcatgtttccagctgagtggctgtgaacacgggtgccacaagtaggaaaaataattgcaaaactataatgtcaggaacaaagtgctaaagaagcagaaagaatgggatgataaatctgtccgtggaagtcaaggaagactccatagctgaagtgacatttaggctctgactttaaagatgattaaaaatttgccaggagaaagagggggaagtggaaaagggcattccaggcaaaaggtacagcagaacaaagcccctggtgatttatgttgagcttgtagtccaccaaaaccatcctgatctttttttttctaggcaactgttaagttatggcttcctcctctattatctttgctgctgattttgggtccttagggggagcaatttatatttaaccctccaaaatttggtctcaataaattaataattccagctggctttagtcattccttccagctttatgtatcaagaaagtctaatgagataccccaaagtcttcatgtagatgctacttagatgctaaaaacagggtatgtcacatgcccagacatggtttggggaaatctgcccaggggcaacaccccccaaccccccggggccctaagccctgggctcttaagaagagcagagtgactgcagcatgaacttccaacaggtcagactgcctggctttaaatcccagtcccatggatactatctgccagacctctgagaagaaacagttccccatctgtacaacaagagtactaaagacagcaccaactcatagggcagatgagaggattaaatgagttaatatgtgtaaagcacttaggatagtgtctggcacatggttattcaatgtcttagctatttgtcatcacagtactaatactattggggcaacacgaatccaactcatggtacatctgccatacaggccggtaggtctcaaacttactcaacacagcaagcaatctgggacatttgtttaaaatacagattcttgggtcctagcccaagactcattaaaacagactctcaagaggcatgatggataaatctgtgtatttaacaagtgcctgtgctgcaagtggtggccacacatccagcccttatctttacctctggaaacctttctgaacgttctcaaaacggcacagctaccttttgaccctagtcttcaaacccaatagcttagcaacaacaaaaaggaatacagaaaccatgatttttctgttcttaatcccatgctctctttattctgaaaactacaccttcttgattttgaatttcttttgctttgaacagagcattaccccatctccagtcctttagcaattctcctcttctgcacaattcctcaaggatgacaagcagtcaacaagccctctcggcccaccagcgtgaaattcacgctggtcagaggatctgaactcatttagtgccgctctgtgctctcgcacaatcagctcacctatcttgagtttcaatttcctcttacaagtatttactctactcttcccaggctgaagatcgacctccttgtctagagaggacagaagtgtaataggagttgaggagttctgcttgcctgtgagtatcagtctctctgttctggttctgcactcgcagggacattgtttttgttcttgttcaaatttttccacggtctcaatgctgtgagctttaaagccgagtccactactcttttcggttcccgttctcattattctttttcatagtcatccttggtcactcaatctgctttccaatttcctccaagtcactcctaaatccaagctcttaaatattccatgtggaatcaccatggacagacttcagttgccttgtctcctcactctcttcctcattaagatcatttatgattattggctaaaaatttcacctctgaaagcagcctaaacctaaggaaatcataacttttctttctggctctgaagactgcctaaccaaaacctagactaagttagttatcataaactcttaaatgtaatccattggatgtcaggttaaaacactgatctcttactttttccctatcagagattccatggtcacaatcttgtaacaattacattattgtttgggagattaccaaatgcagtcaacaaagctgaggccttcttttgcattatgtttgctcccctgattccttgtggaaataagggcaataatgggtaggactgggttaagactgagaactctgcagcaaacctgctcaggtttaaatccagcctccaccatctactacctgtgtgaccttggcaagccatgtaacctcatctgtgcttcagcttcctcctctgtaataataataataatagctaaagtacaggtctttaggattgttgtgaagaatacaaagggcttaaaaaacaatacgtgattcaccacaggacaagggttagctattatgatgctggtattgttttgattgtggagacttttatctctttgttctgtaagtaactgagaaatattttaaaattattttgtgaagaaggaataccgtaaagaaatcaagcctgcaaaaaaacggaaattcactcacaaacaaggacaaaagatgcacaagtggaattcccttcatgatacgtgatttgtgggttgggggatggagccgcagtacagggagggtgacaactatggtaatacttttattatgcggttatgtcttccaaacgacataagcgaacataaacagttaatgaagacactgttaacgtcgttagttgagtacatggtgatagagtaatgacactgttcgagaacattcagcacgactaatttttttattttttaatccaatttctcaccatacaattacagttgccagattctcgacatctcacaggattccatccatgatgttggaggctatgttaagaagactattcaagagctactgccactcttcaagattttctctgtgtcagtaatgccactgatggcacttttgaatttcacatccctgcaaaaatgcttaaaacgtgcagaagtttaaccctgaacagctgcaatatttttgttttgtcaagtaccattctggaaggagattatcttgtcttgcatgggttttttaactctttcttgccttcatgatgtgctctagaccagcttaggttcaatgaataccacactgaggccacacatttgccccatctgacagcctagtaattttcatctttattttaattatcttattaggatgtgtccttgagtatctctagtatcagtacttttagttttctcattgtcatttcttttaatcaagtaaggacaaagagaataggcaaaaacagcattgatgctggcacaggaacctgcaaactgttgaaactgaactcttagctaaaaggcagccccacaatacaagagtttgatggacaaaaatctgggtcaaaatctgggtctgcatacaaaatgtggtacagaatgtcaccttcccaggtacagaatgtcaccttcccaggtatagcatgtcaccttcccaggtacagcatgtcaccttcccaggtacagaatgtcaccttcccaggtatagaatgtcaccttcccaggtacagcatgtcaccttcccaggtacagcatgtcaccttcccaggtacagaatgtcaccttcccaggtacagcatgtcaccttcccaggtacagcatgtcaccttcccaggtgcagcatgtcaccttcccaggtgcagaatgtcaccttcccaggtacagcatgtcaccttcccaggtacagcatgtcaccttcccaggtatagcatgtcaccttcccaggtatagcatgtcaccttcccaggtacagaatgtcaccttcccaggtatagcatgtcaccttcccaggtatagcatgtcaccttcccaggtatagcatgtcaccttcccaggagtagagcctatcagggcttaggacaatatgaaaacatacatcgagtgacatccatatagacctctgtgcaatcccacatctcctctgccaaagtgagaagaggcttcctaggcttccaggcttccttgagtagagtctcaaaagatagacaggagcttaccatgaagtggatgcttaatgtaacaggtagtaacaatgtacctacagatttaattggcaggtaaaaggctaatactatcattagataatggcccaggcagctgtgcaattaaacagtcagaaaaagttccagaagtgcccgtggcattccaggagagatggccaatcatggctcagattgattctgtcccatcaactcatgacactcagcagagactgcaacacgcttatactcaaaatgttatcaaatagtatagcacttggcattagactgtttataatgaacttggaaattcattcaactaaagacactcaatatcagtgactgcaaatatttactgagtgcttaatatgtgccaaaaagcatgctacaatgctttccatgcaatatatcttaaatagtcctcacaataaccctatgaggtagatgctgttagtaccgccattttgcaggcaaggaaactaacttaaagaaaactgccctaagtcatctagttagtcaatttagggacactattcaaaccggcatcaaaaggccttggggattacccttaacccaaccactacaacttccattaggaagcattcacatacattgacacatagtacctaactggctaagggctggaaactgtcctatatgaattgagactaagtgaaaaatctgcctgctgccataataaactttctcctaaaatatgattctcgcatacgatatgtgatatatgctaataaaacaatttcaatgtttctgttcactatggaaaaaattaggaaaaaaaaagacttcaggtaaaacttttttaaacattttgttttaagtcctccaaatcaaagcctcacaccccccagcccaaactcttctaaaagtatacatggaaagttatcagtcaatagctatcatggctagtatgttaattttcagaggtgatattgatgaaggaataattatagtctataatgaactctttatacactttatttgctctggagtcccctgtattcatgtacaattaggcccatttcataaaacctggagcatggtttcactttttaaaaatggttacagatgtttacagtccccggaactctgatttaatttgagtagctggccatagtgatgatttatgtaattctgagtccctgataagataaacacaacccaattatagcattattcttgtgagaaaacaacattcaaggcacagcttccagaaatgcattgcagcgaaaggaggcataacgccagagttcaaagcctttcctgaacttattctggaagcagcaccccatccagtggtgttctaatagatcaagcaataaagaaataaatctccaagccctgcaggctgagaggttgcagagctaatatcgtcagttccagtttcaactcaagggtgaaggacaagcattgtccacccatggatatcttgggtgactgatgtttggcatctggatagtttcacagtgtaacccatagaggaaatgcttcttcccttcctgatgcttcattccatgggaaggcactctgctaactctcactgtcccagtgctttccactgcccagtcagtgttaccctgaatggcaattcttaaagtatggtccgaggagtggactcctaggagttcccacgaccctctcagggaatctacaaaatcaaagccacttccataatattacaacatatttgcccttttcactctcattatctcacaagtgtaaagtaaagttttccagaggctatgttatgtgtgataccttaacagagaaaattcagaagcagatatgaaaagccagctatcttcttattaagccagacattaaagacactgcaaaatgtaaaggcacaatgctactcttcccactaatcttgtttttctcttttggaaaatacagtaatttttcatacaaattgttatttatgttacgcatacaactggtttaatattttaagtgaattaaatatataattttttcagtttaaattctctatggtaaacagcaatagatattatctacaatagaaaagctcactgaagaactcaataattttttaagcatgtaaaagagtcctgagactaaaaagtttgtaaagtgttatgttaaacaaagagggatggaccaaacttacctgaagcctgcatttgaaagaataatctgagcagctggtgcccaaccctgtcccctactccgcccatctgggagtcacaggtccacagaaaagaagcttggtgatctcattttccatgctgggagctcacagattccctgcagcaatctggcagtggaaggaagtgggcatgtctttgaaatgctgggattctgggattcattgtaagggggacttgccaatagatgaaggccatgcctgccaccctagtgcttatcaggactacggtgatattttcctttcatattttctgattctgctggcttacatttccctcggttcagaattcaagacagggaggacaggtcctatttactgggccctttcaaagacttcagcacttggtgaactatctggggatcttgagaaataaaaaaggagtccaatgtaggggaagaaagtactcatggaggaacttgggcttctggcagtgggaaaagggtgctttactcaggacctgcaatttttttgttttttttttttttttgaaagggagtctcactctgtcacccaggctggagtgcagtggcgtaatctcagctcactgcaacctttgcctccgcagctcaagcaattctcctgcctcagcctcctgaatagctgggactacaggtgtcctataccacgcccagctaatttttgtatttttagtagagacagggtttcgccatgttggccaggctggtctcgaactcctgacctctggtgatccacccacctcagtctcccaaagtgctgggattacaggcgtgagccaccacgcctggcccccggcacttcttttaacttggtggtttatagccttgattgtgtagggtggctggtttttatagttggagaggtggcttttaacatcaaaaggcttaaatttctaaaccacagagtattttgaccttgatgcttgaccaccacttaggtagcttatctccaggaaaatgatagctgtttaagaggtagcgcctcgagaaaaaaataaaaaaaaaaacagcaggacctcaggaaagactataggccaaggatcctagaatagaaaagaggcaggatgcacagcgaccttagcccagtggtgaacaatttgggtgagggatgccacaatctgggtgaaagctgccgcaatttggccttggcaatggtctaaggtagctcaggactctggaagtgctgaggggcctcagcttgaacgtgctgaggggcataaaaagaggattatttcaacatctactgcctaaagactagtcaatgagcaatgtttgttattttttaataacactgagttcaagaacactagcaagggtctcacttgggcaaggtggggacagcatggattctgacagctcgaccactggctcaagggtcagcctccaccaagtggtctggatggcctttacaagtgaacaagaaatcttcccttgaggcagccgtctttggccaaagcaactccatagtaaatggcagagaaagagccagtggggcccgagactgaaaacacctgttccaccagtcaaccaccagaccaaacccaacatggtgataacactgggctgtcagatccaagggagacgaagggaaagtctcaaagggaaagcaggtttgaacaggctggctgcaaaccaaaacccaactggggagaggctcccagtgggaggttgtttagcacttcctatttaccatttggggtacctcatgcataccgggttttctttcagaaagctggcatctgagatactgtcacctagcacaaggttcagaaatgtccaatgatccttgtccttcttgaggtgccttttttctcatctagcatattcagtatctttatgtttccacttccccctttcaactttgtttagttcaaagcttgcagattatagacaagaggcttagactgaccagcatccaggaaaggttaaaatgaagaatgttttctctgcccactatcagtccatccctcacataccacaagctctctactgtgttctttggaacactgagaaacaatttcacctggatgactcttccagagcagagcctggtttgctttctaactttgaaaactgttaagactgttgctgtggtcatcatttggtttgggaactctttaaaaagtaaagctggccgggcacagtggtcacgcctgtaatcccagcactttggtaggccaaggcgggcatatcacctaaggtcaggagttcgagaccagcctggccaacacagtgaaaccccatctctaccaaaaaatacaaaaattagctgggcatgttggcacacacctgtagtcccagctacttgggaggctgaggcaggaaaatagcttgaacccaggaggaggagaatgcagtgagccgagactgcatcactgcactccagcctgggtgacagagtgaaaccctgtctcgaaaaaaaaaaaaaaaaaaaaagcaaagctatagatcttccaagacttcaagaagttgggaataagtctgtcctgacagatgcccatctcgccctctgaggggagttgccacattttggaataagcacacacttgatgactaagaacatgagctcaacagtcaatccaaaatttggggaccgtcagagtgtaaacctcatcctctacttccatgtagtgggagctgcactagtaataacattcttgacctttggccaacttagataaaacgagtgggcatacagaacccaggctcttcatcaccttttcttcctgtcagagccacgccacctatgtcatgcaaatattgttaagctataggtccgtaagcttcgacagatgggagcactgtcaaagatgggatgccaagggtaactaaatctgagatgtgaaagattaaagccacattctctaaccttgtctttatcagtaataaatgttgtaattttggttctctatgtactgattcttttgtcttatttgtccagaactgaaatagataaggagcattattgcttaggccccttcaaagacaacaaaattatctacaaagtctcaatcttactgaatactcaaaggccaaggctaaatgatcaaaaagaagttggtccaaataacattgttgaagtgccagcagggcctcaggcccactaggatgtctctgtgctgagtctgaggcactcaaccaagacccctcatgtacttaggggagcacaaatgcttggaacagaaagccacatgtgcccttagattgctgggtgagtacagaactgggccaaggtggggtgaggtcaggagaaagagagtgattcacagaaggaactatcaacagctcatgagacacttgcatctccgagtcaccaccaagaagctgcatggccagcggcagaaactgcctgcttctttggtagcctatcctgcatctggctcaatctgttagattttcccattcttaagccgagtttgctccatgaaactgagatcttttaaatcctcattctaaagtccaaatcctcctttaggcaacaatccttcaaagtccagaatagactaatcttgctcccactgggtccattcttttgcagactttcaaggaactggccgagttgttatcaggaaagtaaagcactgttaaagccctggccagccacctcacaacagtgtgccttcaggtgagtggtttcagccaatctctgttcagacatctgtaagatggataatgataataacgtctacctattgcagaggattgatgtgaggattatatgaaaatgcaggtcaagtgcttggcctggctcatagtaagcactcagtaaatattaatcccctgtgtcggctatctagaaggttctcagtgcttcaaaacacacctacacaagccatgactgaaaatgttaggtgaagagaatgagaaacacacagcaaggccaagctacagacaagttacaaacttcatccaacaggctagtgttcataaagacacttcaaggcaaaccaaaaggtcaaaatacatagaaaaactctcatcagaaaccagatttcaaatttaagccaaaatgagacattattatgcagtccaccagatttttttaaatgttgaggtttgactacaacaagtatcctaaaattagggggaaactatgcacatactgctggcagaccagtatggaaaacacaatcttgcattagctggtaatgatgaaaacatgcataccttgcaatctagcaattctactccttggtacacatccaagagcagaacagtgttccatcacctgggagtctgccagacaggcaaattctcaggctctactgtaggcttactgaatcagactatcagggctagggccagggatccacatttaaacaagctttctggtgattctcatataaagtttggggaacacagccctagagtatccctggcatttatacccaggtggcatgcataagaatgctgacagcagcaaaaaactgaaaccacacacgcaagtccatcaacaataaaccaaataagtaaattgtaccatattcatagcatgcaatgctctacagcagtgaaaatgaataaattacagctatacaactcagctgaatcttataaacataacgctgagtagaaaaagcaaatcacagaaaaatacattatatatacacatgcatgatacatgtatacatctatgcatgatgtatatgcatatataaaaatgtctatatagatgataaaactacaaaggaaagcaatgaataaatgttagaaaaacccagatagtagttatctctgccagatagtagttaactctgggtggagagaggggaatggatgcagtactctggggatgtccaaggaagtaggaatattctgttttcctaaccaggctggtggttacatggatgtactttatatgctttaattgtcctttaaatagtacacatacactttatagactcctctatatcgtatcctcatatcacacttcacaataaaaattatttttcaaaagtgaccttcatatatatataaaatacaaatggatgtcaatctgctttcggtgtttttctgcctagattcaaatacatatcaaacctagatacacaggccctgacatcaggctacttgcatttaaaccccagctccaacatttaacaaaataaccttgtgcagctcagataacctcaccatgctttggtgtcctaatatgtaaattgggtatatttggggaggaatttaatgagttaatacatgtaaagtgctttgaaccacgtgtggtacatagtaattactaaaaaaatgaaaagctactattagaatagaaagatgctaagttaaaggcaatacttcctgcatctaatcgtcaataaaccatcagcacctatgagaacaatgaatccaccttccctgttttcccagatgctgtactggcatcaaccaatatggtaccattacactcaaccctctcctctacagggttgtcatcatcatgttaaaagcattcagaggctgagtaactttgattctagcctagtctcaaaacacacacacacagacacacacacacacatactcccacatgtgcacacacatgggtccttactagcatatgaaacaattaaattacagaagcaagagacagatctaggaggagacaacagaaaagctcctatctgatatacctgttgtttccaaatcaaatcactggcagaattaacactctacatacactaattccttcccctaattataaagacagtggaattatatcagcctagataacatctgttaaaatttaaggaggattgttaaaatatttgcccttcaattgtggtttccaagtgtggtcgatggaacactggtggtaggtagtccctgctgagctataatttatctggttgtcacactgaatatagaacaaagtcttgcatgcattaagtgctcaaacttattcaaacaattaaattatccattgattgtgtctgtgtaaaacaatggtaatgaccaggtcccaaaatcttcaaataaatatccaacatcttgctcactatatgaaagcacttctctttctattattattactattattagagacacagtcttgctctgttgcccaggctggagtgcagtggtgtgatcacagctcactgtaaccttgaactactgaactcaagtgatcctcctgcctcagcctctggaatagctgggactataggtgtgtgctcccacacccagctaccaaacccagctagttattttttgtagagagggaggtctcactgtgttgcccaggttgttctcaaagtcctggggtcaagctatcctctggcctcagcctcccaaagtattggaattacaactgtgagccatcacactcagcctgaaagcacttttctaagtgatttatatatgcacacgcacaaacacacactaacccatttattcttcataacaaccttatgatagatactatttattatccctattttacagatgggcatactgaaagagaaacatcaaatgtgttgtccaagtccacacaaaaaacaagtgtcagagccagggaaccaatgcaaatctggcttcagagtccccaatctttttttttttttcttttttctttttttcagagtccccaatcttaaccactgtgtcacactgcttcttcaggctactaagtcagtgtaaccttaagagaaaagaaagaaaaagatttagaaatctacagaaatgatgtacttgataaaagaagcatttcagttcagaaaaacagaaactttaacaaatgccaaatgtattattgtgtgtatatatgtcaccacatatacaaaatccaggggacaaaataaagcaagacctctttccacaaaacacatagaaaagtaaatttcaggtaagtaaaatatgtatatgtgaaaacacaaacagataagtaatatctgacatagtgtgacgtttgaggaagctgtctttggaggtggacaggtctcaatttatatgactgcttacctaccaaagaggagtaattcagacacactcatatatatatatatatatatatatgtctgtattttaattatgaagaatcaagacttatgaaaataaggaatcacaatcttgacagtatctattatatatgcaaatactaaaaaaagtaacctgtctttccaaatgctttattttgcaccctaaaatgttatacgcaatctgcaaaataatccactgttatcgacgtttgagtacaccactatctccctttaaaacacagcttcatcaagaaggcctcaaataaagagaaggatcataaaccaaatcatgaatttaactcagtttcatttacaaggtacttaattctaaatcaatttgtaaattaaatcaatggttatgatattctccccaaatgttcttatctgtcaaacaaaaaaagatagaactgtgaataagaagtgaagtcctcaaacacaaacatggtatgtacacaattacttttatggcagcaaaacaatgtgtagaggcaaaagcaagtgaaatacaaattatctatcaataagctaaggccacaccaaaagcacaatctttaaaatatggtaaaattaaatccacaagtgtaagaagataaataaattagagaagctttgaagccaacaaatccttggtgggcaattacctatggaatttgattccttaagtcttcatcattatgcatggaagcctctaccaacaatctagagctactaaaccattataaacagaaaaggcctccagaaagaaagatgctgggacaaatgtggacaatctgcatccctcctggcagactctcagatctttaaaaaagatatacaaatataaaaaaaggtaaatggtacccggatacacacagtgtgtggaagtagaaacccctcaatgtaccctttccaaaattaaaaacaaaaaactgggtaaagccttgttgaaaactgggtcactagtaagctcagagaaggtattaagaagcatcgctgaaaagattagagtctgttaacacctaaatcttctgattaaaaacttcaggtcagaaagatatttagttctttgtctccactctcgttctaataaaaggaaggacaagagagactataacttaacagaattccaaatgtatttggcatttggctgaagtgatattgccaaactaccagaactatggcaaaagatattgtaagaaaacccacaaaaggtatttagtggcttgacaccataaatgtgcgagtggcctttagctgcaaaaaatgattaatctttccattttaaaccaacttcaccctccttacctccaatatatttctatagtgtccgtctttcctaattttgtgacaattacaaatacatatgatataaatataagaaagattctgcgtactgagtggaagatgccagacacaaaagagaatatggtttcacaaagtataaatgagcaaaaaaatcatgctgttggaagtcaaataaatagttaccactgagggacggttaaaattggaaggaggtactggtaaaactctgtcttgattcagtgctgattaactagtatgttccatttaggaacatttagcaggctgtccacttctatgtatattttcctgtatgcatttgacacttccataaagtaaatgtatatgtgtgtattatatgtacataatctgaattttgagttccctaaaatatcatatcaggtagcaggatattagaactcaatcgtaaaggtgttgacaccaaatagactttagcaagagagtgggtgccaaaggccaatattttcgctgcaaaaacagacttttctttatttactcaacccgagagccataaagaatgaacttcagactttgaatgtctgtgttaaccaattaagacaacaaaaggaaaaataataacaaagtggtcacagtttcgagtttattaaagatttatgttaagcgggagcggggggattacatcccctttcaatttagtaaatgtaattttttttagtcctttatttcagattccacttaatagtttcccaaccaacaaacaagacatttcgtgcaagattacagtcaagccaagtgtatccacccaccaacaacaggtcaagttacaagtaaaatagttctaggtttttcccagcagcaaacaaatcagtatctgtactcagttacactacagaatattcaccggaacttgtctgcagtgggtcatttcaagatgtggacatgtatattaaaatatgccaaataacattattagtgtgcgaaaaagtaatgcaaagtgttcaaatatggaaaatgtttgaacattaaacattaaaacttttcaaaaattggtggtggaatatcttgcatttactttcaccctgaagaatatggaaaaaagagtttcaaaaaaaatgtgtggtcttgtggcctgagagtttataggctttcagaaagtattttaagttccaagattcattaaaaaaaattatttttgagtacttaccagcatattatttgttgatcaaaactattagaagaacttttaaaaactgattatgaatgcttctaaaatgttttttctctcctaaagaccacaggaaaaaagaatgaaaatcttaaccaagcattatgttttggcttcagatgccaaaagaaagcaaaatatttaaggccaagattaaacagagagtgtaattcaaaagttaattatttaaagaaaaaaaaatcaactaagtagagagaaactgaaactcttctttattgtgacagtcattctctgggtattatacaaaaagggctgcagtctgataaagggagaaacccgtatgctttgtagtcaagcccaacttgaatatgacaaatatggttttattctggattctcatattcagaatgtttgagttccagttttaccatctctaaaatgagagcaaaaccacctatctcatagagttacagaaacaatgaactgaaacataatagtttccttccctgaaattaaaaatacttaatttctgaggtttaatactaacagacattggcttgaaaaactctttaaagaggcagcagcaaatacctagtttcaagggttttctctgctgtatctgctctactgagttctgtgaatgacgtactgacaattaccaaatataaaataaattgaggaatgtcttaaaactgcagatgtgggaaaaaactaaaagggcaatccttacaacctttaacgaaagcagtaacatcaaaatccaatatttagtgcaacagaagaaagttaagaaaactcaaagtgtattttagtaatgaagggagaaaagagtcattttacatttttagtgccagtgatttctggaataataaaaactccaaactatgcaccttttaatttactttttaaaactaattatttaatccacccaaacattaagtaacatatcagaatggaaagaaaatctgggcatacatgttttaaattataatggccaattaatgtttttaattacacaaaaatcagtattaaaattaaaactacaatatatgggagtaggtaagtacactatctaatttttaaattatagctaggtatattttatgaaagaaaatctaagaacagatcatggatcaaacatctctgcattataattcccataccatatgtataatagcaactctttttaaatagctcaagctgctttaaagcactatacaactaattctcccaatgctactttgaaaaacccaagttaaactgcttacttaatcaaggcagtgggtacactagaactctcattcatatactaaatgttcttctgtatctccagttccacatactagtaaggtccactttcaattacacttccactattagaacagatgaaaagttaaacattcaatcagtcaggagaatgtgaaatattaccatggtttacccaactattataatctctcaggcactgagaactcagcataaagtggttattccatgatgtcagcatggaaacgtatccattatttagctatccattaattcagccaatcttcctttggatctacttatagctcaggctgctataggttgttctaaacctaacttggattgtcctagtgttagtttaggttatcttcattcttaaatctactgtttgattgtatatttctcagttatagcttatattgtggtctgtgtcaaattaatcctcattcagaagcctgaaatcctcatttattttggttgtccttctctgtagcttttttaaattttattttgaggtggagtctcgctctgttgcccaggctggagtgcagtggcatgatctcggctcactgcaacctccgcctcccgggttcaagtgattctcctgcctcagccttccaagcacctaagattacgggtgcctaccatcatgcccagctaattttttgtatttttagtagagacagggtttcaccgtgttaggcaggatggtcttgatctcctaacctcgtgatccacctgccttggcctcccaaagtgctgggattacaggcatcagccaccatgcctggccctctgtagcttttttaggttcatgactattcccaaaacatgaggtggcttaacaatcgctttcttgaacctgaactagtagaaaatgttttgttccctacagcaggggttattaaatttagcttaacattatgccataatttcttaaatcatttcttactcatggacttttagagatcaaataatccaatctttcgtaatcataagcaatgcttcaataaatatcttcgtatatgtatctataccatgtgtttgtcataaatacatgcatacctgtaccaaaaaaaaaaaaaaactagaggaggccaggagcagtggctcgtgtctgtaatccgagcacttcgggaggccgaggcaggcggattccctgaagtcaggagttcgagtcgagaccagccttgccaacatggtgaaacctcatctctactaaatatacaaaaattagctgggcatggtggcacacgtaatcccagctacacaggaggctgaggcaggagaattccttgagcccgggagacggaggatgtagttgagccaagactgtgccactgcactccagcctgacagagcgagactgtctttaaaaaaaaaaaaaaaaaagctagaggaaaacttgacaaagggctagagctgtatttttaatgctgacccacttatatttttaatgttgaccccctatcactcaattcaatggctctcctgaaggctatcttctctcaaagaaacatgagctcataaaactaataaaaaaaattttctcagtaatattacacttaccttcattttaagcctaaaaataatttttattctcagtaatattacacttaccttcctttaagcctaaacccctccccaaaattgtttacttttactggcaaaggtagcacagccaatgaagaaaattttaagtttaaaattcaggcatataaaaaatatagatgactttaaacctatcacgataaactacggttaataaatcttcaaaactcacattctatcactccaagtatctgaaaattcttacattttcggctgaaaaaagcctttccacaaccttcgaaaaggagatgtgtttgagatattttttaagtagccccaggaatcatgcaactggacagtctcttagagatcaactaatccaactaggcccaagattttattgttgaggaaaatgaggtcacgggactttaagagagtagactacatctggacgaaatcagaaccccatgcttcctgccctggacactagctcttgcccttgacactacacaagggcattcacttacacagatcagttattatactgttggtgcctaaaccacctttcatgacataaagtaatcaatcaattattgattgacacttcatatcagactgtactcagtgttgcaggagactcatatgtatatagcagtcctcaacatacatttggggtgtgtgtgtgtgtgtgtgtgtgtgtgcgtgtgtgtatgcaatccaagggcttgggggctgtaagtacagttggaagcagatgaggaagtgcactgagtaccaaagagtgagcgacaaggaataaaaatctaagcagaatttaatctaaattttccttaaagagactattataacataaatcataatgtttaaatctacatctttcaaaaagtcccatttagcttgtgaattcaccttgttctgcctactttagacctatcacttcatacatgcagaagatatagctcttactaaaacattaatatgtatatacctcttccttggcatggataaggttgtttaattaaaacttacatgtatttagttaaatacaaagactagcatctgctcaaattaactgatgtctttttctgaaaaattaaaataaaaataaaattttagtagaaaaaaacagaaatgtgagacacagtgatttgttggtaccaattatgtttcaacttaaaactcttaacttgaaaatacttaggttctagcaagtatactgctgtcagagcgaaatacttattcagatgacaaaatccaaatttaaaaatctatcacatttttaaatggctgacaaaaaccaccaccaaatctaagcagtgcctaaacttgattacttttttgtatttgagccaaaagaacaaatctgaatgttaacctgggaaaaatggtagtgtatatacgaacacaacacttcttaaataacagctctgatttttaaaaatcactcttctaacttcataataaccccttgaaaagaagatggggattttaatcacttaggattaaaaaaaataggatttaaagcaagattaactgttgctttaagtcttgacatttccctattaataaccctaaagcttaatgaggcacaacagatttaagaattgaaattgttaatgaaaaagaaaattaaggacagtttggtgctctataccatcatgaaaataatctgctccagaaagattttagtctctacatgtaaaaagcaagaaatatctaaaaagtatttccttgtaaaatctcagtctgaacttttagaaggttagggcagactttgatgaaagtataaaagtcagaaagtacctatggtttaatatatagtgttttaaaaacaagtgaggatacataaaatactgtttttcaaattacacctagtatgtttgtaacctttcacctattagtaatgaccgcatgcctcaagttaagaaaagcaaagaaatatacataactgtgtctagtaagtaaactctgaacaccaagttaactcttcttattttcacaagaacttatgtttcaaaagcacatgaaaatcaaataaatactgagaataaacacgatttacacttaaaatcactgctgaatccttgccacattctagaacaaagctgcttctttttatgtatacttcatatgttgaatattaatttctttaaaatctgtacctaataggtgaaaaacacataaggtttatccatcgtttttccaaggtcctcacgcagggttgaaaccaggatctgttaagtcttagaaatgaatttctatgaacattaaaatactgtcctagatgccccataacccatacaaacgtatttaaattagaacaatggggttatgcaattaagatgtgaactagaaaaacaacacaggtttctaatatattaattaactaggtcaatggtaaaagcaacattgattttttttcttaacaataaacctatgtaaagatttgaaagtcacttgtattatttaaaaggaaagctagttataactttgtgatataatattttatacttttatcaggtaagctgaatgctcaaattcggattttttaatataaaaaaggctaacatcttaaaataagactaaagaaaatcttgatgttgaacatcataacatgcaagattgactagaattatgtaaatctacataacaagactaactaaactagtaatttctctaagtaaaataaggtacacagacacttcagttaacaattcaaggcacagagtcctttgaatattcaattatatttagcttgtaaaaaaacaagggtgctccgtatctgcactaataacctacatattctcttttctaaaactatcggctgcttagtctggaatttaaaaaaaaaagaaaaaaaaaacctagactgttaatagcagctgactgcaggacagccactttcaccttgcagatagagctttgttgttcgggcgtgtaaagcagaccattagcacaaagtcatttctaatctcagttgtacaatccacatggtgcacttaaccctaaaactcatgttgcgtaaactgctctgcttccactcctaatgacctttcaaatcattcaatgttactgcttgacttgtactcatgaattagaggactgccaaataacttgatgagaaagttataatttctcctttcctgaaggtttaaaaaagtcaacattggtatagaagaaactgagaaagaacatacaatggaaaagcacattatttaatgcttataaacgatatttttagaaacacttaagaaaaaactgacagaaaattcacacctgacttcaaggcagatgactaaaacagaaaatgagagtgctccacttgtaacacacatagatttcccacagtattcatgaccaacaaatgtctcttcgtgtcctaacttcgctgcacagtattcaattaaaactcacttttagatgaaaaagtttgtgaaaataaccatctgctgctggattcacactgaggatttactgtctgtaaataagacgacccaatgctgtccaaaaattagtgtttttaaagtaagatttgtaaaaaatgtatcacatctcctttgttaaaaaaaaatcctaatacacaggagtctttaagtttgtcttgccttccatttaacttcaaatactttagaagcaggacttttttccttcttcctccttcagcctaacctctttaataaaccccatttttaaagaagaaacaataaatgaagtgacaggaggtcaaagaatgaggagtgtgcgctgggagaataaagggcggttttataacaggaggtacttttgttagcaagtgactggcaggtctcctcccccaagttagaaggaattccatccactctccaaaactgcaaaggccaaaaatgtctagtctaatagttctgaaatccccgagtcaggagagagccgagtggcggatggcgagtgggggaagggagaaagaccggtaggagactaaagaacaaaagaagaaatccaagaaagggaaaaggaacgctgggaccctggcctgggaggcaggggtggggagagacaaagtgagagagcacgacccgggaggagagcgtggagccgggcagggacaggcgtgccgcaccatggcgcaccatggacagggctccgcgcggcggcggcccacgaccgtctaggggttgcgggagaaagcgcgagagactgcggaggccagccccgtccagcccctgcccccgccccagcagcactcaccccccggcgggccggagcgcgccaggccctgacccgtgaagaccacggagcggggtaatccacaccacctgtctccacccccggagcaggcacttccgagctgcgtccgcacttttcggggctgccagctggcagtagagcacctctccccttgccccgagggcgacaggcagggggaccctccgtggattttcctgccccgcggcgagggtgggcacgcccctttcccgcaaccttcgagggaccccacggcaggcggagaccgacttgggaccagggcactgcacccgcccagctagagggtcccggccgaggctgtgtgaagtggcctccaggcctgggctggctggtcgggaggagcctgggggcatcctcgggttggaggcggcggaaagttgggctgcccccgggctgggaacccgcagcgtgcagtggcgagggaacctgcgcccggactggagcaggtgcttcctgccgcggaggagcctcttagtagagattaaatgaaaaggctcgctggctctctcccgagggtatgaaaagtacggaaggctccaggcaaaggcgcccccggggcgcatatagggcacaggcagccggacagagaaaggagcagccgcgtaacggaacttctcgcccgggggagatactaggcgtgagaggccagactcgttctacaggcaggcgctgaccggcagagactcctccgggcaagagggccagattttctttccaggtgggacgaacacagaatattgtgagggcaagagaagaagaaaaggaggcaactccagactgggataaagacaataggacagtagagcccttgagcaccgggaggcgcacgggtgcagggtggggtaaggtggaggcaagtcccgtaactaagacaccagagtgagaattcctactgtaaactcgcgacccatccctgcagaaataaacaaaaaaattggagcaaagtactatgcgaggggcgaaaggcacagaaaactgcaaaacctgggagttatcctgcctcaccctcctgctgcctggggacaccccccgcgagcttgctcggccccgaagaaggagcagaggggacccgcaatccagcccctagagccccgccaggaaaggcgcgagagacctactggccccggcaaccctgccccggcgcccggacggagcccgatgcctgcgcagctaccggccgcgcggcgcggcgcggcgcggcgtggcacctcccttcccgggtgcgcagcccggccccgcagcggcgcggggaacaaagggacccggcgccgcccgccccaccccgcccgtggcccggcccgcggggaccgccgcgtacctgaagcagggccgccagcagcggcagcagggtccgcagcgctcccgctatccggcacatggaggcggagaggggccgagcgaagagccggaggaggcggcggcggcggcggcggcggcggaggaggaggaggcagcggcagcaccaacagcggcgcggagaaacggctccaggcagtttccacccccttcccttcccctcccctccccacccccttcttcgctgctctccgctccccgccaatggagagcgagctgatgacaaatagcgggccgcggagtccgcgggactcgcaccaggagtaataaaacagacccagagatcaaggagctggggagggggcgggggaacagggagggagagcgtgtgagcgtctgcgagtgtgtggaggcggctgctgtggcagcgcaggcggctcggctccggcccggagcgcagcggaagccgcgagggatgcagcggcggggaccttggccggtggaggatgtggaggtggaagtggagcggatggcgctcccc

SEQ ID NO: 339 - DNA, 551322 bp, Homo sapiens
ctttcagaccaagaatcaccagttatgtttatttgtcttctacatggtaaaagcatcagacatggcttgtttattattttataaaaacaaagaacagcaataaatgaagggttctccccagatacaggaattatatacaccatttaaaaaatatttgtgcttctgatggttttcaaataaaaagtcttggttttaaaattgaaacagtatttttgaatcacaacgattacaatctaagaaggcaggaaagctaatggcataaccctctaaatggcacgttcagaaagttatacttccaaatttaggtgaagggagaaatatttctactttctttacccttaaatctaggaagcagtatcaagagacgctatttatttattggcttatttattttcaaattcagtctctaaaatacaagggacaaaaaatagaaactagctttgtatatttccatttgacttagagttaagcctgatgtgtaagataacagactgtttacttaataccacagtcacactgaagattttactatataacacgtatgctttaggatgtatccataattagtacagtttttaaataaatttacatcgttgtctaggataaatatgccataaaaccccaacatgtcttagtaatattcttatgctaacccagtatggtagaaaatactgtataataccgactgaaaattagggaccatcgattctcatctctggtctgtcactacattattgagtgatcttaggaaactcactttccctctctaggccatggttttttcatttgcaagatgagcagctgttcttaatgatctctaagactatcttctgctctaacattatgattattgagaaaataatttactgaagttttcttaaacattccttctgtaaattttcttttgtttctatagtcactgctgaaggaagttttatttcacttcaaatttagtattgtgcaaagagtcagagaaagaacctaagtataaaaaatagaaaagggaattaaaaatattgagcaattatggggacatgtaggctggttcaggacagacataaatgaccttgctttattctaaattcagcttactggcttatgatgaaaaatgaaaggttttatatgaacttactgggcaaaaccagattttataaataattacctgtcagactgttcaagatagacaaacatatgccagaccaacaaaaacacagacctgtcatatttctgagagaaatgtacattgagtcttccttctctgggactataaggagatcaggtggaataaaacgaaggaaaaaaacccaaaccctatattttctgccttgtgcatactttaaaatgtataatgtgggagagaaggaattttgatgtgaaaaattatcccctgaaaattttataccatctataagcctggcagatcaaaaccaaatacaataaatgctatcgtttaaaagttaagttaagttaggatgtttactgcaagcttgtaattttccatgattatggatgccaaggaaaataagaatgataaaaagtttaatcataatcatacattttaacaagcatagatggaacatcaaaatcctttgggaatattttgatattatatatctatccgtgctttttgtttctgaaatgcaaattttttctaaaaagattaacatagagcaggtaaatgacagttaacaaatgtaaataatgtggcataataatattaactgagcctcataattctttgagtctgatggttttcaaataaaaagtcttgaatttaaaattgaaacagtgtttttgaatcgcaactattacaatataagaaggcaggaaagctaatgacataacctctaaatggcatgttcagaaagttttatacttccaaatttgggtgaagggagaactatttctactttctttacccttaaatctaggaagcagtatcaagagaggcttgctctcttgagcagtatcaagaaaaaggagcagtatcaagaaaaagatctttcatgtttctcatttctgtttttattaattctttagaaagagtgtttcaagtatgtgtaaaaaccataaaagtaaaattatacaaaactcccacagaattaaagaaataactttcttttttgcaactgaagtttaatcaggaactgtacaattacatctgctatattttggtttgttccaaagagttacggttcctcatttactggagaaagtatagatgccagaagggtagctcggctgctaacagcaagaaattacccagcccacatttccagtctaggtgtggtagtgctttgaagggaggaagcaagaaatcactctgctccccttctactgattctgaatacttggcttctaaatgtgtatggcatgtgcaggagtggtggatctggggattggaggaacaggaaaaggagggaaatgaagatggaggaagaggttctgtgtgaggaaaaacacacatgaaaggcagatggcaggaagttgggaagcaggcattgaaaatgacacatactataagtggagtgaaggggaaaggaggtgggaacaggtgatttatcaggtctgttagatctttgattactgtaagtttataaaatggatagctgtcactaaaacacatgtcaacaaatgttggaaagtaaagttggtggtgtaagggaaggcgaaaactcactgtccttttaattttgtttccttgttccaaacctggattataaaatatatcaaataaaatgcagacaaaacgctggacgggggcaaccactgcttttaaggtatgtgagctgagggcagtaaatctactcaaattaaaatttcaaaactgtgtgatctgcattcttgtccacctacagactatcctaaacatcctgccattaattagctgaacagcccatctagtaaacaagaccgatggttgaggggctggaaaagaggaggagtcagcaagttgaaagtcacaacagaccagcccactccctcagataaaagaaaggtaaatttgtattttattttgttcacaagaaatcaccttaatataacattgcctttcctgttgttgcaggcacatcacagttgtcacatcagcaggctagaaaagccatcccattcctgcggtaggcattctgtcaaagaaaaagaaatctgcaatgaattatcacatgaagtcaaacaaggaaaggaggcaaaaagcaagcagagccctcttcctgttttgtagactctgctggctacaatctaatagaatgcttaatctgaatatttctggtggcaaaactatagcaaccattctgtctattaaaaagtcagtgtggttaacaagtggttagtgattctatttttgggaagtagcagatacataaaataagacatcccattttgttaactgattgggcttggttaggccaaagagatgtattgaatctgtttgtcttttataaacatgtgttctctattcgatatgctcaggaatcacttctaactaactaagtatcttaatagtctataaattactgactcattactggcccttcccgggcctaatttatagtctgagtgaaaagctgtcggaacagacactaatagaggcctctcctcctccctaaaatatgatgatctcaaaggagttctgtatagttctgcatattgtagacagtatcaaaaatgcaaatcttatataattttatatacatacctgtacgtacagatgtacacatggatatgcatggtgggataaaatactcccataaaagaaaatgggaaaatggattctaagtgcaataattaatacgtttcagtaaagaaagaaaagttgcatgcttttcattccaagagacatattttgcatttcagtgttgggagacctggatcacacagggtctctgtaacatcctgaattccaccataagacccagaggggagcagaactaaaattcaggacttaggaataaaatttccctttccctggcacatttttaatcatttaaactagtaacagtcacatccagagaattcataaccgtcaatcttttcagaaaaacaaagaaaatcataaaattcaggttagggatttttcccccttaggctaataactctgaagcagttctggagtctgtatacttccagcccaatgaattaaccttgaacagccacagccatattttaagaaatacagaataaccttttacgatcaagataatgctatggaggcagtgaaatcttcatcttaaaaaataattaaaccacatttataattaattatactaaaaatggaaagtagacttaacccttttagaaagacttccatcaacatgaggtgaaacaaatatagttttctagataaccttctcttaatcataaaattcaattaacttgaaaaccttctctccaaatatcctgcttaagaagatttactgtgcttgtcaggctttggcgccctggctgaaatttctttgcttagttatgctgctatgcagttcactccagatcagtgtatcagggatgacaaaacagtggcacattccaagtgtcattcctcagtgttctttctgtgagcttgttctttaccatggggctttttgtgttgtagaacacttctggattgaagaaaacattctaacaaggactagaaaattccaactctacttcctaaaattgcgctatagaacagtgttaagtgaatgcctcagagagccacaaataacttgcaggaatgcatagggtgtcttcccacaaccacaggcagtggagcctcagtctgtgaaacaaacagctcctaccaccacggctgccttacagagaggcttatgccaaagtaatactcttagcttcttgaccttgatattttaaattttataaccacagtgacaatctttaacatcatgtattatttaaagcacagggatggttttatatggagttaaatggacctaggagtaaggctgcattccttctaaacatacagtgttgaagtgagccttgcttgagaaaggaggttttggcttagagggagactgagtcttagctgagttcacctgagaaataaccaggttttaatcttttcagacggggcaatataaaatagttcttattagcatggaaaaggtcacttttgaaagatcgattcaccttcacagatgatttatcactgctttgcaaacaaaagatttttttttaataacttatttaataacacagatcctatgagaaaaccaaagtttagagttgacccagatttctgtgatgttcttcccatttgaattctgaaataaataaagaaggaacaaacaagcatgtgtaattagtgaagagcaatttcagtaaacatattccctagggtactctattttgagtcactgctttttccttttgatgtacaaaggatgtacattgtctatgtagggcaattatgggaacgtcccaactttggcatgctttccagaataagcaactttacaggaagatggatgaagacaacaactcatcttcacgtcaactgtaaatttctctctatttgtgttgcaaatgttgaaactaaatttaaacattgcttggtgtgagggccttccagaggccacattctcatggaatactttgtatcccacttactttcttctgtcagaccctatgaatgattcccagttctgtatctatctttacagacactcctagttagtaaaatccaggctttgaccagaaagagtcaggacttccacccactactgaaaattatagcttaatcaataacacaattagacctccccaacaaactggatcctacgtgcctatatactacttaaggttcatttctggtttaataaagctctgttctcaacatcagttgctcctttgtgaatttgctgaaaagctcagacattttagcatctcttaaagttcacagcaaagacaatacttaatgtgtttaaggcccaattagttataaaattaggaattcatagttcccattttttttaattgaggacccaatttttgacattcatttattcatacagtgccaaattacgacctgtgccagaatgtcaatctacctggataagcagatacagattttacctactgcactgggcactgtggggtaattaatttctaagtgtgtactttttaaagtgactgttttttacttcatatggacaaggtagagaaaacatttaaatcccatagtggtttacttctgttttttatgggttatcataaattgatacatcttaggggatacaaatgaatattaaaaagcaaaagattaatatttttcttaaaaggacacatgctacaaaacttactttgtagttccgacttaaatattactgcgtattatgtttgccattagcctacttattaaaacattaactataaacaccagtctttcttccagtacagacttgttttattctattacctttcctgattctcttctgctttctcaaatcttaaataaactagcataagaatctcactgtagtaagtaagtcccaaactctcctacaaatactttatttctcaaaggcataagaaagaggttttggttctattgtctgaattcctataaatttgcttaatatgatttcagcaaatttttactgagttcttattctgtaaatcactgtgtgcttggtggtacaacaggacactaagataaatagacagtccctggcttcactaaacttccagtttcacattcaagttttaaccaccacaagtaaaatgcactgagaggtcattctcaaagtgagaaaggagggagaaaacaaagcaggcttttgtttttttgcttctaatcacaatatttaatttgaacttacttacactttcgaaaggcatgagatttgtctatttctcaaagtagggaggggcaaagattaaaaaatgctgagatacatggttttatggtttatgaaatattttcatgtctgtatctaatttgagccttaccacaattagtaaaagagtagattttggatttaaaacccagggcctgtgttcttttcattatactacattgtcttacaataaacaaaacaaaccagacagtcccctgccccaattccacccagagcactgtagatacacatattctcttagtcctaacaaactcagttcttgctaaacatcacttaaagggtaaattacaattttatttcaaatttaagctaaatcagccaggtataatacttccgagtacagacaatggaccttaaatctaaatcatcttcactttggaggctttctcaactactgcttattttccaaactaactttaagaatagtgtatagtatagaacattgcacccaaatcacttggggagctttaaaagacacagatgctgtagctccagttcttcaaagccaatgggtctgagtggagattaggctttggaatgtcttagaagtatcccaggtgcatagtgagagctgagaacagtggtaaaatggatgaggagatcattaacaggacccaataatggtttcgtcaataaatggaacattttcagaatctgtcatgattatggagtaaataaatatttcctaatggaaattctaattttggcatttagtaaatttaacatggaagaggcagaaattgaagttttcagattgtggcttttatccacagcagatgggttacctgtatctctcactttaggttatctgtagattaggcattgctttccgcccccaagatgctgagatgccactgttaggagcacagtctgtctgactgccacaacatgtttaatactatagtgaaaaaggaatttggaaactaagcctgctaaaccaagctgaacaaaccctttactaacatctagaatcaaggaacaatagaactttggaattggaaagtatctttgtgaattcctctggccccattcttaatttaacagatgaaaaaactaatgcccagagagagtgacccatccacagtcacatggttttcgcctaggattcctgactcagtttagggcttgttgcagatggttctgattctgcccaaagctatgtgtttagcttccccggccttaatggggaaaacagatgcagggaaagaaacagtttttctggataaagaacagcccttgggagcagaacaaaagtgaagaaactggtggagttggcggaggggcggttaggggagggggaaggaaggaacacaacttaattatgtccgaaacaatatagctgagcaggtagaggtcaagccattataagctttgagttctaccttgggcttttctgctttatgattagccctcccctggagaatcacttaattttcctgagtgcccaaaataataattctgataaatggacaaagcatcaaaataagatagatatacatagctgaaaggttctgtggcaaatgtatgcatctttaggaccttcagggggttgatacaccatgtgttttcatggaagtcttactatggctatgctcagtatctgattttgggttgagcaaataatatggcctgcgtggagctgtttggagttggcaagtttgggttaaatcaagcagtaaaagggacgataaaaaagatttggagcatacattcaccctctcccaaactactgttaactcctaattaactaagtatagagtatacatgctctgtctctaggatgatctgtgggccacaggagctgccctgtcaccaagagcctggggttttccaaattcttcacatcttgggatgtgagggcacagagggttgaggttgaaagggatgaagatgggcacagagggttgaggttgaaagggatgaagatgggcacagagggttgaggttctatgctggctttgctttgctgggagaaaaaggtagggaggtagtagaataaactagaagcaacaggctttcactaactcttacttgttaacctaaatgtctggtttattggaatactcagttgagccaccgttgggatggtaggtacatttctgaatttcatgtataaatgctgtttaggtcaactaaattagtccccctctctgtcccaccccactcccaagctttatagtaaaaatcagttgtgcttctaacaggcctttttcaatctctcttctggtagaagagagactatgccaagttgtctcaaacttaggttgtttcaaattcaactgctcccatatgtccgaattcagccctggtctctgtgaggtcattagattctgagtctaagccctccatttgcctaagaagatgaccgtgctctgaaagacatattgttttgctttaatactataaatcctggaagttcaggagtttcatatgaaagctatgcaatcgctttttaaaagataaaatatgcccctttctttgctgcccttgtgtctgcgtgtgggcaagatatttaattataatgaataaagccaaatggtggtctaagactcttaaaatcaaagtgggaatcatggctgaatttcattagcaaacataaatacaaataggcacatcttgtttgcaccatgccatgtgacttttctccttttgataatttcattctaactctgatatttcagaggacctaaattaaaccatatgatatatagcactgtataacatgcaaaactcatcattaaacatttttcttttgtatacttgccctatgttataaatatcctgtcagaagcagagccctgatttaacaacagtggagggagccctgccctttaaataagaggtcttctccggctggcagaatgggaaaaaaacatagtattaactctcattgtagtccatgtaacccagagcccataaatcttgaggaacttgtcattttatgcccgattttccctaactctatgccagtctcttcttattttattgaaaatactaacattggacttttataaattcttgagttattaccaagttgttttggcagtctgaatacaaaaatctctagattaaatttagttattaaaagttaccattcataattgcccaagtcatttcaaattatgagatatattaagacttttttgttgttgagcaaaataattaagtggctaataaatacaacattgtattttaggaaaaaaaggttttttgtaaatattatcttcagcaattttatgagactatgtataaattctttccatgacactacatgcacttacatacatctttgtttaatagtaacttaacaccaataatattaaacttgtcttcagctacttttatattaaagacaatcaaaacaaatgtctcaaattattccaagctgcaaacacatataagtaaacattttaggttcacatactgttaccaaaaattagaatcaatagtaggtttgtaatagataacatcaaatactcttttttttacaatcttggttttgtagtcatgttactcaactgcattttcaaggtcttagacaatactgatacaagataaaaacaaaaagaacggccaaaaagtgccaaattggcaggagttagtaacccaaataacaattgtttgggggctcagctctaacaacagttaattctcatttcgcttgagtaacctataacctccagaaggaagggaacttactgttctgtttatttctgtatgtctaaggcataacccaatgcatgaaataaattaaatgcttaataaatagtcatctaatgaatgaatgaatttgactagcaggtagcttcttttcctctgggcaataatgggaaatgctgatgtgctcatcattagagcaggggctggatagtctcagttcctaaaaagtgggcttagaccacacacttaccattttgcaagagaaccatcagcaccagttattaagaaaactaaattagtgaccttgatagcccaaccactagcaatgttgcaaagcagttattctgatattaggtctcagttcccactgggagcatttctgggcttcttcttactgattatcagtcaacagtgaaaagttatgcatcaatcaagccaattgctttgtttgccagaaaaagaatattcaattcatctaaaacaacactgtgaaattattttgttgagtctataaacattttaggttcaaatactctgttaccaaaaattataatcaacagtaagtttgtagtagataatataattttttttacaatcttggttttgtagtcatgttactcaattgcattttcaaggtcttagacaatactgatgtaagacaaaaacaaaaagaaaatactgttgctatggccttcccccgccttctcaatggcctttgccacattaaaacaccatacaaggagtaagaacacagatagcaatagctgtttgccaatggtcaacaccaatttgattggacagtaagtaaattacaattaaggtctttaagaattctttaaagacaataaataaaaaattatgacaaaaatcaggagatggtagttaataatatcaattacattcggtagccacctgagaagatatatttttacacttgattttagccaaaaggctgagaaatgatagagaaggtgtatgtctgtatgaacctactgtcattttacttattcattcaaaaaacacagagtacaaggtacagtgggtacagcaggatcacagatgtggttcctgccctctgtggtgaacaggctgagggggaagacacatactgaatgagaaatgccaaaagtgatggaagttacaaaatgagaatagagtgtaatgggctgtgtaagagggcagtagagggagatggtggtcatcaaggaggtttcttgaagaagtcacacagctgagatctgagttggggacgggaaggggatgggttcaggggacaaaaaagtgttttaagtaaggccaagaggagagagatcttgacttatcttgtttccaaatgccaatctataggctagtcaataaatgctaagtctgagacaccaacccaaactacctaccactaaagagcttatccaaattcaggtccgagatactcataagcattcaaccaagtgattctcttgaatcactgctttagggcctggcataaactctttatattaaattagagtactctctgttggcatttatttccaagctgaactgctgtggactgacaataggggggcatgcctcttccatgcctttgtgtctctttccttaaagttaggtgttcttgagacactgtgaacatacttttaccttgtacatattacacatctatatttctaaaacagagttgtgttaaatttgccatggacatttacaataatatgccttaaccattctgaaaatttatctccaacatatcataaataacaaaagtgtctcctctgatgtgaaagattaatttgaacagagctatcatattaaatgacaagatccgagttgtggagccatcccaagtcagatatattatttatgtggtagtgacagtactcattttattgggtattattctaattaattctaaaaggtgagcttttgggctcatggtaactaggatcctgcactggcccagatcacccttatcacactattgtccaagtcaactgcctactggttacattgtctcataaacacagtgaaaaggcttaagcgcatcaaaaataaatgtttgtttcactattattattatttttttttgaaactgggtctcgcccaggctagagtgatgtggtgtgatcatggctcaatgaagccccaatctcccacactcaagcaattctcccacctcagcctcctgagtagctgggactgcaggtgtgcaccaccacgctcagctaattaaaaaaattttttttagagatgagggtctcactttgttgcccaggctggtcttgaactcctgggcttgaatgatcttcttgccttagctacccatcatgcctggccccttgtttcacttttaacataagttattataattaaaaatacttattaaaaatattttattactcaacagccaaattaacaaaatggatcctcaaaagggcctatgaaaaattcagcaccagttttttttttcttttttgagacggagtctctctctgtcgcccaggctggagtgcagtggcgccatctcggctcactgcaagctccacctcccgggttcatgccattctcctgcctcagcctcccgagtagctgggactacaggtgcccgccaccacgcccggctactttttgtatttttagtagagatggggtttcaccgtgttagccaggatggtctcgatctcctgacctcgtgatccgcccgccttggcctcccaaagtgctgggattacaggcgtgagccaccgcacccagcccagcaccagtttttgactactgaattaagaagtcagttgaaattcttgtccaaactggttggcaaaagttgagatcagagtcatccttacaaaagaatgtggctgttatatttcaataacttttactgcgatttcttgaggaccagctgcataaattctacctttatgtattctattcatgtagcagtcaaatgaaatgtaaacaggcattctataaaatatagcctcaatgtataatctctatgcttaattcaaggaataatttcaactaggttttaggagaagggcaaatggaccttcctctgtctctccagtccaattggtggtgggagtgactgggtaagctggtctcaccactttcgggactgcctggcctcctgtgcatgcagccagtctcttgttcagcagacccgtgggaggtgagaggaggtaagctaatgcacaagtagctgccagaagaaaagatgggagaaaaaagcaaaagaaatatagtatttcaatcaaagtctaaaatttgtaaaagtggttttggtctccatatagtaaaaatatttatccaagaaactcctactcgggtgtgaacatcctacttctagtgggattttgtttggcaaaggtctgtgaaagagtggaagctaatacagaacatgtctataaacaaatttatttagttagtacagattgacacattcactataggatttcagcaattacatgtgtaaaactatttcctatagtggtttccttttgtgattttgctaatttattcaatctaggccattttcatgcactgactcttagaagccctttagccacccaggctgaaatgaacatatggagactctatgccttctttccaattctttgtgtaaacataattatatggtgatattaaagagtcaaacttccaatgaaaaagtcaaataaggttgcaataccttaaaacatgatgttgtcatctaactttggagaagagaaatttgagagtttggctatgataatgtacatgaaagtattatctctctgtctgtctctgtgatgtgcctgcttcccctttgccttctgccattattggaagcttcctgaagcagatgctgccatgcttcctgtacagcctggagaaccatgagccaataaaacctcttttctttataaattacctagtctcaggtattttgttatagcaagcaagaatgtcctaacagatattattattagttgttatatgaattaataagttccaccttttaaaccctgttttagccattattatatctcctgtaatgtctgacatttagatgctcaataggtatttggtgaatagaatttatttaaatactgttcaagtttaggtaatccgtgctatgctgtgaatatggtttttccccaccaaaactatttttttaaagcctcaccaaaactaatggtaaggcttggtcctcaatgtggaagtgttgggaggtgtttaaagacacccacataggaggtgctgtacttctcgtagccactgaccaacaaaatatgtaatgattgaaagccttcaataatgtgtttaaataaattttattaatcacaatggtatctaatatgtaatgactgacagccttcaataatgtatttaagtaaattttattaatcacgatggtatctacataccactgaaaaacataaagaaaaatcagttattctccctacagacaatgcttaatgcatctttgggtctgcagatgtcccattgtaagcataaggctcttggggaactcaggtttggaaacgcctctctggcctacttttgcttattcatttgttcattcactcatttacaagtatttattaagtgcctatgacatgtcaggcacagttcttagtgctggagatgtatcgtgaatacatgtgaatccactaaatcttactttctagtgaggtataagatagtctctgtatgtgtgtgtgtatatacacacaatgacagtggtaagtgctataaagacaaataaggcaggatgaggtgacagagagagatggggtgaaggtgttacctctctgataaagtgacatttagaggcctgaatggaggaagccatgcagacaccagagtgcagatggcctattaatggacagcagagtgtgggtgctgaaattgtgtttaaaaggaaggctttgataggatgctgggaacattgagaatgacttgtctttccaacatttttttctgtgtatattctctgtgaaatgcacatggtaggctctgaggaatcagttaaacagtcatggttcttattacacaggagtctcactttgggctgggggtgggcagaggaaggaagttacttagatgtctgtgtgtatcatgtatatgtatacatgcatattggatttagaaatataaatattattcattaataaataatgtttattaacatttatttagaaataaatgtttcctctacaaaaacaggtaagtggtatcagtgtcaggacatgagatcatgaggctagtcagtgctgtccaattgtcttgggattatttcaatataaagaaatgaatggaaagagagtaagacattaccaactataaatcatttaaaggcttttcatgctgtcatatacctatttttttttaaaaaaatgcttacatgatacataaagataagaaagattattttttaaaataccagtgatataagagcagtttgatggtctgtgctttgacacaaggggaacatgattacagacaggcctatttatccagtctcctgtgagacagaagggaccatttattacattactatatatcagcacaagattatggtggtgactatgaatacatgctcacatcagaatgaatcataataaatgttaatgatgtcacttgttttcggtgggagcaaaaagacattgctcaatgaaaaagacccacgtctactgacttttgaaaagaaacatactgttacgtggaagggaattatcacctgggcacattgtggctacccaaatgtccatccactgaagggagactggataaaaaatatccaatatttctagaaattttagaaatagtaaaaaaataaaagcctagtttcaggacacatgcaattcagtgtgctgacaaaaaacctttttggtagcagcaaattattataaattgttttatatcggtgctttaagtgatatacatgaagaagcattagaaatttcaaaatgagttgtgtatacatacacaaaaatagacaggcaagaacaatggtgctgtacaatctgataaaagacatacataaaaaccccacagctaacatcagtcttagtggtgaaagtctaaaacaatttctccataagatcagggataaagcaaagatatctactcccactgcacctatttcaccattaataccagctgaaataaggaaagaaaacaaaaggcatacagattggaagtgctgaaataaactgccagtattcacagacaataatacaattgtttacatagaaaataccaaagaatctacagaaaacttactggaactagagagtttagtaaggttataggctataaaatcaacaccagaaaaaaataaactttatttctatatctagcagtgaacaagaagaaaaaattaagaaattaaaatggcataaaaacataatattaattaggggactcttaaaatatgtgtaagacctgtacaatgaaaactacaaaacactacagaggaaaaattttaaatattaatatataagtggagagagatactgtgttaagggatcagaagacaatattgtaaagatatttttccatagacttatctatagagtcggtgtaattcttttctaaatcctaccaggcttttctgtagaaagtgataaactgattccaaataaaaactcaaaggaccttgaacagccaaacacacacacacacacacacacgcacacacacacacacacacacacacacacacatgcacagaaaaagaacaaagttgggaggaggcacactacctaattttaaagctaaagtaatcaagtcagtatggtattggcacagatagaaatgcagatcagtgaaacagatgagagagtccaaatagacctacacgtttttggagtatttattttcagcataggtgccaagataactcaatagggaaaggacagtcttcaatatatgatgctggaacaattggacatccatatgcaaaaaagtgaacctcgattcttaccccataccatgtacaaatattaactgaaaatgaatcacagacccaaacacaagtaaccataaaaattctagaagaaataggacaaaatttttgtgcccttataagcaaagctttcttagctaacatacttatctgtaaaaaaaagatcgataaatcagactatgtcaaaattaccaactcaagagaaatgaaaacatgtccatgttttataggtgaacatttatatatttttatgtaaactttattcctaattgctcaaaactggaaatatcccaaatgtccactacaaagaaaccaaatgcggtacacccatagaagggaacactcttcagcaataaaaaaggaatgtattattgatatatgcaataacacagatgaacttcaaatgcattatgctaaatgaaaagaagtcagactcaaaggggtacatatatacaatttgcatttgtatgacatattacaaatgggaaaattatagggtcagaaaacacatcagtgattgacagagctatggatggtaggggtagaggactgactataatgagatgtcaggacatcttttttgcagcaatggaaatgctctaatattttaattgtgatggtggttttatggctatatacatttgtcaaaatcatcaaactatatattttaaaagaatgaattttattgtatgcaaattataactcagtaaaataaaacaacaaaaccccccccacaataatgcttttgttggagatggtcaggatttgtacatcacaggcaggatgtacttgtttggacttgaacagtactagaaatgaaacacagcacttagtaagtttccaagttgttagttttctacatggcagcacactacatgttcattagaaagtcccagttgaatagaaaaattatatgactagagttccttaagaccaaggtaaactgtgtatataattatacaataaattccattcattttggcaaacatttattgaatgcttactagtaccagacactggggtagaaactgagtgggagaaaaacagatacgtgaggcataaaacagggtctcctgggactcacaggagtacatctaagccatccattcataagctatcattgtgaagtgatataccaatcactagacagctctgaaatggcatttctctatggagggcttgaattctaattctgaagaactgctccttgataaaggtatatgaagtagcaggctttcaaaaactgttttggtactggtatggaagaggggcaaagaagtgctgggaagagaagggtgggtccctggtgagggctccaccctagggcctgtacccacagacctaggtgaggacaggcacttctgcccaaatgttgcatttcccaagaccaccctggtccaccacgccccgatcctgtgcctataaaaacctgagaccctagtgggcacacacacaagcggctggacatcaagaggaacacactggcagaagaagacacaagaggctggatgtcaagaggacgttgaggggagctcgctggcatgagcccaggccactgagcaacccgacaccaggggaaaatatctcccttctggctcccctatctgctgagagctacttccactcaataaaaccttgtgctcattctccaagcccatgtgtgatctgatttttccggtacaccaaggcaagaaccctgggatacagaaagccctctgtccttgcgataaggcaggggtctaattgagctgactaacacaagctgcctatggacggctaaactaaaagagcaccctgtaacacacgcccactggggcttcagctgtaaacgttcacccctagacactgccatggggtcagagcccacagcctgcccgtctttatgctcccctagaggtatgggcagtggggcactgaacaagcgagccacacccccactgcatgccctgtgagggggagaagggaatttttcccatttcagtaccatccctgatcctttgtccttttcatcactttgccttccaactttgcactcactctgctctgtaactttaggcttgtcaatcatgaacttttcctcaacttaatgcaaaaggctagttaaggataccaacagttcgatttactaatctcttcaagagttacacttacgcatatttcaacaagctaaccacacagatagtgacaagaggctcaaaggtagttcagacaccagacaaccttacagttgaagggaggaacctcagagcccttcaataaagcatgtgcaccagactacagaagaaacaagggaggttttagaagggaaggagtgggaaaaaggaggtaagaccaggatagatgtctatattgcaggaaactgagaagggtctttggagagaacaggggagggctgagctttctgaacatttttgtctttcccaattgaatttttttttttttctttttgagacagagtctccctctgtcgctcaggctggagtgcagtggcgcaatactggctcactgcaacctccgcctcctgggttcaagcaattctcctgcctcagctttctgagtagctgggattacaggcatctgccaccacatctggctcatttttgtatttttggtagagacggggtttctctgctggacaggctggtctcaaactcttgacctcaggtgatctctccgccttagcctcccaaagtgctgggattacaggcgtgaggcactgtacccagccccagttgaaaagttttttgaagactaaaacaatttccacatcagggatggagtttttaaggcttaccgtttgactttcttggctttttctgtgtttaaactggaaaacacataaatgtgatttttctgttttcagtaattgatattaaggatgagattgaatccttgggcacaaatcaggacaatgctctgagaactggacccttagcatcacaatgaaagactaatattttttttcttgtattttagtttgggactgtgctagctactatatacttttccaattgctgatacagttattttgttaggcatagaaatgacctgagactacaagtctggtcacaatcaaagtgtctacacatttcatggaatcagccatgattggttataacaacacagattagctgttacttaaatatttactacagggaacaagaattgtgaaaacagcacttacacttgtgtttacgtatacctatcgccacttgactcattctatagctatcatattactggttgaatactaatttttaaatggaaacttaaacagttatgggaagattttttttttttttttgagacagagtcttgctctgtcacccaggctggagtgcagtggcacaatcttggctcactacaacctccgcctcccgggttcaagtgattctcctgcctcagccttctgagtagctgggactacaggcatgtgccaccatgcccagctaatttttgtatttttagtagagatggggtttcgctatgttggccaggctggtctcgaactcctgacctcgggtgatccacctgccttggcctcccaaagtgctgggattacaggcgtgagccaccacacccagcctatgggaagattttttaaatgctctgtcttttcttctcctgctcttgtcactggtgagatgtcaacctaagctactatagactattgttggagatgtatggattccactaattttctttaccattcattacagaaatattttcttctagtgttgacagttatctctgtgtcttttttttttttttttttttttttttgagatggagtctggctctgttatccaggctggagtgcagtggcatgatcttgactcactgcaacctctgtcttgtggttcaagtgattctcctgcctcagcctcctgagtagctggaattacaggtgtgtgccaccacactcagctaatttttttttgtatttttagtagagacggggtttcaccatgttggccaggctggtctcgaactcctatcctcaagtgatccacctgtctcagcctcccaaagtgctaggattacaggagtgagccactgtacccagcctgtgtcttcataactagacttctggaggtcttttattgatttctctagcacggtgacttttctcaacactggctggttgtacattagagccacttggggaacttttaaatatcctgagacccactggcaccaattaatttctggtgacaggccccaggcatcaattccaaagttcagccagggcagagaaccactaggctagggagaaaaatcaaaaccttatttgtcaggttcattcctagttttaaatctctgttgtctttattcttgtgataagaacagtattagagtaatagtctgtgtacatttgttgtgtggatctctgcaactgtccttttctaatgaaggttttcctgtgagctgacttacaattataagagagtcttttctattacagaccaatagatattatagagataggcaaggtacttctacaagcattctctcatgtgaacctaactgtaattctggaaagcaggggggattactatgcccattttagatgagaaactgtggctcaaaaaggttaaatgatttttctaaatttcgtggttcaatgacagactcaggactcgaaacaatgacatctaacatttaacctactacacttcctactacttcattccccccaaccttcctttgaaggaaatcagaagtgaataagagacgactttctttttaaaggcattttagtctaaataaacaactgataaaaacactaccttataactttaatttcaactccaatgtgacattataggctaagtcatagctgaagcactgggtaccatacatgggagcagtttaacgtaatttcatgaagtgcctagaatataacatatggccaacaaatatttgttgaataaatttacaaacttccacttgtttcttgccatgtatatgacttttctatagggcatagctgtagatataagcactacaaatgaatacttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtattttttagtagagacggggtttcaccattttagccgggatggtctcgatctcctgacctcgtgatccgcccgcctcggcctcccaaagtgctgggattacaggcgtgagccaccgcgcccggccatgaatactaatttttattctagtttgatctgcctataatcatgaggatctggagaaagggtcagaaaaagtaactaagcatttaggctgaattagtcttgcaggaagacaaggacagactgatggacaaaaagagacacagacatagtcctctattcttctgtctggaacaataatctcaggaaataactaaatatgtgcaggagaaaatattaaccaaaaacagcttacaagacctacacattgaattaaaatcactgggcaggaaaaataaaggatagctattccagcagatcaaccagatgtatggcctgagtacaactgtagaggcaatatatttatacatttataaaagcgaattcatactgttggcaatgtatttagctggggagaagacagttactatgtatttgtaataatgcccccaggacacctggcctgaggaccaccactggctgacatttggagcaatgcatagataccacttcctcttcagacattcaagtctgaggagttgcagagtggatatgaggccaagaactggtcagagatgatgactaaaatctgtgaaacaaaatgctagttaatggtagaataacttccaagaaaaagaatcaacaattttaaaatgctactaatgtaagaatgcactaatgatcagattaaattttaaccaataaatgatttaaggaggcctaagggacaatctccttattgaaaaataaaaacttaaataaaataaacagaaaattgtttgaatcacagttcccctccacttccccctaaccttttttttcctgcttcctttcagtttctttagtctctcagaaattccctggtggggctttaaagggacacactcttcttgacatatattaggcaggtcaaatccagatgtatgttttttgaattaagatggcttatttaaagcaataagaagctgccacagaatagccaaaattatagatattagagatggaaaagacttattagatcatcaagtctgtccctcagggccagtgcaggagaagcaatcaaaataaaatgatccactcactccaactgttctctgtggttagcaagacaaaaacattctcaaatagaaaggagtcttggaagtttatgactgaaatactgaactttcttttttcaattattttgttcattgtcagtcagaatccagggaagctgggcttattttgcttttggttttatatacatctatctatctatctatctatctatctatctatctatctatctatctataaatgtaccttgtatgtacaaacatatatagatgctatgaagccaccatttatagctttcagttttctcagttatagtcatattagcattcataataagctactggtttatctagcggtttctgataaagcttctggtttgttcaagatttgctagtaggaacccacccatagaccaagttctctcttttttgggagctcaaggtctaatgacatggctgtgacctctgacagatggtgtacgtgatggacactgaatttaattcatgtgatggaattctggaaataagcatcaaggacttggggatttttctatgtgtagagaccacaggaagggatcagcctttagccctcctcataggaatggtttcaataaatttgaatacctttccatggccctttatattttttgaaatatttacatataaagatgtacttaaatacaagagcagaataaaataacaccaatatctaaggaataaaaagagttttctaaactggctaggatgagcagaaagtggggatgtaagaaattctccttcattggtaaacaggcagtcttggagagacactgatgtgactcacgcttgtgttcatattcaccacaattatggttggcagaacagacagacttattaggcaattagaaggaaataaatccaacttcagattgatctaccaaaatactcagtctctaagacttgtgctagatatagtggaactagtgatgagaaaaagtgtgatttctttattgaagagccatcattgagttatcctaggtctccttggagaaacttgtcaaaatgatccccggttagccttttgaatttccataccaatggagacatattgttgccttctagttccttaaaacaaaaatgtgataggataatttttaaaaaggattccatatggctatgaacttattaaaaatacataaatatctaggttatgaaatactagagtgccttttaaaattgattcagttgatgaaatctggtgtctggagtgatttctataaaaagctgctcattgagcccctgatcaagattataaactcctactgaacactgtttctatgggaaaatcgaaaactgacttacatcattttgacttgtcaggccttttccaggaacttagtctgccaaagagacaaagattgactccttatttaaataagaggggccccattggcgtttcctacaaatttgggtgccaaatgaaatggaaaatccatcatcctcacacattagaggaccaattcgtggtaataataccatatcttctattttccagccttggggaaactcaaaaacttttgcttttaattttcactgtattctagtgaggagggaagaggctgagaatcaattatttaaagtatttaagccagaattaggcaaatgggcacctgaggaaaagtaattataggtggcactagtcaccttttccagtttgctttctttacctttcaactaattccactctactattttttccctaattttgcattatgcttggctgaggcatgctcagaccttgctcagcttcatttactacactgaaagccatattatagagctgtgaacatataatatggcacctacatcaaaaaaggctttggaggtcaagtttcagcagggctctatttttacatttttacttaacctcttctggttctaaggctattgaaggacttcatcctttgaaaaattaagtggagaaggaacaacctcttctcccaagctttctgttactttccttaccctcttcccaacctcccacaagagaaatagtattcatgaacattagaagaaaatgaaaacatcttaaaaatttatgctatttactcattcttctaatttggagaacatactattttcatagaagaacagctatggtaaattctctatatttttaacctttaagtgttttattaaacaaaaactcctatcagcatacaaaaggtcttgctctcccacaaaacaagtaatttgtataaaaaatgctacttcttccatagttgtcgctgttctgtgagctgaccttagggcaagtgcagagaaaaggtgtacgtacagtattagctaactatgcagcaatttgttttgcactttgtcttgcaggaggttccagtctaccacctggttcaaaacaattctaaacagagttttacatctatatctttaacatttttaaataatgtcctagtggctgtagaaagtatgttacctaacgactgccttgctctctagagattaaagagaaataagcttttgttttttaattataataacaaagtctaacatactgtgtttactctgtgcttgggactattctaagcatttaacatgtattaacttatttagtccttataacaatgctattagacaggtgctttcagtaaggttatataacttgcccaaagtcacacagttgctaagtggagagtcatgatgtgaacctaggcagttgctccacaacccatgttctcaacttctacgttgtactggcctttgaatcactgataacctcgagaagctctaaaatcatcataggaaacatgcattcaataaatgcaagtggtgcatgaggtggcttatgcctataatcctagcactttgggaggtcaatgcagaaggattgcttgagcccagaagttccagaccagtctgggcaacatagtgggaaaccaactctatcaaaaataaaaaaataaaaattaaataagtacatgtgtacaggaggaaacaatgcttccttttactctttccaggttctctggtctaagaattaaatcagtgtaagacagattaacaggagaaaaaaacttaattacatacatatgcatgagtgttttacaaaaatgaggctcaaggagatgggcagataattgagacttacatacctgagctataaacaggagtagtggtttaggggcttctggtggggggagtgggaggcaaattatgggaaggtgaggggaaaaatgtgtagcaaataaagtttgctttattatgctggtaagagtgataagaactactgagagtagttctcttcctgataaaaatactttactagtggaaatttcatttacaaaagtaaatttatactttattctagatagttgagggggaggtaaagagcttttcctgcatcagctggttctcaattgcctttagctaaaaaaaaaaaaaagtcaaagtggtatattttgaaccccttcacttataataaatatacgcagagagctcttggagtctgcactggagacagaagaataaacaagacacaaatatcactgccatgacattcagtcatttaaacagatgaaaagttaatccatgcttggggcctgaaaatgcacatagaacaaattataaaatttattcccccaaacaggggaataaaaatgaatgcaggaatgattttttttgtcttgttaacaggcaagaaaaaaataggctgaaatcagctttcccaaaacaaaatgcactgtaccatcatccttctatggactcttttaataacaccctaactggtctccttgcttctcttctggtctgtaggacactctcttcatagcagcctgagtgatcctttaccacctattttgaaaagaagctgtcaatcagtataaactaatactgaacagtagatactaggagtcattctgctcttctgttgaacttggttctggagcgggagagcttagtggcatcaatgttactgaacagcttctctctgctgaggttccttctcctttttcccattctatatgccctcaatcccttgcagccagaattctcctctcttttctttacgcttcttgcagatccagctccattcagcttctgcactcagtgagtacgcccttatgaaccatctctgcttatgaccacaaacacattaaagtaaaaatgccagcatttaaatgtatctaaaatgtgattttaaaatattattcatatgaaagataagaagaaatttatttccatctggataattcttttaaactaaagactttcttacagaatctggaaagatgacagctatcttcaaatacctgaaggactatcttatgtgacaggattcattatattacttaagttcaagaaacctccagagataaaacatagaatttccttatctaaaagataagcacaaagaggaagcacaaaatgtgtccttgatgttttcaccttagaatgaaaacaatcatagagttcatttttcaccactcagttgtgcaacttgcaattcttgggttatcaaagaacagtcagattatattaagaaactcatgttttctgatctcaaagctttttctatcacatggaattgcacacaaacatcttgcactttctagagagggtcatataataccacacacttaactttgcccctcttctcccaaactgctttgctgtggatcagggaggtgctgacgggcttgagtcccatctcttgggctggccagttttgactggcagatgcttctactgaagcagcagtttttcatctccccagctttatggcccacactgtaacagataaggggtagcagacatcctggctctagtgtgctcagaaacgaatacaaactaatgcaaaacagaatcagaaggcacagtttttcttatttgctctcctaatgaaactgtcatctttattcatagaatggtttcttcatatcttttcactacttctgtgcagccataggtactggtctgaaatgtgccgtatttgattcttggtcaattccagtttcttcaaatattgcagggaatcaagaattaatatacagcaaagactacacaaagatggtgtgtagacgataatgcagatagacaacagatacatccatacatcttacacaaaaccattatatatgcgctcacattctttttctgtttcggttctaggacagcctttaggtcccaccccaccaccctgacaatcagagacacttttgactacttcagaggcagtcaagcatttacactaccattattctcgtttagtaacaatactgaaaagcttcatactgtctgccattatgcctcctcaagctgtcttttaatagtttcaatgaaagctgtgcaaggaaataatattctacaatctccagtctccagggaagaatatgactgttcccagaggagagtaagcctttgctgaatctgctactttatgagtaaaacaggaagttcggtcctcttttattgtacctttttcatttttgaaaagctgcccaaatggttccaaatatagttgaagcacttattaatgtcaagaagccaagatatttctccatggtttgctgaataagaaaggaagaaaaccgcttgtactcagttgtcctttgcttcccttgccaaagaagcaggaaggagagtgaatgaataagtgaaaagggatggtgtttatctttcaacaaaatcataatgttctgcactcagctcctgcagtcaaatgtggccactgcatctttaagacagctagtctcttccctcagagacgacacactaattatagtgcttctgccagagggaactcacacatgtaaaccattatgtaaaatataatttctttttctttaggaatactcaagatcattagacatggtttcttcaatgctagaaaatcaggccaaaaatgaaaataaacagtttcaagtatttgcaacataattccctcatgcatttatggaaatacagtaaaagtgccctaaaatgtggtttgacatttcatgctgcactggttttttctatttttccaattctctaacatttgccctcttatcctatatcatttcagtttcactatatttcaaatactcacatagcaatagccacagctattaccaaatagttgggctttgagggagctagtgaacaacaggaagcagcccagaagcttgttgtaaattaaacaaacgccttataaattaaacatggtaacacatgaacacaaacgtagggcacggcaacatgacataacttttaaaaacagcaattaaatgtatagcattgctttccctaatgatgtgctatgctaatttaaggcaaaggtaatgattccgttgatttaacagtttgacatggaactcataaatgagaataaaatctgtaataaatcatggggacttcggtattcacgagtatagaattaggtatgttattatatgggggaaagatatacatttcaattcaatcaattttctatatcataaactaacccaaaacataggctcaacagtaagcagtcttttgagactcaaagaaataatccctttattaaaaattcagattttcaatagtatattaattggtaaattttcttttttattgttactgtctgcattttgcttcttccacattgtttacctttttaatctttttatccagatgttctgaaaatacaaaataaataaagcatcacttataatacccttataaaacacaaagcgccataatggacacataagttttatcttagtaaaaggacaaaagcggaagagaaacacattctcttaagctcgtatgggtttgtgaaagaaagggatgttctactggggagagcagtctcattgggagagatctgactgctacaatcgtttgctttaactggtttactttgctctattaaaaaaaatccatatcaattggattgatttttaatgtctatgtttagctcaatgttaactggctttgtttttgaaaaatgcactctttggttattcagataaataagtaatccagctcttctacaatgattttactattgctattattatgtagcattattaacagattttctttaaaagttcttttctattctggaggcccagtttttactttttagtcgatttttcttacctaggattacataaaaatacctttagagaatagccacttctgtacaggacaaaaacattacagctggaatcctttggtaagcaactctcgaactattcaaataggcaactagcaataagctcttgatcacattggtaaaaatcatatacatttttgccatggtgtcaacagatgaaacctgttgatatatggggtaataagtgcaaaacaggagggaagtaaagacttgttctcagaacacataatgctctctctccctccagcctctatactttatattcatgctgatgagtctgttcttcctggttactttttcttggctaacgttattagtcctttagatttcagcttagctgacattccctgcaggaagccttccctgatcattaagacaaaatcaggcctcgcccaagtgcactaagtccacagcacctgctagccctacagtagcacttatactacattactactacactacactacattataattgaaccttgagggtagggaatatagcctattcagaaatgtggccccagtaccaggcagcttgccaaatagtcagaagccaataaatattcattgaacaaacaaattagtaacatgctgataatgatgacaatgttactaatgactaaatttactgagtgcttgttacatgtcaagtgctattctaggccttttacatttaatcttcacaaccctacaaggaaggtgcatttgtgccattaccacctccattttacggatgaagaagctgagacacagagaaccttctgtattttgttgcattgctttgttttggtagtggcttgtcaatttagatgaattcagattatatgctcggagcaaaggtgaagtgaagagtaactgctaattgataacagatcaaaataattactaagttgaaccatataaaactgttggcattcaattgggtttgacctacataaatggcaatttcatctttatccctgtgctttatctctaaatctacccacaactgggtagcatgcacctacatattgccatgctagagtgacacgcacctggagaaggacctgagaaggtatttatgcacataattatttttaactgtgtcaacagagctttgttcctatggctgtctaggacttaatgatatttttgggatatatttgctataatacattttgcctgtgtagacaaagtcaagggactcaaaagaggtaaaatcagtaatgatggtttttccatagttctaactcatccaggatgacaaaaagccaaagataaaagaaaaaaagaatctggaattgaaaatgatttaaatttgccagttcccagcacttctggaatactgccagggttaatttggattgggcctttcagagtttgcattactttaacttgatgtaacctaaaaaatagacttgatataaagaggtaaaaagagtccatctaactcaacacaactgacagtctgttctcaagttgcctagccctgaaccagaatgttttatttgtttcactccagaagagggtgatactgtgtctcttagtgaaaggtatttgtgatgaaaataacttatagactaatccaaagctatgtaaggcaaatgctcacagaaggaaacagaacttgttttttaaggtggaaacatttttagagcttgctggagattttcatttcaaaatctccaaattcaacaattcttcagcctctgtaaactttcaaatggaaagctccaatatttagagtaaataatgtctaagcttccccttcatagcaagttttctttttctctcctgtcataagagtgttatatcctggcaagtgaaatacagaacccctttgtagtaaagctatcatactataccactcagaatgtggtgctaatgaggttattgcttaatagaaccatagaaggacattgaaaaaagaaaataccctgacaaatgtgttgaccaaaggataccaacaactctcctagggtcctgtccgaaattcaaggatttaaaaaagtaaaaatgaactttagtgtatgtgaaaaatcataacattgaaacataagtccatttatcttttaactatttttctagttctcttccaaaattttgctggttattaaaacactgctgtgtaaataaaaatgttctgctttataacttaaccccatttcttgtccttacaatataataatgtcattgtttgttatatcacacttattctcaaagtaatagggcttgatttaaaggactttaaatagcacattgaggaagggcttctgcagaaaaatgagattggggaatcaaacacagaatggggaattcagaaatggactatgaaggacttctattattctgagagtcctaaaagagtttatataccatgactcccactgagataagcacagctcttcataaacactcttaataaacatctgctaagtgggctgtcccaaggctgaactgtccactgataaggtcgtggggaatttattactagaatttcagtgaagccattcaaattcccagactgtgaatatagttgcaaataaatgaactcatttcattaatacatatcctctgccctgatgagtaaatgcccacttttgcgtctcttcagagatattcacaatcaactgcttcatgtacccagctatccttagtcattcagaccaccaaaaatgagagcttgcagcagtctataacatcaccactctcacagataaaacacaacataccctataattagaatcacagactgtaggagctcgaatgggccttagaagtaatttagttcaaccttctcattgtacagttgagcttgagtgacttttccaaatgttattcaaccagttaatggccggactgggagtagaaccaggtctcccgactcttattcaactgcttttgccattataacaggattcagccatgacatactatttaagcaaggtcagtaaacagacactactaggacttaatggcaagtgatttcattaacaacaagaggctgtaacaaaaaactccctgtatctaattcctaaaaaattcaagttgagggatggtaacttggtattctagccactaacataaaaaagcaaagaaactatatggactagaaaccaattctaaaagaatctttttaaaaaaagtctgcattaataagattaataaggatatactcaatgtagaacatttattctacttgggtgatatatatttttttaatctcacctattgcacctgcataagagtgaggaatttctgtattaaacagtaaaagttttcttttgccaatgatgtacattatactgcagaaaagaactagattgagaatcaagagtcctgggttctgctattaattcactgagatactctaattttctcattttctcagtcatagctttcttttgttttgttttgtttttttattttttggatacagggtgtcactctgtgattcaggctggagtgtagtagcacgatcacagctcactgcagcctcaacttcctggtgatcctcctgcctcagcctcctgagtagctaggactacaggcaagcaccaccacacctggctagttgttttatttttgtagagatggggtcttcctatgttgcccaggctaatctcaaactcctgggctcaagtgatcctctcacctcagcttcccaaagggattaaaggcatgggccatgatgctcagccacagttttcttttcttttctttttgtttttttttgagaaggagtctcactctgtcgctcaggatggagtacagtggcacaatcttgtctcactacaacctccgcctcctggattcaagcgattctcccgcctcagcttcctgagtagctaggattacaggtgtctgccatcacgcccagctaatttttgtatttttagtagaaacagggtttcaccatgttggtcaggctggtcttcaactcccgacctcaggtgattcacctgcttcagcctcccaaagtgctgggattacagatgtgagccaccaccatgcctggccccagccacagttttctaatataaaaattgaaagggttgatttttaacagtgtgctaagaagggccctggaagtttcccagagttgtcctaggagctgacaagaggggctagggaagaataaggaagataccaagcttggaagttctgtgttttccaccccaacctcaactgggcagttctgctttgatctgattttaatattaagctaaaatgtaagatcttgtttgaagaacaagttatgtggctgaagtttcaaagccactgaaaagttgacagtacctataatacaccttctgactctgatgttcgcttaaaagccctgcaaggacactaccttaaggattaaacccaagctcctaaatacagcattctccatgcctcagcccccgcctctccttttcttctcatctccagccatttctcaccatgtacttcatgctttaagcatttcaaaatgttggtaataacctgacaatgcagtgctgtttcacacctccttggaactcacttttgctcatgctccttctgcaatttgcccccttctctgcttggcttaactcttcttactcttcaaaattcagctcaggcaatcctttctccacaaagcctttttggaaccccaaaaccaggtgaagtgccctctacttgctcttactacagcctgtgaaggattcgcacattacaccttataaagaaatgatacagggccaggcgcagtgacacacacctgtaattccagcattttcggaggccgaggtgagcggatcacctgtggtcaggagtttgagaccagcctggccaacatggtgaaatcccgcctctactaaaaatacaaaaattagccgggcgtggtggcaggcacctgtaaccccagctacttgggaggctgaggcagggagaattgcttgaacaaggcgggtggaggttgcagcgagccaagattgcgccactgcactccagcctgggcaacagaatgaaactctgtatcaaaaaaaaaaaaaattaatattaaaataaaaaaagaaatgatagaattctatagtttctctttcatttgggctataattgtctcatgggcaaggcccttctcttttgtatttgttaaaatattagtgtctaaaagttcaataaagacgtattgaaggaggacattaaaaaattttaaaaacaccttgaacctgatcaaacaatttaatttcaaaaactaaaaaatcccctgatggtgtacagcttctctctttgacggcatattctcttaagcaaacattttagttaagaaaggagtctccacaaggtttgcctgcagctgacatctgcttgttaggaagcaagagagcaacactccacctaaaaactgttataaaaactcccctcaaagaacaaacctaaaaattactaattaaaaacaaaataaaataacaaagttcaccaaagaaagggctagtatatttgcagaatgtatgtatatctactctatctttaatccagtcatgcactgattacttaccagtcactcttctaggtgtgggaatgcacctgtgagccaaacaggtaaagtccatgctctcacacaaaatattacagtggaagaaatatgcaataaacacacacacacagtatttgtgggtgacacatgctatgggatgaaaaggggtaatgtgctatggggaaaagatatcctgggaaaaagcaacggtgagttctagagaggaggtggtgttcctatttcatgtaaggggtcaggaggtcctgttcgtgaaggtatcattagatcagggagctctatagtaaatgacagaataagccatgtagtataatatatgaccaaaaagcactctaggtagagagaagtgaaagtggaaagacgttggggtaggaacattaagtggagtctttgaggaacaggatagaggtcagggtggctgcagcagaatgagcaagagggcaggtattaagagatgaattaagaggttgtcgggggccagatcatgtggggctgtattttcatgctgctgataaagacatactcaagactgcataatttacaaagaaaaagagatttaatggactcacagttccacgtggctagggagacctcaaaatcatggtggaaggcaagagtcacgtctcacatcgcagcaggcaagagagagaataagagtcaagtggaacaggtttccctttatcaaacatcagatctcgtgacacttattcactaccatgagaacagtatgggagaaactgcccccatgattcaattatctcccaccgagtccctcccacaatatgtgggaattatgggagtacaattcaagatgagatttgggtggggacacagaatgaaagcatatcattctgctcctgccccctgccaaatctcatattctcacatttcaaaatcaatcatgcctttccaacagtcccccaaagtcttaactcatttcagcattaactcaaagtccatagtcccaagtcttatctgagacaaggcaagtctcttccgcctatgagcctgtaaaatcaaaagcaagttagttaattcctagatataatgaaggtacaggcattgggtaaatacagccattccaaatggtagaaactggctaaaacaaaggggctactggccccatggtgcaagctgtcagtggatctaccattctggagtctggaggatggtgaccctcttctcacagctccactaggtgatgccccagtagggactctgtgtggggactccaatcccatatttcccttctgcactgccctaggagaggttctccatgagagccccacccctgcagcaaacttttgcctggacatccaggtatttccctacatcctctcaaatctaagcagaggttcccaaaccccaattcttgacttctgtgcactggcaggctcaacaccacgtggcagctgccaaggcttgaggctttcatcctctgaagccatgtcctgagctctgtgttggcccctttcagccatggctggagtgactgggacacagggcaccaagtccctaggctgcacacagcgtggggaccctgggcccagcccacaaaaaaaacactcttttctcctaggcctccgggccatgatgggaagggctgccatgaagacctctgacatgccctggagacattttccccattgtcttggggcttaacatttggctctgtgttacttataaaaatttctaaagctggcttgaatttctcctcatataatgggatcttcttttatatcgcattgtcaggctgcaaacttttatgtctgcttcccttataaaccgaatgcctttaacacaccaagtcacttcttgaatactttgcaggttagaaatttcttctgccagataccttaaatcatctctctcaagttgaaagttccacaagtctctagggcaggggcaaaatgctgccagtctctttgctaaaacctaacaagtgtcacctttgctccagttcccaacaagttcctcatctccatctgagaccacctcagcgtggatttcactgtccactccatatcattatcaccattttggtcaaagccattcagcaagtctctagagagttccaaactttcctacattttcctgtcttcttctgagccctccaaactgttccaacttctgtctgttattcaggttccaaagtcacttccacattttcaggtatcttttcagcagcaccccactcctggtacccatttactgtattacttcatttttatgctgctgataaagacatacccaagactgggtaatttacaaagaaaaagagatttaatggactcacagttccacgtggctggggaggcctcacaagcatggcaaaaggtgaaaggcatgtcttacattgcagcaggcaagagagagaatgagcaccaaatgaaacaggttttcccttatcaaaccattagaacttatgaaacatattcactatcacaagaacagtatgggagaaaccaccatgattcaattatctcccactgggtctctcctacaatatgtgggaattatgggagtaaaattcaagataagatttgagtggggaaacagagccaaaccataccaggagccttagaggcagggacttgaggtacatcacatatattaagtagaatgttctccaatcttctaaagagttctgctgtaaaagggcagtaacaataatagtcatctgcactgccaaggagaggactcaagatgggggagacctgagtctgctaaaatacagacaggaagcagaaagccaagtgggagaacttgcagtgagggaggggagtttaagagctctgcttgacaaactaatcagtactttctcctcagaaacaggtctaagagagataacaggaattaaattacagaaatgttgaggtgaggaagaaaataatttagaaagcctacatcgactttttttttttttttttttttaagcaaagtagattgcctgtctaagagtcacaggggcaaactgggggcttgaaaagagtgaataacttttgtatgattcctatgggataaatgaatcctccaaattcattacttctctactccatgacttgagggggaggtggcacatgaattatgttttattgtttaactggggaaaaagaaagaaaatactaaaaatgacaaaagcaaacccggcttagcagtgcacgcctgtagtcccacttacttgggaagttcaggtaggaggatcacttgaggctaggaatttgaggacagcctaggtaatatgttgagatccatctcttaggtaatatatatatatattgagatccatctcttaggtaatatatatatattgagatccatctcttaggaaaataaaaaaaaaaacataaagctttacaactgtcttctatacaagcaactccttctagtgcccaactccttttaggctttactgtgtgtcaaattaggtttggtctttttctgcagcagctggtgtgacaactccttttctggtctaggggcagcagttaaagacctgaaatcattgcctcagcttatatcctagagaaagctctgactattcatatttattatcccccacagccttcaatggctacttgagttgaagttctaaattattcttcagctggtaaaacattagcttgcagtaagggaagtctaaggagtgacttaaatcagtgtaaacacaaatcattaccaagggttgcgcttaagtcagaagaatagcacatttagtaaagacatattccatagtaataaagactatcacaattttagatattctcggatattatggaaaggagagtgaaaggaaacatcactgtcctttaactgcacatgtaaaaatactaacaactgaagaaaactatttcttaagtaaatggattaaaaacagccactatgattactgaaatttgggccacgaataattaaatctttaaagaactttttagacagttacttataaaggaagatacactttttttttttttttgaaatggagtctcactctgtcacccaggttgcagtgcagtggtgtgatctcagctcactgcaacctccgcctcctgggctcaagtgattctcctgtctcagtctcctgaggagctgggattacaggcaggcatcatcacagtcagttaattttcatatttttagtagatacatgttggccgggctggtttcgaactcctgacctcaagtgatcctcccgcctcggcctcccaccttttttaataaaattcatgtcacaataaagggctaccaaatattcaatcttcaattcagaatgctttaaatttcatcttctactatagatatgattgattcgctaacatctaaaaaagattcagctagtcagaattgctgtctctttctagcaagttttcacttttttttaagcagtaataagcaattccatccccaatgcggacttagaatcacagcctacatgtgcaagtctataacaaacctgcatgacacacagtagaatctcattggttcacacccttgcaaaaaccacaacccctcaactttcaaaaaagcaaaggcctctttacctaagtgcacattagctgctggcttaggcaggccttatgacatggctgcctccccagtgggcaggcgtaccacagcaaggcactcattaagctattgagtttcattccagtaaccgttcaaatacattcttcattgtaccataaagtatgtttgtttgatgctagaactttgattttcctcctccttctctttttctatcccccatccctaccttctcaaccattttggtatttttttttttttctcccatgctaacacactcacaaaaatccagtaattctcaatggatctcttggtcattagtgcaaattagtgaggttttactgaatatgctcagatttgatttgccaagttcttttcccgttaaagttttaaacccatgtgtatttcaaaggaaatctaatttgtaggtttcggattcatttacactcaactcacaaacgtggttctgtgagtgcccccatagctggtgtacaagaagccacaggagctggtttcccttcctcttaacaagttcttgttagaatgtttgctttgaagtaggtatttggaccatgctggaagcaaacagaataaaaccccaggaaaacgtaaagtaaaatttaaaaaccaagttcatgtttttcttgccccaataattatactttttaaagaaaagtctctaaggatggaaccatccatttcagccttttaaggatgatgtcaccatctacctgcctggatgaggctgtgtctcataatgcttctgtgacaaggtagtcatctgcgagtatatggctttctctgcttaggtcctgtcttgtccattttgtcatgctatggactctgttcagctgctaggcaacccaacgctgctccaccattccctctaagactctgctgctgggagtcttgaaggtgccatttctgcctgtgggggtccccacacctatcaattcctgcctgtcttcccctctttggagctccttagctctgcctgttttcttggacttcatcacagcaactacttcctgtgtttcctgatgtttgtcccaaagacaaacatcaggatagattccttgtcaactcatcttggattcccaatgcttcttggctaaagtcacaactgcagacctcctgctgcagtcacggaataccatggttttgcctctgtgctgacaatttccccaatagctatgctatcccaatgggtggacctactgcctactgctgaccctggcttctctttgtcacttttgattcctctgaataaaagagccaaatgtcactgatgtttctgtttctattacccatttccacagtgtgagaccagtagcaggtaagatgtgaatgctgatgagactctgtgctcacatggatggcatgagctgtgcctcaaaaggcagaacatctctagcagtgccagctcttgtccaaacatcaaaagtaagcagcaattcttaacactgagtataggctgctttgtctttttttttttctttgaagactgcctccttggaaagacaaatagcatatcacaccccaaaggctgtgacaatactgaaaaagcccttctttaccaactgtcttctacaaaaacaactccttgggagttcatttcaagggactcgagaaaaatagccatgcatgctgctaaatgctgggtgactcactgaggcagaggtgaaactctgagcagtgaaccaagggctgagatataaaccactaagaaaacccagtaggttgaaacagacgatattgcaactgttctgaaaatcagcacgtatgtaggtaattactcctaatatgcccagacaacttcaatgtgtgtatctgtgtgtcttatctatgtaaatgcaaaaaaacctaaaccaattctacctacctacctaaatgcaaagaaatataaaccaagtacacccatgaatcagaaagctcttttctaacctgccccgaatcccttgctctaagactccttgaaagcattgtgccacagtccaccggaagatatagcataattatctcataaccactagttaggaagtccctaggaagtaccttctgactgctaagaatagctattcatttattttcactcattcactcacctatcaatctttaacaaggtgtcaaacatgtcaggacaatgtgaggctctctgtattagataagaaagaatttctagggagaatagtggagatgagaaacaatatctcttttcatttccctgcctctaaatttacaaagcaaaagtagaaagcaaattatacaagcaagttgtgtatgaggtacccaaacacctataaccagtcttttgccaattatcagccaattttgctttttttcccccaaagaatttcaacatttctcttcattcatccacttcccaacctggtcctttttagtgatttaactttgatctggcaaataatggctctttcaacaactaacaagttataaacagcttctaccaatggaacagtgcctctttcctcacaaaacagctctttcaattaacatgtatacagagcacagcaagagttaaaatgatgatcaaaaagagtttcatcagcatagtatgcttaagatttgtgtatgtcggccaggcgtggtggttcatgcctgtaatcccagcacttcgtgagtctgaggcaggaggatctcttgaggccaggagctcaagaccagcctgggcaacacggtgaaactccatctctacgaaaaatacaaaaattagccaggtgtgtggtggtgcacacctgtagtcccagctacttgggaggctgaggtgagatgagcacttgagcccaggaggtcgaggctgcagcgagccgggactgtgctactatactccagcctgggtgacagagtgagactctgtctcaaaaaaaaaaaaaaaaagaaagaaaaagaaaaagaagggggaggagccaagatggccgaataggaacagctccagtctacagctcccagcatgagcgacgcagaagacgggtgatttctgcatttccatctgaggtaccgggttcatctcactagggagtgccagagagtgggcgcaggccagtgtgtgcgcgcaccctgcgcgagctgaagcagggcgaggcattccctcacctgggaagcgcaaggggtcagggagttccctttccgagtcaaagaaaggggtgacggatgcacctggaaaatcgggtcactcccacccgaatattgcgcttttcagaccggcttaaaaaacggcgcaccacgagactatatcccacacctggctcagagggtcctatgcccacggaatctcgctgattgctagcacagcagtctgagatcaaactgcaaggcggcaacgaggctgggggaggggcgcccgccattgcccaggcttgcttaggtaaaaaaagcagccgggaagctcgaactgggtggagcccaccacagctcaaggaggcctgcctgcctatgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccaaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagaaaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaaacttcataagtgaaggagaaataaaatactttatagacaagcaaatgctgagagattttgtcaccaccaggcctgccctaaaagagctcctgaaggaagtgctaaacatggaaaggaacaaccggtaccagccactgcaaaatcatgacaaaatgtaaagaccatcgaggctaggaagaaactgcatcaactaacgagcaaaaccaccagctaacatcataatgacaggatcaaattcaaacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacacagattcataaagcaagtcctgagtgacctacaaagagacttagactcccacacattaataatgggagactttaacatcccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaatctgctcctgaatgactactgggtacataacgaaatgaaggcagaaataaagatgttctttgaaaccaacgagaacaaagacaccacataccagaatctctgggacgcattcaaagcagtgtgtagagggaaatttatagcagtaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatggtaaaggggatatcaccaccgatcccacagaaatacaaactaccatcagagaatactacaaacacctctatgcaaataaactagaaaatctagaagaaatggatacattcctcgacacatacactctccgaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatacgcaaatcaataaatgtaatccagcatatcaacagaaccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaaatggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagaggcaaatcacgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatacatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaagtagttcaaccattgtggaagtcagtgtggcgattcctcagggatcttgaactagaaataccatttgacccagccatcccattactgggtatatacccaaatgactataaatcatgctgctataaagacacatgcacacgtatgtttattgcggcattattcacgatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacactggaaggggaatatcatactctgtggactgtggtggggtcgggggaggggggagggatagcattgggagatatacctaatgctagatgatacgttagtgggtgcagcgcaccagcatggcacatgtatacatatgtaactaacctgcacaatgtgcacatgtaccctaaaacttaaagtataatttaaaaaaaaaattaaaaaaaaaattaaacaacatactcttaaataaccaatggatcaaaggagaaacatcaagggaaattagaaaatactttgagatgaatgaaaatgaaaacacaaaagcaaaactgtgcttaaaatacatagttgtaaaagcctacaataaaaataaagatcttcaattgaaaaaaaaaaaaaagaaaaagaaaaaaaaagtgtatgacattgtatgaaaattttatcttaaaagaaaaaaactgaacattagttaataacatgcatccttaaatgctgatgtttgtaacctacttagaaatgcattaaaaagatggggtaggttatacctcaaggaaactggaaaaaggatttgacagttatgtctagtgtatttctataaatttgcttttaaatatcttatcctatgtcaaataatgtagccttctttactccttacaatatgctgagcattttcccaagccattcaacattttacaaaatgttattttaatggctacttaatatcccagtgcatgggctgggcacggtggatcatgcctgtaatcccagcactttgggaggctgaagcaggcagatcacctgaggtcaggagttcaagaccagtctggtcaacatggtgaaaccctgtctctactaaaagcacaaaaaaattagccaggcgtggtggcgcatgcctgtagtcctagctactttggagactgaggcagcagaatcacttgaaccccagaggcagaggttgcagtgagctgcgatagtgccactgcactccagccttggtgacagagtgagactcagtctcaaaaaaaaaaaaaaaaaaatcccagtttgtaacacaaattattcaggtgtgtccttacaggtaagcagattatttccacattttcactaacataagtgtactaccaggaaaacccttaaatgaaaattattcaatcccatttacttcttcagcatggctaaagggtaggaacagtttatgtgtgtgtgtatctatatatctatacatttttaaacagacctaagattgcatttctcatgcaaacctctcctgcatcaaacattatgttcaatttttttttgtcagtgatgtagacattggtttatcattgttttcatagaattccattatcagtgaagtctgccattcatatttttagatgaattgtcggtgtttgttctccagttctgcactgtgatgttggtatttttctccttattgacttccaaaggttctttgaataagcctgatgtgctttccatcctggaacctgatcctgtttgtaaattccttagtatgtctaaaaggaatttaatataaaatgtatgatatgccgtttcttcatttggtgaagcattaaagctattttgacacccaactaaaggagtccttccaggacagaatgctaacatgggccaaacactgaaccctagctgccagcattttgcttttaagtctaacaaatcctaagtaattcatatgctgttgtaaacaattaggtatgatcctaaatagtgataaagtaatatagagcagtgttgtaacaaggttttatttgaaattgttttctaaaatgtgatgcattactgattttgacactgtttgaagcaaagtccatcatcaaatgtgatgcttatgatgagaagatacatgtatttgtaacgtttaatggaacctaaactcttttaaaaacaacgtgccatttgtgggtatgtttctaatctcctatcataaatcgtgagataggcctttttttggagatatttgggcttgcactaaagcctttttttttttaaactaatgagagttttgagaaatagaagatcgtgttgaagttactgtgtatgtgtgtgaatcccttgcttaaaaatatttcatccattggttaggttgtggagaaactggaacacttacgcattgctcgtagtaatataaaatggtatagctgctctcgggtgtggatggcaagatggctgaataggaaccactctggtctacagctcccagtgagattaatgaagaaggcgggtgatttctgcatttccagctgaggtacccagcttatctcattgggactggttagacagtgggtgcagcccacggagggcaagccgaagcagggtggggcgttccctcaccaggaatagcaaggggtcagggaactccctcccttagccaagggaagccgtgagggaccatgctgtgaggaatgatgcattccagcccagataactatgcttttcctagggtcttcgcaaccctcagaccaagagattcccttgggtacctacatcaccagggccctgggtttcaagcacaaaactgggcagctgtttgggcagacaccgagctagctccaggagtttgttttaataccccagtgacacctggaatgccagtgagacagaaccattcactgccctggaaagggggctgaagccagggagccaagtggtctagctcagcaaatcccacccccatggagcccagcaagctaagatccactggcttgaaattcttgctgccagcacagcagtctgaagtcgagctgggacattcgagcttggtggtgggaggggcgtccaccattactgaggcttgagtaggcaatgttcccctcacagtgtaagcaaagctgcctggaactttgaactgggcagagcccactgcagcttggctaagctgctgtggccagtctgcctgtctagattcctcctctctgggcagggcatctctgaaagaaaggcagcagccccagtcaggggcttacagataaagctcccatcttcctgggacagagcatctaggggaaggggtggatgtgggcacagcttcagcagacataaatattcctgcctgctggttctgaagagagcagtggatctcccagcacagcactcgagctctgccaagggacaggctgcctcctcaagtggggccctgacccccatgcctcctgacttggagacaactcccagtaggggctgacagacacctcatacaggagagttctggctggcatctggcgggtgccccactgggatgaagcttccagaggaaggaacaggcagcaatctttgctgttctgcagcctctgctggtgatacccaggcaaacagggtctggagtggacctccagcatactccagcagacctgcagcagaggggcctgactgttagaaggaaaatgaacaaacacaaaggaatagcatcaacatcaacaaaaaggacatccactcaaaagccccatctgaaggtcaccaaaatcaaagaccagaggtaaataaatccacgaagatgagaaaaaagtagagcaaaaaggctgaaaattccaaaaaccagaatgcctcttctccaaaaaatcacaactcctcgccagcaagggaacaaaactggatggagaatgagtttgacgaactgacagaagtaggcttcagaaggtgggtaataacaaacttctccgagctaaaggagcatattccaacccaaagcaagaaagctgagaaccctgaaaaaaggttagaggaattgctgtctagaataaccagtttagagaagaatataaatgacctgatagagctgaaaaacacagcatgagaacttcatgaagcattcacaagtatcagtagccgaatcgatcaagcggaagaaaggatatcagagattgaagatcaacttgaagaaataaagtgtgaagacaacattagagaaaaaagaatgaaaaggagtgaacaaagcctccaagaaatatgggactatgtgaaaagaccaaacctacacttgattggtgtacctgaaagtgacggggagaatggaaccaagttggaaaacactctgcaggatattatccaggagaacttccccagcctagcaaggcaggccaacattcaaattctggaaatacagagaacaccacaaagatattcctttagaagagcaacttcaagacacataatcatcagattcaccaaggttgaaatgaagtaaaaaatattaagggcagccagagagtaagaaagggttaccgacaaagggaagcccatcagactaacagcagatctctctgcagaaaccctacaagccagaagagagtgggggccaatattcaacattcttaaagaaaagaattttcaacccagaatttcatatccagccaaactaagcttcataagtgaaggaaaaataaaatcctttacggacaatcaaatgctgattttgtcaccaccaggcctacgttacaagagctcctgaaggaagcactaaatatggaaaggaacaaccagtaccagccattgcaaaaacataccaaattctaaagaccatcatcaactaatgggcaaaataaccagctggcatcataatgaccagatcaaattcacacataataatattaatgtaaacaggctaaatgccccaattaaaagacacagactggcacattggataagacccattggtgtggtgtattcaggagacccatctcatgtgcaaagacacaaaaaggctcaaaataaagggatggaggaatatttaccaagcaaatggaaagcaaaaaaaagcaggggttgcaatcctagtttgataaaacagactttaactaacaaagatcaaaagagacaaagaaggccattacataatggtaaagggatcaatgcaacaagaagagctaactatcctaaatatatatgcactcaatactggagcacccagattcataaagcaagttcttagagatctacaaagagacttagactcccacacaataatagtgggagactttaacaccccactgtcaatattagacagatcaacaagacagaaaattaacaaggctattcaggacttgaactcagctctggaccaagtggacctaatagatatctacagaactctccaccccaaatcaacagaatatacattcttctcagcaccacattgcacttattctaaaattgatcacattattggaagtcaaacactcctcagcaaatgcaagagaacggaaatcataaacagcctctcagaccacagtgcaatcaaattagaactcaggattaagaaactcactaaaaactgcacagctacatagaaactgaacaacctgctcctgaatgactactgggtaaataataaaattaaggcagaagtaaataagttcttcgaagccaatgagaactaagacatgacgtacaagaatctctgggacacagctaaagcagtgattagagggaaatttatagcactaaaatgcccacaggagaaagtgggaaagatccaaaatcgacaccctaacatcacaactaaaagaactagagaagcaagagcaaacacattcaaaagctagcagaagccaagacataactaagatcagagcagaagtgaaggagacagagacacgaaaaacccttcaaaaaaatcaatgaatccaggagctggttcttttgaaaagattaacaaaatagactgctagcaagactaataaagaataaaagacagaagaatcaaatagacacaataaaaaatgataaaggtgatattaccacggatcccacataaatacaaactaccatcagagaaaactataaacacctctacgcaaataaactagaaaatccagaagaaatggataaattgctggacacatacaccctcccaagactaaactaagaagaagtacaatccctgattatatcaataacaagttctgaaattgaggcagtaattaatagcctaccaaccaaaaagagtccaggaccagatggattcacagccgaattctaccagaggtacaaggaggaattggtaacattccttctgaaactattccaaacaatagaaaaagagggactcctccttaaatcattttatgaggccagcatcatcctgataccaaaacctggaagagacacaacaaataaagaaaatttcaggccaatatccctgatgaacatcaatgcaaaaatcctcaataaaatactggcaaaccggatccagcagcacattaaaaagcttatccaccacgatcacgttggcttcatccctgggatgcaaggctgattcaacttatgcaaatcaataaacgtaatccatcacataaacagaaccaatgacaaaaaccaaatgatcatctcaatagatgcagaaaaggccttcgataaaattcaacactccttcatgctaaaaactctcaataaactaggtattgatggaacgtatctcaaaataataagagctgtttatgacaaatccacagccaatatcatactgaataggcaaaagctggaagcattccttcttaaaaccagtgcaagacaaggatggcctctctcaccactcctattcaacacagtatttgaagttctggccagggcaatcaggcaagagaaagaaataaatggcattcaaataggaaaagaggaagtcaaattgtctctgtttgcaggtgacatgattgtatatttagaaaactcaatcatctcagcccaaaatctccttaagctgataagcaacttcagcaaagtctcaggatgcaaaatcaatgtgcaaaaatcacaagcattcctatacacaaacacagagccaaatcatgagtgaactcccattcacaattgctacaaagagaataaaatacctaggaatacaacttacaagggatgtgaaggacctcctaaaggagaactacaaaccactgctcaagaaaataagagaggacacaaacaaatggaaaaacattccatgcttatggatgggaataatcaatatcatgaaaatggccatactgccccaaagtaatttacagatttgatgctgtccccaatcaagctaccattgactttcttcatacaattagataaaactactttaaatttcatatggaatcaaaaaagagctcatatagctaagacagtcctaagcaaaaagaacaaagctagaggtatcaaaattgtaactatactacaaggctacagtaaccaaaaagcatggtactagtaccaaaacagatatacagaccaatggaacagaacagaggcctcagaaataacacaccacacatctacaactatctgatctttggcaaacctgacaaaaacaagcaatggggaaaggattccctatttaataaatggtgttgggaaaactggctagccatatgcagaataatgaaactggaccccttccttacaccttatacaaaaattaactcaagatggattaaaacttaaacataagacctaaaaccataaaaaccctagaagaaaacctaggcaatacccataagcatgggcaaagacttcatgactaaaacaccaaaagcaatgacagcaaaagccaaaattgacaaatgggatctaattaaactaaagagcttctgcacagtgaaagaaactcatcagagtgaacagacaacctacagaatgggtgaaaatttttgcaatctatccatttgacaaagggctaatatccagaatctacaaggaacttaaacaaatttacaagaaaaaagcaacaccatcaaaaagtgggcgaaggatatgaacagatacttctgaaaagaagacatttatgcggccaacaaacgtgaaaaaaagctcatcatcactggtcattagagaaatgcaaatcaaaccataatgagataccatctcacgccagttagaatggtgatcattaaaaagtcaggaaacaacagatgctggagaggatgtgaagaaataggaacgcttttacaccgttggtgggagtgtaaatcagttcaaccattgtggaagacagtgtggcgattcctccaggatctagaagcagaaataccatttgctccagcaaataccaaaggattataaatcattccattataaaaacacatgcacacatatgtttactgcagcactactcacaatagcaaagacttggaaccaacccaaatgcctatcaatgatagactggataaagaaaatgtggatcaggagccaagatggccgaataggaacagctccggtctacagctcccagcatgagcaatgcagaagacgggtgatttctgcatttctatctgaggtaccgggttcatctcactagggagtgccagacagtgggcgcaggtcagtgggtgcagcacactgtgggcgagccgaagcagggcgaggcattgcttcacttgggaagtgcaaggggtcagggagttccctttcctagtcaaagaaaggggtgacagacggcacctcgaaaatcgggtcactcccaccctaatactgcgcttttccaatgggcttaaaaaacggcgcaccaggagattatatcctgcacctggctcggagggtcctacgcccacggagtctggctgattgctagcacagcagtctgaaatcaaactgcaaggcggcagtgaggctggggaaggggcacccgccattgcccaggcttgcttaggtaaacaaagcagccaggaagctcgaactgggtggagcccaccacagctcaaggggacctgcctgcctctgtaggctccacctctgcgggcagggcacagacaaacaaaaagacagcagtaacctctgcagacttaaatgtccctgtctgacagctttgaagagagcagtggttctcccagcatgcagctggagatctgagaacgggcagactgcctcctcaagtgggtccctgacacctgaccccgagaagcctaactgcgaggcacccccagtaggggcagactgacacctcacacgtccgggtactcctctgagacaaaacttccagaggaacgatcagacagcagcattcgcggttcacaaaaatccgctgttctgcagccaccgctgctgttacccaggcaaacagtgactggagtggacctctagcaaactccaacagacctgcagctaagggtcctgtctgttagaaggaaaactaacaaacagaaaggacatccacagcaaaaacccatctgtacatcaccattatcaaagaccaaaagaagacaaaaccacaaagatggggaaaaaacagagcagaaaaactggaaagtctaaaaagcagagcacctctcctcctccaaaggaacacagttcctcaccagcaacggaacaaagccggacggagaatgactttgacgagttgagagaagaaggcttcagacgatcaaactactccgagctacaggaggaaattcaaaccaaaggcaaagaaggtgaaaactttgaaaaaaatttagatgaatgtataactagaataaccaatacacagaagtgcttaaaggagctgatggagctgaaagccaaggcatgagaactacgtgaaaaatgcacaagcctcaggagccgattagatcaactggaagaaagggtatcagtgatggaagatgaaatgaatgaaatgaagtgagaagggaagtttagagaaaaaagaataaaaagaaacgaacaatgcctccaagaaatatgggactacgtgaaaagaccaaatctgagtctgattggtgttcctgaaagtgacgggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactgacagctgatctctcgccagaaactccacaagccagaagagagtgggggctaatattcaacattcttaaagaaaagaactttcaacccagaatttcatatacagccaaactaagcttcagaagtgaaggagaaataaaatcctttacagacaagcaaatgctgagagattttgtcaccaccaggcctgccctaaaagagctcctgaaggaagcactaaacatggaaaggaaaaactggtaccagccactgcaaaatcatgccaaattgtaaagaccatcgaggctaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctatattcaggaaacccatctcacatgcggagacacacagaagctcaaaataaaaggatggaggaagatctaccaagctaatggaaaacaaaaaaaggcaggggttgcaatcctagtctctgataaaacagactttaaaccaacaaagatcaaaagagacaaagaaggccattacataatggtaaagggatcaatacaacaagaagagctaactatactaaatatatatgcacccaagacaggagcacccagtttcataaagcaagtcctgtgtgaccaacaaagagacttagactcccacacaataataatgggagactttaacaccccactgtcaacattagacacatcaacgagacagaaagttaacaaggatatccaggaattgaactcagctctgcaccaagctgacctaatagacatctacagaactccccactgcaaatcaacagaatatacatttttttcagcaccacaccacacctactccaaaattgaccacacggttggaaataaagctctcctcagcaaatgtaaaagaacagaaattataacaaactgtctctcagaccacagtgcaatcaaactagaactcaggattaagaaactcactcaaaagtgctcaagtacatggaaactgaacaacctgctcctgaatgactactgggtacataatgaaatgaaggcagaaataaagatgtcctttgaaaccaacaagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagactgctagcaagactaataaagaagaaaagagagaagaaccaaatagaggcaataaaaaatgataaaggggatatcaccaccgatcccacagaaatacaaactaccatcagagaatactacaaacacctctacacaaataaactagaaaatctagaatggataaattcctggacacatacaccctcccaagactaaaccaggaagaagttgaatctctgaatagaccaataagaggctctgaaattgtggcaataatcaatggcttaccaaccaaaaagtgtccaggaccagaaggattcacagccgaattctatcagaggtacaaggaggaattggtaccattccttctgaaactattccaatcaacagaaaaagagggaatcctccctgactcattttatgaggccagcatcatcctgataccaaagccgggcagagacacaacaaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaacatacgcaaatcaataaaagtaatccagcatataaatagaaccaaagacaaaaaccacatgattacctcaatagatgcagaaaaggcctttgacaaaattcaacaacccttcatgctaaaaactctcaataaattaggtattgatgggacctatcacaaaataacaagagctatctatgacaaacccacagccaatatcatactgaatgggcaaaaactggaagcattccctttgaaaactggcacaagacagggatgccctctctcaccactcctattcaacatagtgttggaagttctggccagggcatttgggcaggagaaggaaataaagggtattcaattaggaaaagaagaagtcaaattgtccctgtttgcagatgacatgattgtatatctagaaaaccccatcgtctcagcccaaaatctccttaagctgataagcgacttcagcaaagtctcaggatacaaaatcaatgtataaaaatcacaagcattcttatacaccaacaacagacaaacagagagccaaatcatgagtgaactcccatgcacaattgcttcaaagagaataaaatacctaggaatccaacttacaagggatgtgaaggacctcttcaaggagaactacaaaccactgctcaatgaaataaaagaggatacaaacaaatggaataacattccatgctcatgggtaggaagaatcaatattgtgaaaatggccatactgtccaaggtaatttatagattcaatgccatccccatcaagctaccaatgactttcttcacagaattggaaaacactactttaaagttcatatggaaccaaaacagagcccgcatcaccaagtcaatcctaagccaaaagaacaaagttggaggcatcacgctacctgacttcaaactatactacaaggctacagtaaccaaaacagcatggtactggtaccaaaacagagatatacatcaatggaacagagccctcagaaataacaccgcatatctgcaactatctgatctttgacaaacctgagaaaaataagcaatggggaaaggaatccctatttaataaatggtgctgggaaaactggctagccacatgtagaaagctgaaactggatgccttccttacgccttatacaaaaattaattcaagatggattaaagacttaaacgttagacctaaaaccataaaaaccctagaagaaaacctaggcattactattcaggacataggcatgggcaaggacttcatgtctaaaacaccaaaagcaatggcaaccaaagacaaaattgacaaatgggatctaattaaactaaagagcttctgcacagcaaaagaaactaccatcagagtgaacaggcaacctacaaaatgggagaaaattttcgcaacctacttatctgacaaagggctaatatccagaatctacaatgaactccaacaaatttacaagaaaaaaacaaacaaccccatcaaaaagtgggcggacatgaacagacacttctcaaaagaagacatttatgcagccaaaaacacatgaaacaatgctcaccatcactggccatcagagaaatgcaaatcaaaaccacaatgagataccatctcacaccagttagaatggcgatcattaaaaagtcaggaagcaacacgtgctggagaggatgtggagaaataggaacacttttacactgctggtgggactgtaaactggttcaaccattgtggaagtcagtgtggcgattcctcagggatctagaactagaaataccatttgacccagccatcccattactgggtatatacccaaaggactataaatcatgctgctataaagacacatgcacacatatgtttattgcggcattattcacaatagcaaagacttggaaccaacccaaatgtccaacaatgatagactggattaagaaaatgtggcacatacataccatggaatactgtgcagccattaaaaatgatgagttcatgtcctttgtagggacatggatgaaattggaaatcatcattctcagtaaactatcgccagaacaaaaaaccagacaccgcatattctcactcataggtgggaattgaacaatgagaacacatggacacaggaaggggaacatcacactgtggggactgttgtggggtgggggaggggggagggatagcattaggagacgtacctaatgctaaatgacgagttaatgggtgcagcacaccagcatggcacatgtatgcatatgtaactaacctgcacattgtgcacatgtaccctaaaacttaaagtataataataataataataaaaaaaaaagaaaatgtggcacacatggaatactatgcagccataaaacaggatgagttcatgtcctttgcagggacatggatgaagctagaaactatcattctcagcaaaccaacacaggaacagaaaaccaaacactgcaagtcggagttgaacaataagaacacaaggacacaggaaggggaacatcacacactggggcctgtcggggttgggggactaggggaggggtaacattaggagaaatacctaatgtagatgacgggttgatgggtgcaggaaaccaccatggcacatgtatacctatgtaacaaacctgtacattctgcacatgtatcccagaacttaaagtataataataaaaagaagaagacctcttaagaagtcaaaaaaagaaataaaaaataaaatggtacagctgctgtggaaaacagttcggtggttcttcagaaagttaaacataaaatgaccatctgatacagaaattctacttctaggtgtctaatcaaaataactgaaagcaggaactcagatactggtacaccaatattcacggccacattattcacaatagccaatagatgaaaataacccaagaatcaattgactaaaacaaatgtggtttatgatggaagattattcaaccataaaagggaacaaaattctgatacacattacaataagtataaaccttgaaaatattatgagtgaaataagccagacacaagagaccacatatcatataattccatttatatgatgtatctagaataggcaaattcttatagatagaaagtcgatagaggctattagggattggggttggggaggaaagaatgggttgttattgcttaatgggtacagagtttctgtttgggatgataaaatatttctgaaaatggatagtggtggtggttgtacaacactgtgaatgtactgaattccactgaatgtacacttaaaaatggttacactggtaaattttttattatgtatattttacaataaaaaataaaagattcattccaggaaaaaaaagatggttgatggagaatggacagattagtgaccaaaaaaaaaagacaaataaaatattaactgtcgatataggtggtaggtatacaggtgttcactgtaaacttttatcaacttctctgtatgttcctaagtgtcctaataaaatcttggggaaaattccatcaaaatgttctattcttttatatatttattatttctcttattaatttagaaagctcatgaaatgttagtattttcttcctttttaatctaaaaaaggaagatagtgagtacaaaccatctggaatgaagagaatgtctagagtgaaatgaaattctgggagaactgctatggactgaactgtatccttccaaaattcatatgttgaacccctaacccccaatgtgactatatttggagacagagctctaaggagatagttatagttaaatgagctcatatggttagggctctgactttacaggattggtggctttataagatgaggaagagagggagagagggatctctctctccacagacaagtaccaaggaaaggccatgtgaaaatacagtgagaaggtaggtggtcatctacagctaggaagagggtccgtaccaggaactgagtcacccagcagcttgatcttggacttttcagcctctagaactgagggaaaataaatttctgttgtttaagccataaagtctgtggtattttgttatggcagccctagctaactaagacaaagtctacagttaaacatctatggatatttagataatctgcatgcaattaatacacagggaaaaaaggatctgaaacagtacatgcagaatttgaatgatggaatattaaagcttgaagacattccagcaaccatactactgtcaaacctttcattttacagatagggaaacagaagcccacataggtcaagtgatttatctgaggtccttcagacagattagtggtagagcccaggactgaagcccaggcctcttgacttctgctcttttcaccacagcacatggcttcatcaaatcaaacaccctgagccaagtgttagcagccaaaattataattactttccttccactaaaatctctttcagaaattcagctgaatttttctgattttgtactttactctttttttttaaacccacaaaccaactatccaagcaggataaaaactaaagaagtcttttgaacaaatacaaaatgtatgtaggaatacaaaaatacaaaacaatatatacaaacacacacacacataatttaaatttggacaaatgttgactcaattattcatttacagcagaggcctgtgtgcctaaaggttgcatatgtacacacagaaggcatctcatctcacttccttctagttgcctatttataatatataaaggcattctggaaaaataataaaaatgtattttttttaattattatactttaagttttagggtacatgtgcacaatgtgcaggttagttacatatgtatacatgtgccatgctggtgcgctgcacccactaactcgtcatctagcattagctatatctcccaatgctatccctcccccctgcccccaccccacaacagtccccagagtgtgatgttccccttcctgtgtccatgtgttctcattgttcaattcccacctacgaatatgcggtgtttggttttttgttcttgcaatagtttactgagaataatgatttccaatttcatccatgtccctacaaaggacgtgaactcatcattttttatggctgcacagtattccatggtatatatgtgccacattttcttaatccagtctatcattgttggacatttgggttggttccaagtctttgctattgtgaataatgccgcaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacgtgttgcttcctgactttttaatgatcgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttgtcagatgagtaggttgcgaaaattttctcccatgttgtaggttgcctgttcactctgatggcagtttcttttgctgtgcagaagctctttagtttaattagatcccatttctcaattttggcttttgttgccattgcttttggtgttttagacatgaagtccttgcccatgcctatgtcctgaatggtaatgcctaggttttcttctagggtttttatggttttaggtctcacgtttaagtctttaatgcatcttgaattgatttttgtataaggtgtaaggaagggatccagtttcagctttctatatacggctagccagttttcccagcaccatttataaatagggaatcctttccccattgcttgtttttctcaggtttgtcaaagatcagatagttgtagatatgcggtgttatttctgagggctctgttctgttctattgatgtatatctctgttttggtaccagtaccatgctgttttggttactgtagccttgtagtatagtttgaagtcaggtagcgtgatgcctccagctttgttcttttggcttaggattgacttggtgatgcggtttttcaaattatttatagtctaatttagcaaagtattatatatttattatatttaaaatatgtattttgagaaaacgcccttataggccaggaaaaccatgttaataagcatgagtgtttcatagggcaataatatattttataacattttaaaataatataaaatataaaaattgaacaatctaataattgagcattattttgtttaaaagagttcttatagaacttttaatttcacttttccactaggtaaacttaagagtgcatgaagagaaatacctctaatgatgttgatataatgggaatgtgccaatgacatccagaaatggtaataacccattattaccattcaatacttaaacattttctttaacatttatttttttcctcagtttagattcattatacacagacaatgaattgaaccataagaaagtccatttcataatttttctttttcatattaaagtcagatgtatcagaggtggtcttaatctataactatatggaataataatagtgtgatttgtttgtcatcacttagtcttgtttttttttttttttttttttaagagacacagtttcactctgttgcccaggctggtctcgaacttctaggctcaagggatcttcctgtttcagcttcttactgggattacaggcacacagtaccatacctggctcaaccatttagtcttttcaaaaggacgtgctgaaagctctgaagataattattaaagctgattttaaaaatactttgaccaaaggcagcactgtttggaactgtagatatattcaaggacattttgttttgagagacagtctctgagaaataatgctctagttatatttgaaaacaaaacaagcaataacaaaaccagtgaaattactttctagtatcacctgtctttttaacatggctaaaacaatgtttgtattgtctggggctgtggttcagcctgatggaataactgcagtgaagggaatgggattttactttttatgcacttacccagggcagaaccacaattagtggaaaagattggagaattggagaacaaagagccgatttcaaaagcaaacaattattttactgctttaataggctgtataatgtaaaatgaagttcattctctttatccaaataagtaagaaacgtgtagacataactaaagtagggtaaaaaaagtgaagcggtcacaaatagtgcttggggaaaaaagcagaattctcttctaccttcctaggtagtgatgccctgtaagacttcttacttttgaaggagggattgtatatgtcccatgggcattcagaggcctggggacaaacaacattacaacttctcattccatgcttttttctgtaacacaacctataaaaaacgctgggagagtgtgattaggggtccagctgtgtagatgctgtgctagtcaattagtatttcaaaaccaggtaacgaggtttgaaataaatatgtgcaaataatgtggtttgatggaattcataagccttgaattcaagttccagctgtataagctctaagtaacctcagaaaacttaagtaactgtcatgaatttcagcttcctcatctgcaaaatcatcatcatcattattaacacttagggtcctaaatacatcgcaagtaatgttctaaggacctcacatattttaattcattgaattcttaacatccccaagagaaggcactattattggtcacattttctacataaagaaactgagttacagagaggttaagtaacttgctcaaagacaggaacacttattccacagggttgttgtgagatgaaacaaaatcaataatctggttagtgatggaacagattctgagatcatccagtctaggctctaacagtaactaagaggcatcacaacaaaattggttaactgcagacgtcaaaccaggtcttctggttcttattcctgtgctttttaaacacatctccttactattttgctttcctgtaagtaattttcatatatttcacttatatgtataaaattcctctagggtagaaaagtgggagagttgttaatttctatgttttaaaaaaacagatgagaaaatgcaggataccctgaagtcagcgtgtatacagcacagctagacagagggtcaaggtcaactgaatgatagtgacaacgatgacacaatgaagatggctgtaataccatctcatttatcagatccagattctctttagggcactgtgccaaagcgccttatgcaaattatctcatttaatgctaaatctatttctgagtatgtgacttaaaatcctgttagttttaaaatcacagaatggctaagcctgaggtatacaaaatgcagactttctggagtcaggatcacaaatcccagctgtgtcgattcagcccaaggtcctaatacagagaataaactgaaggccaagtagattagttagtgtgggctttgggctagacattgagaatgaagaccttttctctacagtgaggatacacacttggtgctttttgaaaaagctggggttaacctcaactctttcgacagaatatcgggtttatttgccaaaatggatttttaaaaataatggctgaattgccctacagtccattagtcatcctatagaaatctaatgttagaaaaatattcacttaaaatatagtgggaaaaactctctgaactatgttcagcagttcttggctgtggtcttttatccaacagaaatttcctcttttgaaatgaccagttactttgtgtaatatagcctaatcttcagcatttgtacttatggagaagagattaaagctcctgactttgcatcatgtttttactgataatgtgatgtactggaacatcatttcaagcaaaatcataaaaccctaagcaaaggccatgcttccatttttagctctctgtacaatattctccacatcctaggaactccagaaattaatcactggacatctacttgtattatgcagtgtgctggttcctggggatacaacagcgagcaaaggtgacccagaccctgcttctggagggagctcaagttcagtttatttctcatatcccccagttaagggtatctttgctatgctcttctttctctggctcccccaaactccttcttcactgagccctaggcctcatctactatcgtcctgtcaacaaagagttgacatttaattttttcagtcaccaaatcatactgtattttcttgttatacaattatataagacatttgagaaaatgccaagatctcagaaccattccatccaaaaaaacttataaccatttgtcacatacacaaattattattacataacatacttgcttacccaattttaagaaataagggactaagaatttgcattgggactaagaatttgcatcttatgatcctttgaggccttttgttaacttgaagtagaaatgatctcttatcctaaagattatatccttcttaaggtatggtggtagccagcttccagatggtacctgacaattcttgcctccgggtattcatgcccttatgtatagttccttcccatactgaatgtaacaatggtgaaaggaacagtatgtgacctttagggttaggtcgcagaaggcactgtggttcacaccttggtctcctggattgcttgctctggagtaagccagctgccatccaatgagaatgcttcagccctcccatggaaaactgaggcccccagccaactcctagcattactctatcagctacgtaacaaatcagtgaacagctggctgacatctgactgcaacctcacaggaaattccaagccagaattgcccagccaagctactcccaaattcctgcccacagaaatcaccatataagtggttactgttgtaacagtaagttctaaggttattgctataatagatacaatagaaaccaggcctcccagccagccccctacacctgaggtgcctgcattcttgcactgccacagggcctggccgcctggtgtgcttgtgcacacctggactgcacagcgtgacacctgggcgctgcatgacaggagcagccggctcacgcctttcacgtgcagtggcagtcgctgcttcaacagggtattcttcctatgctgcctgcatgagctgctccatgactaccccgacttggccaaggtggtgagctgtcagtggtcattgacatcagaggcaactgacagttttttttatcaacagaaatttggttgttgcccccaaagttctatgaaataagaagacttgaaaactctgcccccctccctgatttgcaaaaattttgtttggatcatgaattagaaagggtagaaagatggctgggatcaccttattaactgctgatgggatgcccagcttttaccaggttatgagctggctttgtttacctagaagattcacactttttagaaaatattttgtctactgaaaaaaagactgacaaaatcatgaaggcaagaaatgtcactgagtagtgatgtacaattgccatctttacaatatccatgtgactattcaaagtagaaatacatttatcttaagaactatatagtaagtaagagtcacttgtaaggtgctgcctggttgtaagctggtctatttgtagtcctgatgaataatgagggttgactaaacttgcttgaaatttaaggaaatttgtgcctataaaagttataatgtggccggtgtggtggctcatgcctgtaatcccagcgctttgggaggtggaggtgggcagatcacgaggtcaggagttcgagaccagcctggccaacatggtgaaaccccgtttctaataaaaatacaaaaaattagccaggtgtggtggcgggaacctgtaatcccagttacatgggaggctgaggcaggagaatcgtttgaacccgggagatggaggatgcagtgagctgagaccatgccactgcgctccaacctgggcaacagagtgagactcgtctcaaaacaaaacaaaacaaacaaacaaaaaatttcacaagggttcccactctgtattgttttattatctcaaaagtttaaatgagatgttctactgccattggccattgttattcttgctctcaaatgtattagtacttttcctgatgtactctggaggttgatccatgaatttcatagactttctgctggaaactaagggtgtctgattagatggtggaatgtagatggagacaaccttcaagtgataatgtcattgttttcttgctgtgtcattaccttgatgattaagatacaattatttttaaaaccaaaaggcactagttatgtttctcaaattagaaaactattttaggatgatggagccaagacggctgaatagaacagctccagtctacagctcccagcataagcgacgcagaagacaggtgatttctgcatttccaactgaggtacccggttcatctcactggggaatgtcgtaaagtgggtgcaggacagtgggtgcagcgcaccgagcgtgagctgaagtagggcaaggcattgcctcacccgggaagcacaaggggtcagggaattacctttcctagtcaaagaaaggggtgacagactgcacctggaaaatcgggtcactgccaccctaatactgcgcttttccaaagctcttagcaaacggcacaccaggagattatattctgcgcctggctcggagggtcctatgcccacggagcctcgctcactgctagcacagtagtctgagatcaaaccgcaaggcggcagcaaggctgggggaggggcgcctgccattgccgaggcttgagtaggtaaacaaagcggccaggaagctcgaactgggtggagcccaccacaactcaaggaggcctgccttactgtgtagactccacctctgggggcagggcttagccaaactaaaggcagcagaatcctctgcagacttaaatgcccctgtctgacagctttgaagagagtagtggttctcccagcatgcagttagagatctgagaaccgacagactgcctcctcaagtgggtccctgacccccaagtagcctaactgggaggcaccccctagcaggggcagactgacacctcacacggccgggtactcccctgagacaaaacttccagaggaacgatcaggcagcaacatttgatgctcaccaatatccgctgttctgcagcctccgcttttgatacccaggcaaacagggtctggagtggacctccagcaaacgccaacagacctgcagatgagggtcctgactgttagaaggaaaactaacaaacagaaggaacatccacaccaaaaccccatctatacgtgaccatcatcaaagaccaaaggtagataaaaccacaaagatgggggaaaaaacagagcagaaaaactggaaactctaaaaatcagagcacctctcctcctccaaaggaacgcagctcctcaccagcaacagaacaaagctggatggagaatgactttgacaagttgagagaagaaggcttcagacaatcaaactactccgagctaaaggaggaagttcgaacccatggcaaagaaattaaaaaccttgaaaaaaaattagacgaatggctaactagaataaccaacgcagagaagtcctaaaaggacctgatggagctgaaaaccaaggcacaagaactacgtgacgaatgcacaagcctcagtagccgatatgatcgactggaagaaagggtatcagtgatggaagatcaaatgaatgaaatgaagcgagaagagaagtttagagaaaaaagaataaaaagaaacgaacaaagcctccaagaaatatgggactatgtgaaaagaccaaatctacgtctgattggtgtacctgaaagtgacagggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagctgatctctcaccagaaactctacaagccagaagagagtgggggctaatattcaacattcttaaagaaaaggattttcaacccagaatttcatatccagccaaactaagcttcagaagtgaaggagaaataaaatcctttacagacaagcaaatgctgagagattttgtcaccaccaggcctgccctaaaagagctcctgaaggaagcactaaacatggaaaggaaaaactggtaccagccactgcaaaatcatgccaaattgtaaagaccatcgaggctaggaagaaactgcatcaactaacgagcaaaatcaccagctaacatcataatgacatgatgaaattcacacataacaatattaaccttaaatgtaaatgggctaaatgctccaattaaaagacacagactggcaaattggataaagagtcatgatccatcagtgtgctgtatttaggaaacccatctcatgtgcacagacacacagaggctcaaaataaagggatggaagaagatctaccaagcaaatggaaaacaaaaaaaggcaggattgcaggggttgcaatcctagtctctgataaaacagactttaaaattacaaagatcaaaagagacaaagaagtccataacataatggtaaagggatcaattcaacaagaagagctaactatcctaaatatatatgcacccaatacaggagcacccagattcataaagcaagtcctcagagacctacaaagagacttagactcccacaataataatgggagactttaacaccccactgtcaatattagacacatcaacgagacagaaaattaacaaggatatccaggaattgaactcagctctgcaccaagctgacctaaaagacatctacagaactccccactgcaaatcaacagaatatacattcttctcagcaccacactgcacttactccaaaattgaccacatagttggaagcaaaacactcctcagcaaatgcaaaagaacagaaattataacaaactgtctctcagaccacagtgcaatcaaaccagaactcaggattaagaaactcactcagaactgctcaactacatggaaactgaacaacctgctcctgaatgactactgggtacatcatgaaatgaaggcagaaataaagatgtcctttgaaaccaacgagaacaaagacacaacataccagaatctctgggacacattcaaagcagtgtgtagagggaaatttatagcactaaatgcccacaagagaaagcaggaaagatctaaaactgacaccctaacatcacaattaaaagaactagagaagcaagagcaaacaaattcaaaagctagcaaaaggcaagaaataactaagatcagagcaggactgaaggagatagagacacaaaaaacccttcaaaaaatcaatgaatccagtagctggttttttgaaaagaacaacaaaattgatagaccgctagcaagactaataaagaagaaaagagagaagaatcaaatagacacaataaaaaatgataaaggggatattaccactgatcccacagaaatacaaactaccatcagagaatactataaacacctctacgcaaataaactagaaaatctagaagaaatggataaattcctggacacatacaccctcccaagactaaaccaggaagaatttgaatctctgaatagaccaataacaggctctgaaattgaggcaataattaatagcttacctaccaaaaaaagtccaggaccagatggattcacagccgaattctaccagaggtacaagtaggagctgctaccattccttctgaaagtattccaatcaacagaaaaagagggaatcctccctaactcattttatgaggccagcatcatcctgataccaaagccgggcagagacaccaccaaaaaagagaattttagaccaatatctgtgattaatattgatgcaaaaatcctcaataaaatactggcaaaccgaatccagcagcacatcaaaaagcttatccaccatgatcaagtgggcttcatccctgggatgcaaggctggttcaacatacgaaaatcaataaacctaatccagcatataaacagaaccaatggcaaaaaaccatgattatctcaatagatgcagaaaaggcctttgacaaaattcaacagcccttcatcctaaaaactctcaataaattaggtattgatgggatgcatctcaaaataataagagctatctatgacaaacccatagccaatatcatacagaatgggcaaaaaccggaagcattccctttgaaaactggcacaagacagggatgccctctctcaccactcctattcaacatagtgttggaagttctggccagggagaaggaaataaagggtattcaattaggaaaagaggaagtcaaattgtccctgtctgcagatgacatgattgtatatctagaaaaccccattgtctcagccccaaatctccttaagctgataagcaacttcagcaaagtctcaggatacaaaatcaacctgcaaaaatcacaagcattcttatacaccaataacagacaaacagagagccaaatcatgagtggactcccattcacaattgcttcaaagagaataaaatacctaggaatccaacttacaagggacatgaaggacctcttcaaggagaagtacaaaccactgctcaaagaaataaaagaggacacaaacaaatggaagaacactccatgctcatggataggaagaatcaatatcatgaaaatggccatactgcccaaggtaatttatagattcaatgccatccccatcaagctaccaatgactttcttcacagaattggaaaaaactactttaaagttcatatggaaccaaaaaagagcttgcaccgcgaagtcaatcctaagccaaaagaacaaagttggaggcatcacgctacctgacttcaaactatactacaaggctacagtaaccaaaacagcatggtactggcaccaaaacagagatatagaccaatagaacagaacagagccctcagaaataatgccacatatctacaaccatctgaactttgacaaacctgacaaaaacaagaaatgggaaaacgattccctgttaaattaatggtgctgggaacactggctggccatatgtagaaagctgaaactggatcccttccttacaccttatacaaaaattaattcaagatggattaaagacttaaacgttagacctaaaaccataaaaaccctagaagaaaacctaggcaataccattcaggacataggcatgggcaaggacttcatgtctaaaacaccaaaagcaatggcaacagaagccaaaattgacaaatgggatctaattaaactaaagagcttctgcacagcaaaagaaactaccatcagagtgaacaggcaacctacagaatggaagaaaatttttgcaatctactcatctgacaaaaggctaatatccagaatctacaatgatctccaacaatttacaagaaaaaaacaaacagccccatcaaaaagtgggcaaaggatacgaacagacacttctcaaaagaagacatttatgcagccgaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaacaggaacacttttacactgttggtgggactgtaaactagttcaaccattgtggaagtcagtgtggcgattcctcagggatcttgaactagaaataccatttgacccagccatcccattactgggtatatacccaaaggattataaatcatgttgctataaagacacatgcacatgtatgtttattgcggcactattcacaatagcaaagacttggaacctacccaaatgtccaaccaacaatgatagactggattaagaaaatgtggcacatatacaccacggaatactatgcagccataaaaaatgatgagtgcatgtcctttgtagggacatggatgaagctggaaaccatcattctcagcaaactatcgcaaggacaaaaaaaccaaacaccacatgttctcactcacaggtgggaactgaacaatgagaacacatagacacaggaaggggaacatcacacaccggggcctgttgtgcggtggggggatggggagggatagcattaggagatatacctaatgttaaatgatgagttaatggttgcagcacatcaaatggcacatgtatacatatgtaactaacctgcacattgtgcacatgtaccctaaaacctaaagtataataaaactattttagttattttgaagaaatataaagccataacaaaagccattatgctttttactcgagtgttaatgaatgcaaagagattagatagtagtatttaattaatgatgtttatcttcagtatatttaatatgagtaatttttcacctcctttacagaggaacaatgtttattgtttaaaggtgggaaatgatggctaagccaccaaatctatttcacgatatttgactgtattatgcattgtacaatggatttcatttttcatgtaatatctcagttttcttacctataaaacaaaagcagtggctgggcgcggtggctcatgcctgtaatcgcagcgctttgggaggccgagttgggcggatcacgaggtcaggagtttgagaccagcctggccaacattgtgaaacccgtctctaataaaaatacaaaaaattagccaggcatggtggtgggcccctataatcccagttacttgggaggctgaggcaggagaatcgcttaaacctgggaggcagaggttgcagtgagccgagactgcgccactgcactccaacctgggcaacagagtgagactccgtctcaaaaaacaaacaaaaaaaattcacaagggttcccagtctgtattgttttattatctcaaaagtttaaataagatgttctcctgctcttggccattgttgtttttactctcaaatgcattagtacttttcctgatgtactttggaggttgacccatgaatttcatagactttctgctggaatttaagggtgtctgattagatgtggaatgtagacggacacaaccttcaagtgattaacgtcattgttttcttgctgtgtcattaccttgatgattaagatacaattcttttaaaaaccaaatgacactagttatgtttctcaaattagaaaactatttgttattttaaagaaatatgaagccataacaaaaaccattatgttttttactccagagtgtaaatgaatgcagagattagacagtggtatttaattaatgatgtttattttcactatatttaatctgagtaatttttcacctcctttacgggggaataatgtttattgtttaaaggtgggaaatgatggttaagccaccaaatctatttcacgatatttgactgtattagcattgtacaatggatttcattttttatgtaatgtctcagttttcttacctataaaataaaagcagtggccgggcatggtaactcatgcctgtaatcccgacactttgggaggctgagacgggcggatcacctgaggtggggagttcaagactaggctggccaacatggtgagaccctatctctactaaaaatacaaaaagttaaccaggcatggtggtacacaactgtaatcccagctacttgggaggctgaggcaggagagttgcttgaacctgggaggcagaggttgcagtgagcccagatcatgccactgcactccagcctgggcaacacagtgagactctgtctcaaaaaaggaaaacagtaaaattattatactctaatttgtatgcggttgttacaggcattattgttttggaaggtgatatttttcatcttgtacacaacatggctgtctccattttgtgagatgctgacctcacaggctttcaaaatttctgatttgctaaaaatattagtaatgaatgtttatctatattttcctcaatgttaagttaaagaaaaagaaaaacaaaacttgcttagttactttctgaagataagttttgatgatgtggctctgactatggtaaagtaaggaactgtggaggaccaaagagccaggagaacttgaaagagtagcaagaaataaccaaaactgctgaaatccatttcattgaccttctcaaggaaaaaattttaacaactccccatgtgtccaaagaatttaattttaaccagtgcaaaaatgtagcaagatttttagaaataacttttttttcttttctttttttttttttttgagatggagtctcgctctgtcactcaggctggagtgcagtggagctatctgagctcactgcaagctctgcctcctgggttcacatcattctcctgcctcagcctcccaagtagctgggactacaggcgcccaccaccatgcccagctaattttttgtaattttagtagagacggggttttaccgtgttagccaggatggtctcgatctcctgacctcgtgatccgcccacctaggactcccaaagtgttgggattacaggcataagccaccgtgtctggccagaaataccatttttaaaagctagacactgggcactgaatctcaattctaaacagaaaagacatactacgcatgaattcatggaacttgcctggctgccaaaaatttgctatttcacactggtactatggggaaagtatttaagagaactgccaactacgcaatctagcttcgtaaattagacccattccatgtgtaaaggaaagtcacctttacaccccagaaagtcttcactgcaagccaactttgtgcctagcactatgcaaagaactgtggaaaggtaggtatatataattcctgacatatcagacatgtaggccactaaaatatctgagtacaaactaaaaaaaaaatattgaaatatttggtttatagaagtactcactggttcagccttactctgagctaatattgtctctaaaattttaataaataggtaatagtggaaaattggtttagaaactctaaattatagcatagggaaatattaaataataagctttcatctatctcctcagcaacaactacttttatgattttcatgtgtccttccagataattctatgtatatactagcatatatatgtatacacatatagctataaaaatatatctttaattacccccttaatataaataacactatgtatctttctgctgctctatacctaagaggtgtgtgtgtgtgtgtgcgtgtgtgtgtgtgtgtgtgtgtgtgtgtggttactaacatattttgggaattttttctatatcatatgctaaacttgctatccatatttgggtgtatttctgatctttctaggctgctcaatttatctatttatgtattaacatcaaattgaattactgtagctttgtaatgttttgatattgggcctagttaattaataactccctccctaattatacttttcaagaaatttcctggctcttcttatatatttcattttctatatgaaattctggatcacctatttagtcctttccccaacctctgattttgatttttaaaaattgggatcagaagtgctacatctttaagctcacacttatcctataaaatgctcagattaagtcttaaccatgtagcatactaatatataacaattatcttgaattttatagttatctagaattttcctatgtacgaagactgttcacttttattatctcctttaaccttttcaaccactatggcaccatgcaggggcctgttttttgactctcacattacagatggagagaggcgcatggacttgtcctcaaggcctgtaggtaagggctctgacacctagctcaggcccagggctcttcccattataccaaaggctgagggcattacaagtcttcaggaaacattttcaaaatagggaatgctaccattttagaaatgttggcaggctatcaaattttcaaactttaaatgaagtttaaaacacaataatactggcatgaatacagtgaaatgagaactctcacgaattgctggtgggagggtaaagtagcatagcgcttttggaaagtatttggacaatacataccaaaagtcttaaagtgtttcagaggaagaagaaaattgctactgggatttctgggctgcagttccctctgctcatgaacccacttcccttgctccagttgggcctatttccccactgtcttctgagtcctgtaatcatgctcaactctctacctgtctgtagaacctcccttcccctatcttctccttctctcttttcccctacaccttggaccttcaggctggcaaggtgtcactgaaacctgaccttccatgtttcccaacatttcccattagctccagatccttacatgtcatgccttcattcccagtctcttatcttctcccaaggtttctctactgcgtatcttgctggtggagaaaattgtttactatattcctttcatttttatttcagaattaataaccattgttctcattttccaattaaatgacaaaattaaaactttttcaaacaatgcacatccccttacttacttcatgggatttaagtaacttttccagaaataacaacaaaataaaccccaaaatgataagacagtcactgaaatacttttctctgaataatatgcctttatctaccatgaccagaaaatattatctaaagaaattaagattgtgaatcttcttcataattaggcaaatattttcatttcctttttctaatttctctttgatttagaaaatgtattttctttcaaattaaaaaaaaaaaagggggccaggcatggtggctcacgcctgtaaccccagcactttatgaggccgaggagggtggatcactcgaggtcaggagttcaagaccagtctggccaacatggtgaaaccccatcttcactaaaaaatacaaaaattagccaggtatgatggcaggtgcctatactcccagccactcgggaggcttaggcaggagaaccatttgaacctgggaggcagaggttgcaatgagccgagatcatgccaccgcactccagcctgggcaacagagtgagactccatctcaaaaaaaaaaaaaaaaaaaaaaaaaagtagcttcttttataaatgaaatagtctaacttagatataattgtttttgatgagtttttttttaaagctattgctaacactattggtaagcttttgctaacattattatccatatcaagtaactattgatagcacaattcaaaattgatttcattttcctccaaaaaggctttgagaatcttctgttgttctcttttagtgcatcttcttttgtcttagaattaatcacttaaattttttagtcagcattcccaccacatgtttgacagtggttgcaaggtcaaatttggtatatatttaattaggatgttttttcctttgggcagattcagaaaatatcataactatcttccaaattgttccaaagaatgtcactgttattgacacaactcctagcaatacattcaaaagacgatgcattacttacggcataaaaaatacttctggaatttatgccaaaattctggcatgtataccttttcttttgtcagctgtattagtaccatcatgatggtcttgcccttcagatgattttaaatttttaaaataaagctgcaatttttattataattttttgaaaatttaatggactcattaaatatttctattttaaagaaggtattcacaattctaatgtctactatccatatagttgccaatataaggaatgactattacagttcatgcactttacatctaggcctaaatatgtaccagtgtaagggtaatacgaattgttactgtttttcagctaacatttgcaactgctgtggatactgtgttaatttgtgagcatatttggaaccttgaattagaacatggagagaggcaagaaaactgatgcttggcaccactaggaaacaatgcttccttatgccagaaactattgcattcatacccagagaaaggctttgatgagttaatttcctttccctcttaaataaaagctctgcagctcaaatcttccccttgctcttacttaagcagtgtctgtctacgaagtcatggcagcacaatccacagaacttcatggaattcagcagcagtttcctttggaggcagggggtgataaaatatatataacaaaatttgtcattttaacaatttttaagtgtacaagtcagtggcattaattacattaataatattgtacaagcatcatcatctactttttcatcatcccgaacagaagttctgtgcccattaagcaataattcctcctcttcccccactgctgtagcttctaatctactttctgcctgtgtgaatttgctcattctagatatttccagtaagtgggatcatacagtatttgtccttttgtgtctggcttatttcacttagcataatattttcaaggtttatccatgttatagcacgtatcagaacctcactcctttttatggctgaataatatttcattgtatgtatatactatgttttgcatccccattcatcatcagttgcctcttattcagggcacattgtaagagatgtggagaagtggaacctgaacaatgtttgtgataggagatactctctacactgtgggacctggggcaggagtccttctgcctggtctgagagcagtagtgctgccccacaagaatcactggcagagattcttgattattccagttgttgttccctttacctctggattcctaaagcacctagaaccaatgatgtgaagtttaacacttatctacagaatgagttactgttgccctccttacaattaaatgtaaagtctctttttgttctcagctgttgatagttgatacagaaggaaatgaacactggctctgaatgtggcagttactgtgctaggtgaggaggcaccatagatgttcagtttcttccccttctctcttctccagtgtctaatattgcactgataatacactaggaattcaaaattattgtcgattcattgattggaaaatgccttcttcccaagaaaatgtgtgaaatacttgactctcattcttctttgttcatcagaaaaactgatttccctggccagtaagaagaggcaaaccaaagcttacccctcaggaaaaagaggcttcagagaattgcatttcctgattgtagatgggagaggggatttcttctccctttcttcccaaggctcatctctatctgcataatggagtagaatcatcatccttccagttgacagtctacattaggacacatttctttgcattattttttctttgctacaatgctgagaattcttctctttttcccaaggaaagcagagtcacagcatgcctgtgtttatcattggcttttatttggcataattaaaacaaaaaaagatgaattctcctccagtcaggaaacatgtgaagccccatcttcaacttgcagctgtctagcttttttatttagccatatagcacaaaatattttatgttgggaatttcttaacaggatgagagaagggctcctcattaagaatgtagacaactacagtctgcatgggaacctgatgaatttcatggctgcatgtgaatttgttatccaagaagagaacataacttccaaatttgaaaacaagacgtctagactcttttcttaattgatgactacacataaaaatgtataataaaaatgtgtctgcaactctacaaaagcatcccactaacaaaagcacttttatcagaaaaattaggttgtgtctatgagaacacacattcatctaacaaatagatgcgtcttactgtccatattattctgctacttggggttcttcaaattttgttttccaagtggttatttttggtatctaaaatttttcagacaaaagcttcctaaatggatagtgatgattcagtgccacccctatcatatagtttcatgtgtaacttgtgattttcataacaaatgtttatcaactatcaacttgagtcctcattaaatattttccatttaatagctcataaaatagtcacatgagtaaaatctgccttcatcaagtaccattacaaagaataatattctattataataatattctatccagaacctaatagttaggcattgctcctttgaatacatttttttaaaaaattgctgtcaggaacaaataggtagacagaatggacttctgtgataaaagtaaccatgaagattaaatgttttatacatattacctagtcacctaaaagccacttttgcaaaatgattaaagagttttatcagtgaagttaaaagataatcctcagaggcttaaaattgacagcaaagttctttcttgttggttatgtggagctttgctcctcagtgctgaatgaggtgcagagtgcaaaggtcaattaaacaggcatttattagctccaattatagttccagcatggtgctaggagctcagcttcatacttttcccagtatggttagggtagtacataactacccactgaacatattatttcaaaacaggtattactcatgaggtagcttgggcattattttgccttggattcatgaggaatcaatgatcaatcctggacagtaataatcaaacaatcttatgatttcttttggctgccctgcagttacccatatgcaaattaatcataggtaatgaagtgtacatttatataaggcacattaagtttgaggggcctaaaactgattagggagattaaaattggactctatcaggtggctgttgtctcttcagaccatcgttctgtacacttgtccatccattcatcaatcttttatgttgagctacaaataaacaaaagtattgtcctttgctgagagaggaacccaagatgattaagacgcagtcctttggtctacctgaggatacaggtcctcaccaggtgtggatcagatcaggaaatacgatgtatcttggagcaagtgggtcaaagcttaggactagatccaaaaggagaaaacagttcaaacaaagtcaaggaagtaagaaagagatgagatctggactcttactaccatgccctgtatcaccaggaattccctgggcacatatctatctaaatctgaacatccaattctttctccttaccttacctctaaagaaagtatgagtgctaagaagccatcttgggataaaagtaaagagagtggcaaaattctcccaactgaatgcatgagaaatactgctaccaaaatttggaagggcctcagagagtttgttcatataacattacacatttttctttccactggggagaaagaaacactttcaacttaggtttgaagaaaagtatgtaactatcagatgctaagataacctggcgaccaagatttcacaattaaattcttaggaaatttctggaaactgtatacattctcatctgtcttgaataatttacggttctgctgaaatagactaagagaataaaccaaagatcatactagttaccataaaccaaaagtaaagttctaaggccccccaaccatctgaatggactttctccttggccagtgcattctaaaatttaacctgaaagactagttcatgccatgatgggaagtgggggttggacatgccacattataccctccagcattaacatcaacacagaccttaagtctgataagaaacatttacactctattctctctgaagtctgctacctggaggcttcatctgcatgataaaatttttggtctccacaacctcttattgtaactcagacattcatttctattgataataactcaaccaattgccaatcagaaaaattttaaatctacctataacgtggaagctcctgacccctccccacttcaaggtgtcccgcctttctggaccagaccaataaatgtacttgattgatgtctcatgtctccctaaaatgtaaaaaaccaagctgcaccccaaccaccttggacatatgttctcaggacctcccaagggctgcatcatgggccgtggttactcatatttggctcagaataaatcttttcaaatattttacagagtttgactcttttcatcaacattatcaacttaaagtgttattgctgaacaattttgttgaattatagattttctcatctagatgtttgaaacgttaaattttcacaggtgtacaaagacatattttaagagatgacaatgactccacactagtagaagtttaggaatcagtaaaagcagaagtaggaactatttctgggtaaggatcctttcctgatgctcaagctggaaacttatcattaaagccaattcacaatacactgcatctttcatttttttctttcaatctaaagcttccaacttcagtaagctctcattcctggaaatgattttggtagttactttttggaacccacaatttctgtagatcctcatctttttaccatacccttactgcctctaagccttattccccatatgtggtcagtaatgccatggacactgggaagtaaaatggtactcagaatgggtctgtttgcccacacaagggcaaacatgcagggcaggaaaggagtccagcatttgtggatctcaagatattctgaaaggttttggtaaagagaacatattattactaactgaaaatggacatagaaacattagggaattttttgaaggctataaagaaagccaattatggctctgggtctctgtctcacactcaaatgtcaggctgggcttccctttgtgattctctgaagggtactattggcaaactagcattgtaatctacatttaaattctaatatgataataatgatttttaaatactgcatttctttaagcatgttctatgttaagcacagtgctggaagctttgaagtattattactgacacttattaaaagttgctaatttgggggctaggcacagaggctcatgtctgtaatttcccagtactttgggaggctgaggcagctggatcgcttgagttcaggagttcaaggctgtgggtaacatggtgagaccctgtctctacaaaaaacaaacaaacaaacaaacaaacaaacaaaactacttgggcatgacagtatacgtctgtagtcccagctatttgggaggctgaggcgggaggattgtttgagcctgggaggttgaggctgcagtgagccagggctgcaccactgcattccagcctgggtaacagagtgagaccctgtctcaaaaagaaaaaaaaaaattgctaattttaacaaatcacaaaactgactcaggcaagttgtctgactcaaaagcccttgaaaaaccatcaaagacagtagaatgttaactggtcatttacgtaaaatagtgttcattaaatttttggttcatttaggataatcattttaaatgagactgtatttgagactgtatacacatacatatacatgtttacacacatatacgtacaatatatgtacattctatctaaaagatcatacatgtgtgtacatatatgtttttaaaagtcaaactgacatattaatggaaacagtgcttacatctctggtagtgattttctattagcagcagccctacatatgctgcgtctctgaacagcatgtcagtgccatgactgtctaaacatgcaaatatgactgacagactcttgagacagctttcaccttggtagagcacagggagcaccacataaattttcaggagtataaatgaagcctcatgagtcttttagaataaatacctccaggctaggtgggaccacagccaagcagcctagaagttctatccttgcttacaatagtttgtgaactacgatactgagagctgtgtaatccaagtattttaaatacttccacaccatttccagtacaatcatggaaatttaaaaatactcctctatcatcatatattatatagaaaaaaaccagttctttgcaaagctggcttaagtgagatatttgagtacttaaaacctactttaaaatttctatcggtaatgccatgctctatcagcacaatattggcttcctcattagcaaattcactctaagtaaattcattgggggtaatctagtgatacagctggtaacctgtgacattaagttaaatgaccaatgtatctctagaaaattagttcaaaatgatgcatcattttgccaaaaggtcttaggaattagctaagatctctctttagaaatatgaatccccttgaaaccactcccacaaatagccaacattttaagtaactgctaagccacctggttttctccaagaaacatcatgaaactcacaagttagtaaagttttggaaagcctacaaaatccctatttttctgacaaagtttacatattttgtttcagtgactttatttccccttttctgagaattaaaaagtccccacatcagatttatagttcaagctacagacttatttgcaaaagaaggacttgtaagtagatgccaaagaacacttcttcatcactttagtctggacttggcacagtgtttcagatggtattcatttggaataaagagatcgatgatataccttgtccaatcctcctttataagtgactttactagaagtgggtaagggcataaaaatataaattcatctgactgtaggcaaccaaaaatataccaactcatcttggagtaatttaaccaataagatgatttagaggacagttcagtggcaccatttttggaaggcaaaagcttagcagaaggaacataaatcaaaggtgactggcaggtaaaggatatatgctgcaatcagccaaaccatgtgcatactggcacaaattcaataagatcatttataaaatttttaaggcagaagtacacaaaagggggtctggtgctaacgaaatccacagatagcttacacgccactgaaataaacacttccagatgcgggtgtacaaaaacctttcacagaaagaaatgttttctttcataaatctgaaggagggacacttagcagggaagggcaaaaatgcctgaaattgagcctgagcttcttacagactggaagtgcttattgaggtggaatgattgtatgggtgatgatgaactacatagcaagtctcctttagaagcatcactacaatcagtaaggctggatttctgttaaattgtacaaaaagtgctaactcatcatttcataaatcctataaaatctggtgtgtaagttagtgctgctctcattacgttccttacagtttctttttcagggggcgtggaagagcaatgacagagacgatagcttctcacagagataaaagctgctaatcaaagtttaggaaaataatgccttggatcttacccaaagctattgcaggcatggctttaatgaaggaaaaaaaaagtcaaaacctggttagattaggcgtcttctaagaatgcatgaccaaattcattaacggtttagaaagtcaatttgttcatcaaaacagcataatatgtgggactttctggtcgtatatacaaaccctcccagaagttcaaacagaaagctatagtgtatttttttttttttaaagtttagatgacttctgctttgagctacccccacccttaaccaggatatccccctgaaattagtttccctggtgaatctttaaatttaatgcaagttcttcattaagtatatgagcattgaatttagtctcgagaacatttctaattgtctgttctatgcattcagccaaattgtaaacttgctatttttttattcttctctcactcagggtcttattctacttattctatacggcaaatatatcttgaatacattttgtcttctctggtctcacgccattgcctcagaagatgctcttttagcctctcgcctgcaatattgcagtgccacctaatttgtttccttgcctattatatcccctcacaccagtctcttctcaacacaatcacttctttttcttttttcttttttattttttgagacccagtcttgctctgttgcccagggtggagtgcagtggcgtgatctcagctcaccacgacctccgcctcccaggttcaggcgattctcctgcctcagcctcccgagtagctgggattacaggcgcatgccaccacacccggctaattttttgtatttttagtaaagacagggtttcactgtgttagccaggatggtctccatctcctgacctcgttatccacccacctcggcctcccaaagtgctgggattacaggcatgagtcactgtgcccaacccacaatcacttatatttttctacaacacagagctgttcatattaatactttgcttaaaaaaatctgaaatagctccttaatgactatgtctgttgtttaaaagaaaatttcccactgggtgtggtggctcacatctgtaatcccagcactttgggaggccaaggcaggaggattgcttgaggccaggagttagagaccagtccgggcaagagagtgagaccccatctctccaaaaagttttaaaaaattagccaggcatggtggtgcataactacttgggagcctgaggtacgaggatcacttgagcctgggagatggaggctgcagtgagctattactgcactactgcatcacagcctgggtgatagaatgggaccttgtttctttcaaaaaaaaaaaaaaaaaagacagaaaaggaaaaagaaatttaagagacaaaaatttgtataactagagaaaacactattatttgtgggaaatccataatgtattttggcagaacagtttgctaactgctgccctaaatcataaagtctgggtaaactggctcgcaattaaaagtccttctcaaaatggcatcactttatctttgatgcttcatctcatctcaacgtactccagatccagttcctcatctttgcctgaacagccatgctactttcatacatctattttatttttcattttattcctgctcctctgtgtgcttgtattgtcttttcaaaatcactattcattcccttcccctctgttttataaagtcaaatattaaacaccctaaaagttttccttcacttcctcaggcagattgtgccatcctttcgccgtatctaagggactgtccctcttttagttacaacatcagtcacatggcactgcttatttattcacctcctttgctatatttggataactggtttcttatctccatacaccatacctccctcccaatatatttctaacacaatgtttggcacatgcttattgaataaatgcaggtatcaaagctataaggatctcaggacacatgtggatgttaataatggtcacatgtagttcagttgtacagatacggattcttgtccatactcaaaaatcaagtgctgtcctttgtatgcgaagtgtgctttcattctatcaggaaggcatgtactttggattgtttttctagcagtggtgggtgacagattgactcatagcagtacacagtcttgccctgcctccttaattttttattttaaccatttgcaagctggttgtgtgaacgatagacattgtttgccatcaaaaattaaggcaaagttaggtcaccaacatgaagatcaacccctaatactttcttctttagacagtggcttcagagaaaagcacagtgtagaaaccaagctagctctcttttcttttttctctttctcttttgaacaccaaaaccctgcttggatgagaaatatttgtcaactataactcatttacttattaggatcttacctaattagtcttgaatacaggtatgggtttttgggttagatcaggaatatagagtgaaatcagagccagaaatgtagtctctaacgtctctactggaaactgtaaaatctacacaagtgtttgaattggattgacagaaatctgtaggccaggctgtgaacttctgcagccagaaagtcaactcaaatactccctccctgctatttccaccagagaggcacagcagcccaactgtcaccttgaatgcgcctgggcaaactcagagcctgacactgggctctgtcctcatgacctctgccaactaatcagtcaaaatatttcctgatctagagagcatactccacctattgggcatatgcccagagctgcgagtgcactctaatcaggtgggagaacctatccaggtgccagggcaaaaattaacatctgactgacatatggactatgaattttctcttctcgcatcctagagtcatgcagaggcagtatgtggggatgggagatttgatctgtgcatacatagcctaggggatttggtttaaatcaaatcataattaaaacactggttaggaaaacaaggcataattatttttttcccgcacattttaactaacttgcatatagtcttaaatatatgttgggcacaataagagtaaggtatcagtttcatttttgaaaggtgcaaatttcctatttaaaacaatccacttattatgttctgggattaactttgcagctacatcagtaaattaaaggacatttcaatgattacatttgttgactaaagttatgtaacactatttaagaaatcaccaaaaagtaaatcacctacagttcaacaggctctcatcacaggtatttggaggggatttttttgtcacactatcaataaaacagtatacaaatgcttcacttaaacaaaacacacttatgaatgttagatgtttctggcaatagtaaataaataatctatttaaatagaactgatatgttatttttctaatattcaactaatttgtatataaaatacttaaaaaatgaaaataatatttttgctaggtcaacatgagcaacttaatgtactgaaagagtcatctatctgagtatttataatcttcttgtttcttcatagactttaaagaagtttcttgccatttttacagcacaattttaaaatttagaaatagctcaacttagtttagtttctcctggctaatccttgtgctgctttcatgaattcatgagttaaaagaatcctgtaatttttttaaagccatattttccttttcagagtcactccaaggattttcttcattcgatttccattcctccagaagacagcaaaaacccagaaactgtaacaacatttaaacctcaagatttagtccttttagaatattccactcaaaaggtttctatttggtataaattacccctttccttgcactcatgatcaaattcttcctctattcctcaagatacagtatacctgttataacaaaaatagatttcttgaagtactaccaatttaaaaagactttgaaatatataaacttggagaaaatacagagggatgattaagactgtcatctttcattgctgctttatgtcccccattagagaaaagtgatttgcttttccagactatgttcctgaaaattctaggattctttggagtattctagggtctccatagatgtttggtttgaatgtctatcacaatttttgtgctactccaaataaaggttatgtcatccactgttttatatttgaacttttcataattgttctgttgattagtaagttacgtcttggaatttaggttttgtttttgatatttaaagcagcccaaatatactctgaataaaattgtgcaagtaagtctatcacctcaggatgtatgtcctgtgctgaactaaatttcaggtgtttactaataacacaaagtgaaagcaggaaagagtaaaatgtgtttgaacagtcactgtataccacagagacaaacattagttattggcaataccaggatttttcaaaacagaactgaataatttcttataaacaaatgtactggctgccccaaggtaagatattgctgcagagagtttaaatgagataagatctctcttcccttctccccacatctgcctgctgattaaaaaaaacaaaaaacaaaaaaacaataaacaattttataatagaactccagttggcaatgtagactcatgatgttatgcttacaatagcggaaaatgaagttcaccaaatatggtttcaatagacgaagcaaaataaatttaactctcaaacttcaataaatatttgtcagagaaggatcctcagatgacggagattttctttgtgacatctttaagtagcttacagtgttttaagattcatttaaaaatattttccagaaaaccttgaagaattatgctggataagaaatccatatattgattccctctaaacactttccagtttagaaatggaagcacgtgccagatattgttagtgaaacaactttcaaacaaataatttttactatttcttttgcaccaagacttttgcaggcctgtatagcacattattaaaaacggctgtattttgaatcaaactcttttcaatgctgtgcaattaaaaatatacaaaaataaagtggacattaatggatataatattccaactgtcatccataactttgacttcaaaatacacctatacttactgagtgaaattttaagagtggatcttccttacacaaatacagacttaatacctcttggaatacttgtcttctacagaatttagtttaggaaatgctgtagttttagaataaaaccactgaaagagttaagaatacaggtcaaccaataaagaaaaagtttaatgggtaggattagtaagaatttattgaagcctatggtaccagtaagccatagagtatttagctgctgtacacagaaaaggctctggtgattaaaattaaaagtaattaaattaaatgtttcatatctttctgggaaatactcactttcaggttattcttatatgataaatatgctacatgttaatttttttccttaggatcagtggcctacagttttaaacatatgtttggtttccaatctgtaataatagatttagtactctcaaaaaatttattatgaaaattttcacttccagtaaaaacacatataatttatttctacccaatttctacttggtatttacatttgaaaattattctaatattttgtgacatttaattttccaggttgaacacataagatgcagacaaacctaatgtgctcatgacataaatatttgcaaatatgaaattctagatcaaaatgatcaaaacaatctgccatgccacttttgtttttaaaagttcaatgtgaagaattctttaaaaatttttcatattttcgatccctattagtccattatgaacatccctaaactaatgatatgaaaacatctctagtaccctctaataaatttacatcaaagtaaatgggcacagtaatctgagagtcaggaggctggattctagggttagttctgtcatgcacttgcaaagtgtctttgggtacagcacaaagcttctcagaggtccagactaactggctagctcaagtcctctccagtaaggactagagatttgtttctacagatgcacttaaggtattattcaggttaatgaccatgcttaaatgagcaattttattgtctcactattctagttcaatagaaagttacctgataacatgcaagttcagagggttaacatttttctactgtgaatatcaggagaaactaaaatagatttaggcattacagatgggattatgtcatcacactcggcaaacacagtttcctttctctggctttcaaaattacagacctgggtttatatcagcaatttacagcacttcccattgagagctaggcttgagtaggtaaccatgggtaccacccactgcttgtaaatagtgaagatctagataaaacatgtctgaccaccttccctgtgacataagagaacactagactacccctcagagttattttctctgagagaaaacaccaaatgctctaatcataacattttaaaatgctctttacttctaaccctgaacaagtaaattctaagaatgtttttgttaaaatcattaccattaccattcaaaagcatttgaatttttaggttgtgaaaaaaatattcttcaaacaaatgccaatgaattttctgatgggacaattcatttaaacctttgttacacccatttttagaccctgaggcccttcctcaatattgtattctttatatattcaggtagtacatacaaaacattatcaataattttggaaaataatacagaatagaaaacagaaagacccgcgatacgcttgtagtaatttaacagatgataaataaagtaatcctaataaataggaactggatagattactcatttaattgattggcatattttgatatttagtttttatattatagaaactctcattccatatattagataaaaatgtagaattatagttgaataaaaaataattaaaaatacagatgtgtatttaatctcaggttatacaattttttaaatcttaagacaacggaatattatagaggaaaataccagtagacctaactacataaaatcctatatattgaaaacatatcgaattagaaaaaaattaagataaatggagaactgggaaaaatacctgcaacaaacctgacaaaaagttttactgttcatgactgataaatgtcttaaaaatttttttaattacaaaaatttattcacataagttagtagattcatacaaataaatctaatgccctacaaaaaatggcaaagacataattcaattcaaagaaatacaaattattagtaaatatataaaaatgttcaatatcattagttatcaaatacaaattaaaacaaaaatatcctatcactcactagctgtatgttaacttgggaaggctagtaacagtctgttagttttctcatctataaattaacaatagtttctatttgttaaggtcgtcatgaggcctgtgtgagtcagtacagtgcagtgcatgatgcatgagtgctcaacaaatattagctgctatagttgctactttatttttgcctggaaaatgacaaaaataaaactgataatattcaacgctgatttgagtttatactctcatataccacttatacaattatgaagtcattcatgttttctaagaattattttggtaagattatcaggaaatttaaaaggtccaatcctttgatccaggaatttcacttctagtaatctatcataaggaaacaactagatagatggataaatatttacatacaagaatatccactatcactatttataacctaaataaagaacaaaatggaatggttaagtgaataaaggtacagttagatgtataatgtgtattatgaagctattacaaatcatgtttttaaggactacataatatactataaaatgataagtaacaatattagaataatctcaattttgctaaattattaatatgtatatacaaagaaaaagggcaggatgaaaaggtagtgatatattaacagtagttatctctaggatgtaagttttattctattctttatttttctatattttcgtaattttctaacagtagcatttctttcataatgagtaaactgaagaaactttaaaagttgagaaaaataagcccagtaattaaaaaatgtatcaactttgatatattcatcaatttctgaaaaccttttcaataacttatgcaaatatgtaaaatcacaaacactgaaattgaagaaactttataaattaggtcacccatttgttctttagatttctgttccacagagctagtatgcaaaacctagctggtatgcaaaaaatcgggtggtaagtatgtacactcagttgctaagacttatttatgatgatcagtgattaaaaaaacaattatattctttagccgttattaatccaaagagtaaaaatgaatattttcaggaacaataatttttacatggtatttaaatttcaatggtacaaactattagtccataaacaaaccacattattattgaaatttttagtttttttccgggcttatagagtaaggccagataggctcggtgtgtacatatgtgtgcacaggcacacgcatttgagtgtggttgagtggaatggtttccgcttactttgtattatttatgtcttttaaaaaatataccatagctactactacttccactattactaatataatttattaagagcttagttcttacagtacttcttaaatcctattatgaagtataatctaatatcctcactttagggatgaggaaacagccataaagcggtgaaaaaacctgtgtaaggctactcagcttgtaggtagcagggctgggatctggaccctagccatttagctccaggatcgaagttcttaatcaccacacaatataacttcacatattatcaactactatgaataaaaatgcaatataagatggcaagcatcaaaatcactcaggacattctaggttgcaaaagcactctagaatactgcagatcatagaatctgaagtgatttttagaactaagaaaaacaaacaagaagcaaaaaagtaaaattagtttctctaaaggttctttagagtgtgtatacagaaagtgaggtacggtgggcacagttgcaaaagtgtgtatttcaggagaaagtgtttgaagctaggggttggaaggcctgaatcttagctctggtttaatttaatttaatctaatgaatagcttgacttaggaaaattacttaagaaggtaagataccttctcttatcttctgtgtaggattgagaataaatgagaatacagaaaagaaacaagggccgggcgcggtggctcacgcctgtaatcccagcactttgggaggccgaggcgggcggatcacgaggtcaggagatcgagaccacggtgaaaccccgtctctactaaaaatacaaaaaattagctgggcgcagtggcgggcgcctgtagtcccagctactcgggaggctgaggcaggagaatggcgtgaacctgggaggcggagcttgcagtgagcggagatcgcgccacagcactcccgcctgggcgacagaacgagactccgtctcaaaaaaaaaaaaaaaaaaaaaagaaaagaaaagaaacaaatcaccaatgaaaaccaatatgccaaagagagtactgttgttaaccactgagtggggacggatggtgtgtgtctccacagcacacatgaatgtggtgttcacaggtgtgtggcaggtgactgatgtttatgccattctccctgtgtacttcctactccaggagctactacaattcaaagcattgtttgtactcttctccttcttccccagctaacatggctttaagtattcctttcttctatcactttaaataattcctaaggtgaaaaattcacttacaattctttatataatgaattatattcctgaaattgatcatgtcatttggtataaaattatttcagaagtcataaagtagacagaaagatgactcgctaaaagcagatttttaaatatagtatctgaattatgtttccatgtaaactattaacaatatcaaattattggtaaatggatatatatatacacattgttatgggtattctaaattagatgttacatttaaatatataccaaaaactctagatttgggatgacatgctatgaagacaaaatctctatgcttcataaatataaactagttgttcattggcattttaatttatgaagtacattttacattggaggcaagtcagttcagcctttctgtatgaaaatataggtgtcaatctatgattactataaaagcagtccacataccttttctcttgttaggagctgcagctcaaagccaaggtggcaaagtgtccccactgcagcttaaagtaccatgtcaggtcctcagagtggaccttagggaagtgaacatcagcatccccaatcatggtaagtttctaccatgagctcccttttttttttttttttagcagcttgaggtatgtgggagccaagacagggtggccgcgttattgacacacacagtctacaaatccatcccattttaatgagataatttttaactttaaaaggaagatttatgtattatataccctgaaacctgtgtcaccctggtcatgcaattcatgatataaaaaagcataggtagcctgggcgctgtggctcatacctgtaatcccagcactttgcgaggccgaggtgggtggatcacctgaggtcaggagttcaaggccagcctggccaacatggcgaagttctactaaaaattacaaaaattaggctgggcgaggtggctcacgcctgtaatcccagcactttgggaggctgaggcaggcagatcatgaggtcaggagatcgagaccatcctggctaacatggtgaaaccccgtctctactaaaaaacacacacaaaattagccaggcgtgatggcgggtgcctgtagtcccagctactcaggaggctgagataggagaatggcgtgaatccgggaggcggagcttgcagtgagccgagttcgcgccactgcattccagcctgggtgacagagtgagactccgtctcaaaaaaaaaaagaaaaaaaaattattacaaaaattagttgggcatggtggcaggtgcctgtaatcacagctactcaggaggctgaggtagggagaactgctcgaacctgggaggtagaagttgcagtgagctgagatcgtaccaatgcactccagcctgggcaaacagagtgagactccgtctcaaaaaaaaaaaaaaaaaaaaaaagtgcaggcatattcactcttgtagtgcgcaaattctcatagctgaagaaaatggaggagacctttccaggtggtggtcccctcctgaggaataataacaccttgggtgcccctctggggtggagtttgttaccatttgttgttgattttgtttgattgttctactagcggctaactgaaccttccaggtcatggcttgttttattttctagatgtatttaaattaagcattttaaaattgtgtcatcagttttaaaaagcccattctttatgtttattagatccaaattagcttaggcaatacctgaagctagcttaaagtgcatttttatcatatactaatactaacagtcttagattgtaaaagtagtaatacataagtaccaggttggacatgggggaaaagatatacacacacacatgtatgtaaatagtgtcatcaaccacgatggctctcaggtgatctgtccagtctattttaaaaacaaaaactttgaagagagaagcagctaccgcttctttttgaggaaataatgcagacttcatgattagggcattttctccttgtatcagatacattttcctttatgtaatcttattcattacttttagttaccattttaggttatttctcaaaaatcatgtttccctttgctatcttttaattgcttctagattattatcaaacactgcctcttttttcttctttttcccttccactgtctcaacctattcatcattatttgactgttttcgatggatttgatatttttaatctttcattataagttttttttcactctcagttggtttttaaattcttacttccaattatctcttatttttctcattcataatttttcatgttcatcttccttctggcctgtcatttaaaacagcttcacccatcatgtaaaagaaacttgatttaattatttcttttcaattataagacttcaaaaacattcatgcaaaaggatatattgctttaatcagcaatattaaaatcatgttcttatataagataaacttcaaatattaaaagtgcaaagtttcaccattacagagagcttctggagacatttataaaacatgttcttcctgttacacagagaatctatctacataattaacaacaactaaaaaaaataaaggatggaaagaaagcattctatttaactaaacataaggaaaaaagataatatagacaaaatcatgacttttatgaatagtaaaatccactcaggtaaaaatgtatactatgtaatactatttattttctcatttgtttatgtataatgttatacatatacattttcattagcttgttaaaacagagtatcaaaaaagtaaatttgactttcctcagttaggtatatcaaactttactttctgttgaactacttccttataaacagagtaggacttgaagaaatttctcttaacacaaataagatcttttttttaaagggccataagatgagcatttaattaaaacacacacacctgcacacactttctttagactgttgaaatatcaggtctttaattccccattaaaacaacacaaaaccctgattataagttttcaaatcatttgaagatgtaaaaggctgtctgcatttcagcttagttcaaagccagtaaagaaatatctcttcttcttccaactaaaagcatgtttaggagaaggatatctgatagaagtggtaatgccaatctaaccaattttaaaatataaagtgctactagcaatatttagatacatataatttgagaataacgttttataaacctaagctttgaaaaatagaaactataaacctcaacaaaaaaacttaatttgtaattgaaagaaaataatattttgtagaaaaaaagtgtccttccaaaaagagatgaaaatgactttcatttcccaagagaattatgccacttttatacaacaaaattacagtcaccacaaattgctttcaacaattccattgcttcttcatttgaccacttgaaaatcaaaattctttcatattataaatataactttttataactctgttattacgtactgtgaatggggaaagtgggccaatcctgtggctgtagcgtcgaatggcctctctgatgtggcagggctggatggcatcgctgtgagcctcaacaccacaggctgcagtgctctgcgacagaaaaacacataaattgttactaaatcaaaaacacgcaacagaactacagtgtataaatatgaaaataaacctttacaaaagagaccggtttttcccttaggatgcacatcactactgccatatactacatctaaaaaagaattccattaacaaatcaaagatgacttttacatgacccctttctagcagacctaccaaacgcaatttttatgcccacaatatttcacctaagcctgcatgtcaagacacaggagaatacagccacttgcctgcagataaaaagtgtcatgaaagcttactgaaagaaccacaggaagttatttttttaaaaaaaacattttaacatttattattataaacgtttcttaggagcttctttggcacatttctgaaataacttgagggtcatcaacttaaaatgaaaaatgttaaattatgatacatttatttatcatacctgggattgtcataagaccatttcaacttggtttctaattttctaggtatctcaggacaaaacaaaaacgaaaccaacaactttctgttttaatttgccgcatctgtaaaaggcaggtttgcaagcacaaaaagatacaaaaaagataaggattatttgcgatgagagtgtgaatacaaacttaagaaattatagatgtgtatatgtgtgttcagcatgatttttcaaaataacttatagggctagggtttagccctacaagttaccagctctgccaagatacataatatctcgggcctcggtttcctcacctgtaaattgggaaaacaattataattgcttgtaggactgttgtgaaaattaaataagttgaaatacataaaccacttagaacaatgcctgacacatgctaggaaattgttttatttttataaagagatgtttcattttgtcacctagactgcagtgcagtggtgtgctcacagctcactgaagcctcaaacttctgggctcaagcgatcctctggcctcagcctctgaagtagctgagactaaaggcaagtgccaccacatatggctaaaaaaaaggattaatttctttagagatatggtctcgctatgatgcccaggatggtcttgaactgctgggctgaagtgatcctcctgactcagcctcctgggtaatgttagctagtaatagtattaggttatttaaattaagtgttaaaaatgggatcgctaagtttttgaaatggaagctcatttacttcaaagtatagtaggtagcagatggcaggccatcaacattaaagaattaacttgcatattactataacgggtctagaagtcatttgtagtcacagaattaatattatttgtttttctgataattactgtatttttttgataattaatacattttttactcataattctttgtagggaatataactctatagatagcaacctctatggatagcaatttggcaaaatcttataaaaatgaaaaagaacaacctcttttactcagcaatttcacctgtaagaatttatcctacagatatattgcacaggtacaaaataatatatatacataaggatacttactatagtactaaatgttcattaatgagggattggttaaataaattatccattcaaagaaacagaaaccaaagcaaccactgaaaagaatgaggcagttccctacatactcctatggagctatctctaagatattatatgaaacactgatcaaaaactgaagtaggaggtttactatggtaagtctttgtgttcccctaaaatttgtacgttgaaatccaagcccacaaagtgatggtattaggataagaagcctctgggaattgatttatccacgagggtggagctctcatgaatggaattagttcccttttaaagagaccagggaaagaccactcaccccttctgccatgtgaggtttgggtgaacagatgactgcctatgaaccaggaagtgggccatcacaaaacactgaatttgccaatgtcttaatctgggacttcctagcctccagaactataagaaatacattcctattgtttataagccacccagtttacaggattttgttatggaagcccaaatggactaagatagaagctaagttagaaaaattttgtgactgccatttgtaagatatggagacacataagccagcctggctgaatcatgctatttttgccaaaatgtgacattaaattatattaaaataaaaacattgaattttgtgaaaaatgtcattagagtttccattttgccaatttcaggtttatctgccataattcagcaactgttaacattagcataatgaagctactaggcgcacttttatactttcttgatttgctcattgagttctccggaaggaagcctttaaacgttataatcccagttttttttttttccacctcaacaaatatcttcacattctctttgtctgtcaacatctagtcctttatcaaggtgctaataatctgttcaaattaaaaatgtatccaaagtttagaatttttaatatagcagtgattctagcattatattcttcaaaattgcttcagaagaattaacataaaatgtacatatttgttattaataatcttatatcagctataaacacgtgtgaagagcattatacttatacatcaattcatctttagcatcctgattaggcctaaattttatgatattctttaaattttcaaaaactaaacccaaatatttgacaaaatactgagtcctgtttatagagtatttgcagaaatctctctgggatataaactctgtatttctttaagaaaagtactagctgtttggaaaagttctccatatgtcaggtcctcttcctcttggctgcattcacactctattcttgtatccttccatttttgtattaatagttcttcaactagaaactgatgctgggtattagaagctgaaatagcatatggagttctacatattttccggatttggctgttgtctctctgcttttctctgccggtttacaatgaacaaaatatcttagcagtttaaactctcaactgtgatgcagaaagttatactgaaacttaggtttgcccctggatctctcactgaacctttttctcccaacttaaaaaagttcttggcagggttagtgtcctatcctttctcagccttccccttaccagagtgagtgtttaagaaggatctagaatctcaatcaactgcatcttattctttccacatctataatggtaaactagatcttctgctaaatgtaaaatcttaagtcttacagagaagtaacacttacctcagactagagcaactgaaagtctagtactactattactaacattttgcagaccacaaaagttgatatgatctggccaaggaagtattgtctttctcctgttacacacatagctcctccaaagtttcatccttatggagaatttttttcacatgaaggtgggccattcattggccaaaggatatagtgtacaacatatgtaattttctcatttaaaagtttgagatggtaactgttaaaatgtagttcttatataactagaaaaagcttttatttatttttttctttgtataaatgtatgcagtacaagtgtgattatgttacatgcatagattagagtggtaaagttagggcttttaggatatccatttcttgagtaacatagttactcattaagtaatttctcatcatctacccctacttactcccaaccttccaaatctccattgtctatcattccacactctacctctatgtgtacacattatttagctctcacttataagtaagaacatgcaatatttgactttctgtttctgagctgtttcacataagatgattgcctctagttccatccatgttgtaaaaaatattatttcgttccttatttcttttttgagacagcgtcttgctctgtcccccgggctggagtacagtggtgcgatcttgactcaatgcaacctctgttacccaagttcaagtgattctcatgcataagccacccaaatagctgggactacaggcacacctaccgcacctggcttatttttgtattgttagtagagacagggttttgccacattagccaggctggtatcaaattcctgacctcaagtgatccacctgcctcggcctcccaatgtgctggaattacaggcatgagccactgcacctgacccattcttttccatttctgaatattattccattgtgtatacatgccacattttctttacctattcatctgttgatggaaacttaggttgactgcatctttgccaaagtaaatagaagtgcaaataaacatatgagaggaggtatctttttgatgtaatgatttcttttcctttgactagatacccagtaatgagattgctggattgaatgatagttctattttcagttaagaaatagctatactggccaggcgcagtggctcatgcctgtaatcccagcactttgggaggccgaggcaggtggatcactagaggtcaagagtttgagaccagcctggccaacatggtgaaaccccgtctctactaaaaatataaaaaaattagccaggtgtgatggcacttgcctgtaatcccagctactcgggaggctgaggcaagggaatcgcttgaacccgggaggtggaggttgcagtgagcccagatcacgccactgcactccagcctgggtaccagagtgagacactgtctcaaaaaaaaaaaccgtactgttttcaatagaagttgtactaatttacattcccaacaacagtgtacatgagttcccttttctccatatcctcaccaacatgttattttctctttttaataatagccattctgattggtgtaaaatgatatctcattgtggttttaatttgcatttctctgattagtgatgttgagcatttctttatatgcctgttggccatcggtatgtcttattttaaaaaatgcctattcatttcctttgactagtttttaatgggattacttggtgtttttttgttgttgttgtttagctgtttgagttccttgtaaattctggctgttagtcccctgtcggatgcacaatttgcaaatgttttctcccattctgcaggttctttgctcactatctttttttttttttttttttttttttttgaggcggagtctcactttgtagcccaggctggagtgcagtggtgtaatctcagcttactgcaacctccgcctcctgggttcaggcaattctcctgcctcagcctcctgtcactatcttatttctttttccatgcagaagctttttagtttaattaagtcccattgtctattttttttttttacctgtgcttttgaggtcttagtcatgaattcttcacctagaccaatgtccagaagagttttcctcaggtttactttgagtatctttttatagtttcaggtcttatctttaagtctttattccatcttgagttgatttttgtatatgataagagataggggaccagtttcattcttctgcatatgctgatccaattccccagctcctttttctgaagagggtgtcctttccccagtgtatgctcttgttaacttaggcaaagtttagttggctgtaaatacatggttttatttctgggttacctactctcttccattgacctatgtgtctatttttatatcagtaccatgctgttttgttactatggcctcacagtataatctgaagtcaggaaatgtaatgtcttcagctttgttgtttttgcttaagattgttttgcctatttgagcacttttttggttccatatgaattttaggatttttttttctaattctgtaaaagatggggttggtattttgatagagattgcactggatctgtacaatgctttgggcagtataatcattttaatgatattaattcttctgatccataagcatgggatggttttccatttgtcagtatcctctacaattactttcatcgctggtttgtagttttctttgtagagatctttcatttcattggttaaatattactagatattttgttattttctttgtagtactttaaatgagattgccttcttgatttctttctcagctagattatcggtgaatagaaacactactgatttttgtacaatgattttgtgtactcaaactttgaattcatttatcaaatttgagaggtttttggtggaatctttaggtttttctagatataagatcatataatcagcaaacgggaataattttacttcttcttttccaatttggataacttttatttctttctcctgctttattgttctggttaggacttccagtactatgttgaataggagtggttaaagtgggcatcattgtcttgttacagttctttgagggaacgctttcaactttttccacttcagtatgatgttggctgtgggtttgtagtatatggcctttactactgtgaggtatattccttttaggcctagtttgttaagggtttttataatgcagggatgctgaattgtatcaaatgctttttctgtacctatttagataatcacgatttttgtccttcattctgtttatgtaatgtatcccatttattgatttgtgtatgttgcatccttgtatccctggtataaaactcactcaaccatggtaattatctttatgatatgctagtagatttggtttgttagtattttgttgaggattttggagtctgtgttcatcagggatattggtctgtacttttctgtttttgttgtgtccttgcctggtttggtatcaggatggtaatgacctcatagaattatttatggagaattccctactccttaattttttggggcaggttcaggaggactggtattaattcttctttgtacacatttggctgtgaatccatctggtcctgaattcttttttgttgggagatttttaaattactgattcaatcttggtacttgttattggtctattcaggatttctatttcttctgggttcaatattgggaggttgtatgtttccaggaatttatccatttcttccaggttttctactttgtgagtgtatagttgctcataatagtctgtgacaatcttttgtatgtttgtggtatcagttgtaatatctcttgttcaattctggttttgtttatttggatcctctctcttcctagttagtcttgctagcaatttaccaattttgtttatctttttgaagaaccaacttttaatttccttgatcttttgtatttttttttgtctttatttttatttagtgctgctcaggtctttgttatttcttctgataattctgggtttggtattttcttgcttttctaattccttgagacagaatgataggtcatcaatttgggatctttctgcttttttgatatataggcatttaatgctacaaacttcccttttgcaatgcttttgctgtataccacaggtttcagtgcgttgtgtttccattttcatttgtttcaaaaaatcttttaatgtgtcttaatttcttcattaatcccatgatcattccagaggatattgtttaatttccatgtatttttatgctttctgaagctcctcttgttactggttacagatttattccactgtggtctgagaagatacttgattttaaaaatctcttaagacttgtttagtggcctaacatgtgatatctatcttggcaaatgttccatgtgctcataagaagaatgcatattctgcagttgttgggtagaatgttctgtaaatgattgttgaagtccttttggtctaaagtccaatttaagtccaatatgtctttgttgacttctgtctcaaccatttgactaatgctgtcaacagggtgttgaagttgtccattattactgtattgctgtctatctctttaggtctagtaataagtctagtaatatttgtttaggtctagtaatatttgtttcatgaatctgagccttccggtgttgggtgcatatatacttagaattgttttagcctcttgctgaactgattcctttattattatgtagtgactttctttgtcttttttcctgtttttgatacaaagtctgtgttatctaagtatcactactgctgttcacttttgctttatatctgcatgaaatgtctttttcctccctttcactttcagtccatatatgtctttataggtaaagtgagtttcttgtaagcaacatatagttaaatcatgttttgttttttccatccattctgccaatctgtattttttaagtggagcatttaatccatttatgtcatggttaatattgataagtgaggttttgctcctgtgatattgttaattattttctagttgtttgataaattctttgtttctttttctctttgtggtttggtggaattctgccaaattgccatttgattcatttctcttccttctttgtgtgatattttataagacctgagaattttatacttttgtgtctttgtatgatggcgaatattaaccttttgtttccatgtttaggactcctttgagcattttgtgtaaggtcagactagtgtgatgaagtccctcagtgtttgcttacctgggaaaagctatttctccttcatttatgaagcttaatcttactgtatacaaaatttttggctgacagtttttttcttctttcagtacttcgaaaatgccatcccattatttcctagcctgcctgtaaggttttgctgagaagtctgctgttagtctgatggggttttcttataggtgactgaaaaaggttttctttaattaaaaccagaaaggtgtttaaggaaaaaataatagaggttcactaaattcaaggattcatacattattatctctggatgggacataagaatggtctattctaaatgtttccaactcctacacaattttatagatgaaagagtgaaaatacgggacatgtccaaggctacaacaatagtattacagatataactatacatcaaatttcttggcttgtaatacacgtagtgagtgtagagattttattattatatgcaggattacttgaaccattatagcatcatagctgaggtttccagtgagtaaaactcaaaatatagcaaaagtctgaatatagaaagaagtgtataaatgagtagaaaaataattaaagcctctgaagtggaacaatattaattctgatgccactaagttcaaattcaagagaatacagacatagactgggataatactttcctcaggaaaactttgttgtaaaataactccaatttaatagttttcaacaggatcgggaagaaatgtttaaatatacggagaaaaatgtaaagaatttctaaaaacataaaaaattaatttatgtatacatatcactaggttaattacaactccttctcacatactttgtgaatcaaattaactgaagaggtcttttaggtaagattttgttaccatagttttagctactgaatgagttgcagagtacaatagctgaaattcttacaaactttgaataggtaataaaaaaaaaaaccaagtatatgaaagcactgtagactgatcaaaaccagactgaaactggaaacggtagtatgtacttttagaagggaatgtcagtgggtggatttcctgtctttacagttttagcctaagggcagcatccagtgggtagaggagtggctaacatataatcttagatccttgataaacgagatgccagagttcgcgcaatcacagtaggtgcggaatgagaaaggaaatccccaaagggacagaatagaaaaagggggagccccaaattcggtgtacaaattttacccaaatatttttttgtgggtggggagagatggggtctcactatgtccgggctagtctgaaactcctaggctaaagtgatcttcctatctcagcctcctgagtagctgaaataacaagtgccgtcacgtatggctttccgcaaatcttttactaacccctaagttcttcctgtatggtatgaaatgcatgcaatctcactaaagcaaaaagaaatgaaaagacattctagttgctgccactgaagaggagttcaaagtttataggtgagtctagaaaagtaacttccctgctgaacacatataccaatgccactaccaccaccaccaataaaaacaatatattcacaggaataaaacagaatcctaaaatgcctatgatgtattactcacaatgtccactttacaattcaaaattaccagacatgcaaaacacaagaaagcatgacttatattcaatggagaccaagaaaattcacatatttaattttgcaatcaagaattttaaaacagcaattctaaccatgctccaaagcacaaaataaaatacatttgtaacaaacggacaaataaaaaataatgatagataaatggaaactataaaaaatcaaatagaaattttagaagtataaaatgaaatatcagaaataaaatattactagatgggtgtcacaatagattggagttgacagaaagaaatgtatagaagataaaagttcaatagaattgctccaatctgaagaacagagagaaaatattaaaagaggaattaaaaagcacctaagttacctatggaataatatcaaagtaactaatacaatgtacttggagtttcagaagtgaaggagagggaataaggcagaaaaaaatctgaagaaataactgccaaaaagtcccctaatttggttaaagacatacactgtctttgattcaagagattcaagattcaagaattttggtgaattttcggcaggataaatacaaagaaaaccatgtctatggatatcatggccaaacagctgaacatcaaaagtaaaaatacaattctgaaagcatccagagaaaacaacacattagacacagggaaacgataatagaaacctactgacttatgattaaaaacaatagagaaaaaagtggaatgacatcattaaaatactgaaaaataaaactttcgagacagaattctgtatctaatgaaacatcatccaacaatgaagaaaaagtaaagactttttcagaaatatcaaaactaagataaccatcactagctaacttgcactacaacaaatgttaaacaaaatttagcagaacagaaaagaaaaatgatacaagaaaactctaattatgaaagagaaataaagaacaatgggaatggtaaacaataagctcttttttttagttgcttctcagccttttggctaagatcaagtgaagctctatttttttctcttagtttcattaaaacgcactagattatttaagacaaaaattatggtattatggcttataatatatatagatgtagtatgcatgacaattatagcataaaggacctggacctatatatatacaagagtcttacattttatgtgagttaaacagtgtaataactcccaagtatactgaacatttaaggatgtacattgtaattcttaccatgactactgaaaaaaggatgcaaaaagatatcataaagaaatcaatatataaattaaagggaatttctaaaaaacacacaacccaaaagaagacaggaaagagaaacagataaacagtaagagaggaaataagcagaaaagaaataggaaaagttaccctatatctgaccacgtgacttaatacatcaaatatcacagaattatggactacaattaaaagatacagatcgggggagggcacagcagctcatgcctataaaagcactttgggaggctgaggtgggtggaccgcttgagcccaggagtttgagaatagcttgggcaacacagtgaaaccctgtctctacaaaaaaaaatacaataattagctaggcgtagtggtgcatgcctgtagtcccagctactcaggaagctgaggtgggaggattgcttgagcctgggagattcaggctgcagtgagctatgatcatgctactgtactccagcctgggagacaaagcaagaccctctctccaaaaaaaaaaaaaaaaaaaaaaagaaaagaaaaaaagatacagacagacagaaaggaggaataaagaagcaagacccaattatttgctgactataagagatgactttaaatatattatatttatctttcaatacaggcatacctcactttattgcactttgatttattgtgcttcacagatgttgtaagttttgcaaatttaaggtttatggtaaccctaaatcaagcaagtcttatcagtgccatttttccaaaagcatatacgtgtccaactttatgtctctgtgtcatattttggtacttttcacagtatatttcaaatattttcattattattttatctgttatggtgatctgtgatctttagtgttactattgtaattgtcttggggcgccacgaactgtattcatatgagatagcaaatttaataaaagtgtttgttccgactactccactgactagctgttcctccatctttcttctctcaggcctccctattccctgagacacaacaatactgaaattaggccaattaataaccctacaatggcccctaagtatttcagatgtaaggaagagttgcatgtctctcactttaaatcaaagcctacaaatgattaagcttagtgaaggaggcatgttgacagccaagacaggatgaaagctagccctcttgccccaaatagccaagctgtgagtgccaaggcaaagttcttgaagaaaattaaaaaatgctggtccactgaacacacaaatgataagaaggtgaaacagccttattgctgatatggagaatgtttcagtaggatgaatagaagatcaaactagccatgacatttccttaagtcaaagcctaatccagagcaaggtgctaactctctttaattctgtgaaggccaagagagatgagaaacatgcaaaagaaaagttagaggctaccagagactggttcataagatttaggaaagaagccatctctataatataaaagtgcaaggtgaagcagcgaatgatgatgtagaagctgtagcaagttgtcctgaaggttaagctaagatcaatgatgaagatggctacatgtaacaacagattttcattgtagatgaaatggctattagaagaagatgccatcttggccattcatagctagaagaggagaaatcaatgcctggcttcaaagcttcaaagctgactctcttgtcaggggctcatgcagctggtgattttaagttttagctagtgttcatgtaccattctaaaaatcaggatcctgaaaaattatgttaaatctattctgcttatgctctataagtggaacaacaaagcctagatgacagcatatccatttacagcatggcttactgaatattttaattccagtgttgagacctactattcaggaaaaaaagattcctttcaaaataattactgctcattgacaatgtatctggtcacccaagagctctgctggagaagtacaaaaagatgaacactgtcttcacaatagctaacaaaatccattctgcagcacagttcaagaaataatttcaactttcaagttttattacttaagaaatatatttcataagactattgctgccatagatagtgattcctctgatggatccaaggaaagtaaatgaaaatcttctggaaaggattcattattctacatgccattaagaacatctgtgattcacgtgaagaggtcaaaatatcaacatttacaggagtttggaagaagctgattccagctatcacgaatggctttgagcggtccagacttcagtggaggaggtaactgcagatgtggtataaatggcaggagaactaaaagtgcagcctgaagatatgactgaactgctcaatctcatgataaaacttgaatgggtgagagttgttgcttatggatgagtcaagaaagtggtttcttgagaagatgtctatatctgttgaagatgctgtgaacatttttaaaaataactacaaaaactcctacaaaggacttagacttagttccataaacttagctgataaagcaatgtcagggtttgagagaactgactccaattatgaaagaagtactgctatgggtaaatgctatcaaacaatatcacgtgctacagagaaatctttcaagaaaggaagagtcaatcaatgtggcaaacttcacactgttgtcctatcttaagatattgccacagctaccccaaccttcggcaaccaccaccctgatcaatcagtagccattaacatcgaggcaaaaccttccaccagcaaaaagattatgacatgcaaatgactcagataataattagcatttaaaaaataaagtattttaaaattaaggtatgtacatgttttagacataatgccattgcagacttatagactacagtatagcgtaaacataatttttatatgcaccaggaaagcagaaaatttgtgtgactcgctttattgcaatattcacttcaatatggtggtgtggaaacaaacctgcaatatctctgaagtatgcctgcagaaacatacaaatatattgaaaggaagtggatggaaaaacatattatgtaaacagcaatcacatggctggaatggctaaatcaatcacataaacagacttcatatgtacagcattttcagtaataaaaagagatatttcataaatataaaaaagagagaaaatccatgttcatggattgtgagacttagtattgctaaaacatatcccaaactgatgtaagcagtcagcctaattcctttcaaaatcccaccaggcttttcttttttttctttttctttctttggcagtaactaacaagttgattctaaaatttacatagaaatgcgaagaacacagcatgtccatattaagcttaaaaaataacagagtttgaagacttacattataatcaaataaacacaaatgaaactccaaaaataaatccatttagatatattgttcaagcaatccaatgggagaaaagagtctttcagcaaatagttctgcaataactagatatccataagtaaaaattggatttggcttcaactcatacaataaatggattttaatttgaccagattaatagaactaaatacaaaaaccaaagagataaagcttctagaagaaaacacaggacaatatcatcatgacatgggagtagccaaaggtttcttaggacacaggcaataaatataaaagaaaaaaattgtgtaaggaagggatccagtttcagctttctacatatggctagccagttttcccagcaccatttattaaatagggaatcctttacccatttcttgtttttgccagatttgtcaaagatcagatggttgtggatgtgtggtattatttctgagggctctgttctgttccattggtgtatatctctgttttggtaccagtaccattctgttttggttactgaaactagatcccttccttacaccttatacaaaaattaattcaagatggattaaagacttaaatattagacctaaaaccataaaaaccctagaagaaaacctaggcaataccattcaggacataggcatgggcaaggacttcatgactgaaacaccaaaagcaatggcaacagaagccaaaattgacaaatgggatctaattaaactaaagagcttctgcacagcaaaagaatctaccatcagagtgaacaggcaacctacagaatgggagaaaatttttacaatctacccatctgacaaagggctaatatccagaatctacaaagaacttaaacaaatttacaagaaaaaatcaaacaacccaatcaaaaagtgggcgaaggatatgaacagacacttctcaaaagaagacatttatgcagccaaaaaacacatggaaaaatgctcatcatcactggccatcagagaaatgcaaatcaaaaccacaatgagataccatctcacaccacttagaatggcaatcattaaaaagtcaggaaacaacaggtgctggagaggatgtggagaaataggaacacttttacactgctggtgggactgtaaactagttcaaccattgtggaagacagtgtggtgattcctcaagaatctagaactagaaataccatttgacccagccatcccattactggctatatacccaaaggattataaattatgttgctataaagacacatgcacacatatgtttattgtggcactattctcaatacctaagacttggaaccaacccaaatgtccaacaatgatagactggattaagaaaatgtggcacatatacaccatggaatactatgcagccataaaaaaggatgagttcatgtcctttgtagagacatgtatgaagctggaaacatcattctgagcaaactaacgcaaggacagaaaaccaaacaccgcatgttctcactcataggtgggatttgaacaatgagaacactgggagacagggtggggaacatcacacaccagggcccgttgtggggtggggggaatggggagggatagcattacgagacatacctagtgtaaatgacgagttaatgggtgtagcacaccaacatggcacatgtatacatatgtaacaaacctgcaggttgtgcacatgtaccctagaacttaaagtataattaacaaaaaattaaaaaaataaataaatgcaagcggaatattgtcaaaaaaaagaaaaaaaagaaaaaaattggataaattaggcttcatcagaaacttaaaatttctcagctaacaaactgagagaaaaatatgtgaaaaatatgtgtttgatacaggactgttgtcacaagatatgtaaagaactacaaactggtaataaaagtcagcccctttgcctgcaaaaaaaaaaaaaatgggcaaaggatttgaagagacacttctcagagtaagatacataaatggccaatcaatacattaaaaagtgctcaaccttatcagtcatcagagaaatacacacttaaactgttatcagaaaatatccactagaatggctaaaagtaaaaatgacaatgccaaatgttgatgaagctgtggagcaactggaactctaatacactgttggtggaagtataaaatggtacaacctgtttggaaaaaaagtctgtttctttaaaaaccaaacacatgcctaactctatgacccaacaatttcattcactgccatctacctaagaaaaacaaaagcatttgtccttccagacttgtacagtaatattcatagcaggtttattcataatacctcagaaactggtgacagtccagatactcaccaacatgagaatgcataaactgatatgttcaaggaagtctgttctttctttatggagaagtacttttaaatagttgaagacttatctttcatagcctcttctctttaatggtcaaacacctcaagttcatcccagcagttactacaagaaatgtttttcagtttcttcagacacctgccccctttcccattactctcctttagacatgctccactgtgtcaatgtccattctataggatgatgcccaatactaaaaaaattccttatcagtcacatcacagtattggctcctaagaaattcacaggcaaataaaaatctcaaaatcattttaatgtatggtattattaatctacattttcctcatcatcaatcataccaactgcactactggcccacaattcttcataatgtattttaaaaaatagccgagcatagtggtgtgcctgtagtcccagctacatggaaggatgaggcagagagatggcttgagtccaggagatcaaggctgtagtgcactatgatcatgcctgtgaatagccactgcactccagcctgggcaacatagaaaatctagaaagttaacttgaattaatattaaacttgctaatctagtaagaacccaagcttaaccagcccagttccttatatggttagtgctcaagaatgataccccttaaaataaaatgcactgtgtattaacccacatcttgagtttccaattctaatccactgtacatggcactaccatttggatctttttttttttttcctcttgttttattttttattattattattttttatttattttttattttttattatactttaagttttagggtacatgtgcacattgtgcaggttagttataccatttggatcttaaaacacccttttgaactcctcacccttcagccaagaaaccatcaacaattcattccttcctaactctagcagtctaagactctatataatctgagccttaattttctaatccaaatgcctactattcctctttaatgaaccttaatccttgaatattttaaacagcgttgggtttttctccttctaaaatggtacttatgctgtctttgagtcctagagtattatcctaacttctaccttatcatagtcctatttttcttttaaccttagctttctctctaaagtctttgactgcaactagagaaggtttttttttttttttttaaacttctgtattttctgtctgagtcactcatttggaaaccagtatatgccatcttaaactgtttgttcaattatttgcttatttgttttacaaaatatcctgtctccctgaacagagatcacatcagtctccagagtcccactttggactcaatttggtatagtatttgatgtacaggcccttgatgttagctgctgattttgtcaagtgataaagggcaggaaggaagacttccagtctctgaatattcatcttgactaccagtcacaggaggggaggggtgtctgccagccagaaaaaagtttgaggcttatactaacatattttgtcaggaggctctctgacactcatgctcccacctcccagagagcccaggaaatccagcacatataggatattcctctcaactgctgggtagctgggaacagcggctgcggttgctgagcagttgcctagggcagcttggccaccctggagaaccaagaaaagaggggaaataaagagttttcctaggcatgcaagcaatcacttgaatgttaaaagaaaactaggcccgttgtgttcacagtaaattttctcaattagaaatgttataacaaatttgtctgatgttaatggaaagcatacttatacacatattcataaagtgaacaaacatcaaagacattttaaagggggttttttgacatcataatttgggtttgtaacataaagaaaacaaatagtgattaatcaactaagtaagctttagggacttttgtatgttgactgataatgatgtatgaccttttctaagaaaaaaatggatttttaatgggcataaacattttaatccctatttggtttccaagccaatttgattttccaaggggcataagaaaatgttgaattgtccttttgtttgtaataagatgctatatgggcatatatgttaacatattttctatgtatcctagagcagagaaatttaaacctagggtccatagggttcacagatcccttggatccatagaatggcttcagaatgtctctgaacaatctgaaactgtaggcaaaatttgtgaatgtgtttatagaaaaagggtttatagttttcatcagattctcaaaggggtgtgtgacctaaagaagattacaactacttcttagaaatgatttgaaccactatccttgcctatagatatttaacaaggagtagaaatgtgtaatcaaggtatggctataaaacagagcttagccattttcaggttatatatttcaaccaacttgatccaaaacgtacttcacaactctacatgtagatgcgaacttaaccttcttgctgtcttatctatggatattcgattgaattacgtgaaactgctgtttttgttagtgaaaagggtcgaatattggcaaatacattcaagacactgcaatacatttctggttttgaggtagatgctgtttacagaggagattctgtatactaaaagtggtgcacagttattatacagagccttaaaattggaaagaaaactttacggttcccatagcaaagccagatcagaaaagaatataattttcacatagtaggggcaatctaaaaactcaagatgaatgaagacaagcttctttaaatcatttttagagatgaatcaataactgaaatggaaagttatcaataaatgccagggattattttgtgaataataatgataaccctcttatcttttgaagcacaaagaaataaatgacttttccaacattacctaaaccagtttttcatctcccataaaaataagaaatgccttgcaactatccctttcaatgaaggggtaggaaagctaagtgaagcaagaaaaacgtgaaaaaagtcattgtcttaagtggactgtcagggcctggcacacagtaggtgctcaattaaatacttatttgaatgtctaatgtattaagattctttgactgaaggttatacactcctgcataatctttattaaagaatcactaatgtaaataccagatatgtgtcaaaattcacaaatgttttaagacagattttttttgtacttacctcagcagagttgtgatactgaatgaaggttgcagaaatggcatggctgaaggggtcccctgccttggttaccatgtcttgcctcacaagaagagccagatccactaactagaagaccagaagaatgaaagtcacatagctagaaataatcatgaatgccactgaagtggcaaacctaaaagcaatacattctgaatgttactgataatcctgcttgcctaaaaatctatattgtagacatgagcacacactttcattgactggtgaatggacctagtcatgatatattctgactttttaggagagtagttctcaaaatttatttcacagtcactagtgcaaatttctgggctttaagtccagagattctaattcagtaggtctgttttaagcatatagtctaggaatttgcttattttattttattttattaatttttgaaatggagtttcgctcttgttgcccaggctggagtgcaatggtgcgacctcagctcactgcaacctcggcctcctaggttcaaatgattctcctgcctcagccttcctgagtagctgggactacaggtgcccgccaccatgcccggctaacttttttttggtattattagtagagatgtggtttcaccatattggccaagctggtcttgaactcctgactgcaggtgatccacccacctcggcctcccaaagtgttgggattacaggcaagagccaccgcgcctggccagaatttgcattttaaacaagaaccaaggagatgctgatgcctgtggtctaaagaccacatcttgagaaagtcttttagagggcgagattccagacccagaatttggtaagtactcctaaattctcacatacgtagaaaggtgtttttcaaagctcaaaaataatctctaaacaaggcagatgtggatttgagttcaatgtcaagaaaaagcatgcagggattccatttctcattaagataaaggtacaagaactcttttttatcctagcatccacttgaattgaggatgcagagacacataactgaactaaattttagaaaatgatgtaaatgccacaggagagaattcatggctgttattactggtagagcagcagggagaagaagaattgatcatgggcagagataaagaaaaaccagccagtgtggcccgatatgacagattagaattcttacctgtgccacagtttcatacgctaaatatgctaagatttccattgcgacaacattgggttttatctccatactgctgcagtccaaccagtctcgaaatttggaagcttttttggctggccatttaaaaaaaacaagtgcagaaattttaatttttaaagtgttttaatactgcacattactatcacaaaattaaaaaagtatactcagaattgtacacaaaaaataatgcacataaaatgcataattaatgtctagatattctggccccaagaaatccaagttttaactctcagttataaggcaacacaatggttgttttcaacaactctcttacgtatttgggtcttttattttacacctatgctatatgacatagtatattaaagcatttaatgtttaatacttctcacactgtcagatttaccattggctaccgctcatgttacaacaagaagtcagaagatgttcttgtctgatgtaaccttaatttactcatatagaaagaaaatcttgcaagaaagaacctgtgatgaaaaaagaaacatacagaaactattgctaatatttttcaaaaatattctctagtctcagaagaaaatggcacatagcaggcaggattaacttgcagctcccacttggatgggtagagcagcacgtggagacccacactgtgaacttttgctccaagaactaccgtaggaatataccaggaaagccaagagccacagaccccttgaaggaggtggatcaccactgcaggctctgtgggacgcagaggaactgtgagtaggcttgctttctcagctaggaagccggtagcctggggaaagttctcagccctgctcaccagctgcctggaaataaagttggtgctgttacgggcagagggcatggtggagtgagaccggcctttcgggctgtgggctgcatgggagctgggtgaggcctgcggctgctggctttcccccacttccctggcgacctgcgtggggcaacagaggcagccataatgcccctggcaacggtaactcccttgttctagaagccacaccctcatcccccacaacagccacagcaagccccgcccaagaagagtctgagctcagacatgcctaaccctgcctccagctcatggcaacccaaatatcctatactctcacttataactgagagctaaactatgaggacgcaaaggcataagaatgatacagtggaatttggggactcaggggaaagggtaggaggggggtgagggataaaagactgcacattgggtacaatatacacactgctcgggtgatgggtgcaccaaaacctcagaaattgctactaaagattcatgtaggctgggcgcggtggctcacgcctgtaatcccagcactttgggaggccgacgcgggccgatcacgaggtcaggagatcgagaccatcctggctaatatggtgaaaccccgtctctactaaaaatacaaaaaaaattagccaggcatggtagcgggtgcctgtagtcccagctacttgggaggctgaggcaggagaatggtgtgaacctgggaggtggagcttacagtgagccgagatggagccactgcactccagcctgggcgagtgcgagactccgtctcaaaaaaaaaaaagattcatgtaactaaacaccaccggttccccaaaaaacctactaaataaatacgtttaaaaaaagtgtctaggtcgggcgcggtggctcacgcctgtaatcccagcacttcggaaggccaaggtgggcagatcacgaggtcaagagatggagaccatcctggccaacatggtgaaaccccatctctactaaaaatacaaaaaattagctgggcgtggtggtgcgtgcctgtagtcccagctactcgtgaggctgaggcaggagaattgattgaaaccggaaggtggaggttgcagtgagccgagatggcgccactgcacaacaagagcgaaactgtctcaaaaaaaaaaaaataaaaaaaaaaaataaaaataaaaaaaaaaaagtgtctattaccagaatggctcaaagttgtaaatttaaagttaaataaactgacatctggtctaatctaagcctgtggttacattttttccggttatgaagatgtctaaattcttaagcctgactcaaaaccatccagactgattccaagcagcctttaagatatttccctattaaaccatcacctggccttgagtcttttcctctgtgtgtctactcctactcctttccttccatggaatgctctgccatcactcttcttcattcatatgaatcttgatcatacaggccaaaggtatacttccctactctagccatttattgaacactgataccatcagatattctttcacaaatgcttataatttcttaagccatattacaaatttttgtgggagaagaccatgccttatgtctctgcatgtgtaatagtaccaagcatatacagaaccaagcgcgtatgtaacctttagttaaatatctctacactgccacagtgctaagcagtctaatttgatatagggacttcattagacattattcatttaactagtaacctagagggaaagattgatagtgaagattttatgaaatctgtaagattttctttataatccactgattattcttttgattaatctggccccacgggtctataaaacacttaatagtaactcaaagcatgatattttgatccttctatatagaatcttcaggattccacatacagaagagttctcttttaaataaatcatggaaaacattaagtcctgctatcgaagcatatacccaaagctgtcaaatatggcagaattatgataatcccccttaaagctatctccccaacgtaacaaatcttccaaatactttctgacatgcaacattccatctaactagtatgctgcgatagctcacaaacacttgtttaacatctgtggaatacttctaaagttaaagttaacaggcagcaatttggcaagatcaatgagatgtacattaatcacttatctccttgacagatctttaggacagaaacagatattttgtgactgtgctctaaacagttgattttaaaagtgagggaaaggatcattattaatattcagttggatctatccacataacagaattagcttccttgctagattgtaaccaccgagaatgcagggacaaggaccatatatctccaactgtatccctagcacctagaatactgcctggcattagcagactcacaagaaatatttccagaagaaatgaataaatgaatgaagtattttttaaataaaagagtagagtccaaacttttctattcatcaaaagacatgcatagaagtccaaaaaccacttgggttattgctgttccaccaagtggtggagattctttgagagctaattccttccctgtcatgtggagaaggatggctttagagcctcacccttccaaggtattgttggttccagcaaaagaggcacagatacctgtagttaagacagtttgttttcatcaagaggtgagaggggcctcagaataaacaagttccttctccttcgcccctcttcccaacgtatcaggagaaacgataacctggaaattgactaacaaacagaatcctgagcaatggtcaaaagttcctaggattattagcattgtaatactacctggattttcagcctgcgctgaacttaaaaagcaattttacatgataatttcatatggaaatttaaggttaatctcacatactttttatctttcttatcaatgatcactaacaaaatttaagtttcttgcaatattccattctctcatgcctgcatactattcagtgatttctatcccatcccttcccaacagtctttccattcccagtcctttccttagggtcctctggaatgctcattccactcagaagaaactactttgcaacttcaacctaattgaaaatagccttcttcagagggcatggttttccctggaaacttccctagcaggagttccttattcctttcctttatacatatttatgggcaactacttgggccagtgtgttcatttccccatataaggggggacctggcgtcaatgtcttcattctcttagtttcttccacaggaaacatacataataagtagactgacagcaaacttctaccaacaacaggggccaaaagacaagggaatcatgtcttaacaagttaactatcagcttaccatttcctacccaactaaacaatcatttaagtatgggggcaaaataaagacatttaagaaaaaaaaatgggtgtttttaagcttgtacagagctgtaggaaaaaatgacattaggccaagaaggaaagtttaagtacttatcaatggtttttttttttttttttttttgagacgagtctcaccctgtcccccaggctgatagtgcaatggcgcgatctcggctcactgcaacctccacctcccgggttctagtgactctcctgccttggcctcccaagtagctgggattacaggcatgcaccaccacgcctggcttgtttgtttgtttgtttgtttgtatttttagtagagacagggtttcaccatgttggtcaggctggtctctaactcctgaccttaggtgatccacctgcctcggtctcccaaagcactaggattacaggcgtgagccaccgtgcctagccaaatatttaacaattttaaaaactttacgtcatggatgtatatcaaaaaaaagatagcaactgaaatagtacaaagagaatataggacttacaaacttgcagaggaaaaagaaatgaagaaaacccaatcaatctaatacaacatagaaaaggaggagaaaaagcaaattaaaaagcacagaaatttaaaacacaagacagcatatacaatatcagtaattaaatccatataaattaatcaattaaaatacacagagcctctctgattacaaacaaaatctagataaaaccaaatataaaataaaaagttgaaagtaaaggactggaaaataatttaccaattatacattttaattatagattataaattttaatgatttaaattattataaattattctttatgattatgagctttgtgtgtcaatattaatatcagattttaaaagactttaagagaaataactctctgacttatatacatatgaaaacaaaagactgaattgtgaattagattagtgtgccgatgctacagcttaccctcagcctataaagttacagactcattattttaaaatgtaccagtaattccagggatggctatgatcaaatacttaagaagatacatatggcaggaccacaattcctgtatcttggtaatttattagaaggagaagaatgaaaagagcataacactctgacgagtgcaggaatagcttctgaatttgctgacccacgtggattaaagcattctcaaccacagtattttgccatataaaacagatttccccaccaaggtttcataataaaacacctatgggcaccatatataaatagttttaaatgaccaagtccttccactctaaagaaaagaaaattaaacataatacactgtttatactatagttattttatacagaaagggaaaatattattttttaatctactatagtttattattgagttaaaaacaaaacatgggccgggcacagtggctcacctgaggtcaggagttcaagaccaccctggccaacatagtgaaaccccgtgtctattaaaaatacaaaaattagctgggtgtggtggtgcacgcctgtagtcccagctactcaggaggttgaggcaaggagaatcacttgaacccaggaggaggaggaggaggaggaggctgcagtgagccgagatcgcaccactgcactccagactgggcaacagagtgagattccatctcaaaaaaaaaaaaaaaagaacaaaagcaaaacaaaacaaacaaaaacaaacaaacaaaaaaacatgaagtaactgaaaatctgattttcaaagagaaggcatattaggagactttaagattatgagtttcagtgtgaaagtagtatgtctgttcctttaagtgaattaaatttaaaatataatttaaaaaaatagttcaattgcactaaatgttactttataaactggaggttgatacttataaagacttgaatgccatttttaaacctaaaaattacaatacaaaacctttcatttgctgaaattgccatgatctgaagtgccatttacttaatgcttcacagatgtatgatgccaagttgttagtcaaattggaaagtatatttagtcagaaaaaaaaaatcttccaaaacatgttttcctatattttactgacatttacatgggatactatgcaatgtgtcatttatttgcactttataatctataaatgaagctctccctttctttttccaaatcaaatatgctgttattgggaccacataatagctttccatttaaagacaccattgtttctataatccctcagaccatggtcatgtgctactttgtcatatttttgactggacttttcatcacactttcttctttgacctttaccccgagagccttagtcacaactgaaactttgctgtaaggatgttttgctacacaatctagctcactattacgagtcattatacactttcaataagctgatgtgcagtgatgtgaaagtactaattttaccacgaggttactagtgttactagagcatgtactaataaatttggctaacactgaatacatgccacggtaggaggttagacaaaaatggaagagaccagtgatatgttcctttgtggtaatgagtatacataaaggaaaataattaatattagggtcctttaaatgtcatgactactattagagtccattacggatcaaatgcaatcagaaatactagtgtaaatatgactaggaaactagaaattaaaatggaaatactaagacaatggaatttttatgattaaaagtactgtaaataattaccatagcactctgtatattaccagcaccacttaagacctcttaatgttattaactgcaaagcagtagaatgtaggaaaatcatttataggctccccacaatgtagacgttgtttgtatagcacttacaactacacatatattaaatccaccaatttctaagaaacagatcctgtcatactttagtacatctataacacaaatctcttatgcatataattaagcaaagttaaatagttacttacagaaacttaattgtcgactttcacagaattctgcatattgagctgaatccataattcgagtttgtctttctgctctctaaaagataaaaatacataacattttttaaagcaagcagattattatatatgttttcacagcttaaacttagaattgaagtaccattttcctttccttattccaggtgaacagggtagtactaccacatagatcacgatacataaaatcacaataactaacactagttgtgaagctggtgtcttttggaaataaagtttaaatattactttctgctcctttgttattgaaactaaaactaaaggacctcacgtctaaattttctgacttgtatcatccttttaaagaaaaagaaaatgatgagggaataataaaccaaacagaaaaactgttacaaatattattgtcaatctgctttaaagctgtgatgttcaatgttaaacaagaatcagtgaatggaatccatatattccctttcagtcagaatctggggccacagttgacaaatccatattttagattgcaagaaaataaagaaaaaggtaaacacaatacagatcctttaatctgagtccaggtatgattcatttggtatagtttcatttgtggagtttttgattcagtatagcagatgtttactgcttcactgtcccacaagaggtaggataattataattcatccatagtttggtgggaaagaatatgaccacttccgcttccttggtaaggagagcattttgaaatgagacaggctggtacttcttggaatgaatttctgcccagcgaagaaaaaaaaaaatccctgagatttaattttttttttctgttgtggaagaactttcagcaagttacctttaccatcgttgtcagagcacataagtaccatttcttctaatgtctgtggatgtttttgtatttttgaaatagaaattattcttttttcttttatttgtgtgagtagtcaattccaatgataggtcagttgatggaatgaataatggtgtactaactggagcttaatagagaatatagatggggcagtaggagttaaggtaaaaattactagtcactaccgtggttccttctaagaccaatgactgtttttccccttccttattttctgtctcccttttttctttctctccctctctcccttccttcattccttacctcccacacatccacatactcacaaatccaagtctatcttggttatttacccactaggttcaagtatactttttgggcatatacaaacattttatatatatacacatataatgtatatatgtatgtgtatatatatacacatataaagataaatatataaattatatatgtacacatatacacataaatttctttttttatatatatacacaaacacacatatatgtatatatgtatgtaaacatcttcttgtgcatgtgtcagaaatatcacgtctcggctgggtgtggtggctcacgcctgtaatcccagcacttgggaggtccaggcaggtggatcacttgaaggcagcagttcgagatcagcctggccaacatggcaaaaccctgtctctactaaaaatacaaaaattagctggacatgggtctgtaatcccagctacttggaaggctgaggcaggagaattgcttgaacctgggaggtggaggttgcagtgagctgagatcacgccactgcacaccagcctgggtgacagagtgagactccgtctcaaacaaacaaacaaacaaacaaccacacaaccacgtctccttaagagtatattattgggttaatttttatttacttggaagtattttttgatatttaaatgcatgatctagttttagccctctttttaatgtatctgacacatgactcaataaatgtttcctgatgaaaataggaagcaagaaagggagaatttatttatgtgttttgaacattacaaaaaaagttgcagctgggcacggtggctcatgcctataatcccagcactttcgaaggctgaggcgggtggatcatgaggtcaggagattgagaccatcctggctaacacggtgaaaccccatctctactaaaaatataaaatattagccgggtgtggttgcatgcggctgtagtcccagctactcggaggctgaggcaggagaatcgcttgaactcgggaggcagaggttgtagtgagccaagatcacgccactgcactccaccctgggaaacagagggagactccgtttcaaaaaaaaaaaaattgttaatgtgtttatttaaataaactctctaagactgataatactaacgttaatttgtatctatgtacgtatgtttgtgtatatatatctgtttgtctgtgtctcactatagcaggaactactcacgtttgaatttctagctcctaggaaaatatctgacacatggtaaataagcaataaacatttgttggatgaacaaatgcgactgttttattccacagggcaaatgactatcaccataatgaaactagatcgagaatgattatctaatgattcctacataccatctctgctgctctccagcttggtagcctcctccaaccaataaatggctggacagaaaagatttggataactatggaaaaagaatgttcctaaagggattcttaacactaactttttcttccaccaagttggacaaccaagatttggcctctgcatatatgcttacatagctgatgtattcgcaataagtgtttctagaaatgagaggtagcaaaatttgtcgtcagaggttaaggttgccaggattgccagctacaatatttcaaagatatccataaacatgtgaaagactaaattatggcaagcttcattcctttcagacaccctctccaatgcctattctcttttcttcattaagcatcctagttcttttttaattcctccagcatcgaagcagtaaactttgatctgaggagccccacaaatctgaccctagggtatatataagaagccatttatccagtgcctagcacacaggaaacactccacgcaaagcagctgactcaacagcaaagacttatagacaatacaaaatcatggcttagagatagaaggcagcttaaagtttatcttgttcaaatctcttcaattcaaagggaattgaggctcagagaagtgatttgtcaaaggtggactaagttagaattcaagctcaggactcccaattcctaagtcagcctattttcattataaaaagctgtcttcaactaatggtaattttttattccaatgttttcctttgggatgctctaaatttcatatattgtcttactaaaacatgtcatgtagctcctacaattaacatgctcaaactattcttaagaaaaagaaattagcgaggccctgggtcagcaaatgacgtacaagctgggggtaatctaatgaagagtgtagaaactgtagtgtatctgatagtgcaagcacatcacaggtgtgtagagatactgattccattcactctctggatgctgaacgaagctgaggcagcagaacccctaggctggtatctgctaccagctgccttgtccatttaccttggtgggtgataaaaatattatcattttctatgtgtgccatgatgtgagaaagactggaagcactgtactaatactaatgtccttgaatattatatgatataacacatgaatggtattcacagcatagtcaagggagttcatgaaatcagagattctttgagctatatatgcactgacttggatttgaggatgatgaagatgatctggatatgcttatcacctaatttttgtttattcctctctcttcccctgaattgtttaaaaaaaaaatggaacaaattttggccaatgatgaagatgatttggatatgcttatcacctaatttttgtttattcctctcttcccccagaattgtttcaaagatacaaaaaaaaaggaacaaattttggccatatgatccaaataattcaacatctgagtattatattttctcctgtccttccactatcatcttaaatactgagaaagggagtaaatatctaactttcatgaactgtatgttctccaaatacaggaaccgtgctgctcttctagagtgctgaggcaatgctttgcttggatttgcctgggcctcactagctgaatcaagggacagatgaatggatggactaggacaaaagaaatgcgtttaagtacgtgttgaccggcctaagaccagaaactgtaagaattaggatcaaactgtaatccaattttacaaatcccagggagacaaggcagttttaaagacaaaaatccattaaaaaaatcaagacagtggtcaaatattaaataagtgtggctcttattttctgtggtgccctaattctaccttctcctctgcctctattcagatcacccattctgatccatactaaagtatacactggcagtccttttctattcctttaagaaatctttggaaaaagattcaaggggacaatatcataagcctagtaaaacatcatgatcagaataatgcttactctttactgagatggttttatttttaaaatgaacataattttttttatttttaaaatgaaactaataaaactgcttattctttgagatggttttataaaataaaatttataaaatatttatatttatttacatatttaaaatatttataaagtaaaaccatctcaataaagagtaagcagttttattagtttcattttacaaatgaagacactgatttagagaacttaaaggaaaactttaaaagcatacagttaataaagaggcaaaactagaagtaaaacttgggtcctaaatacctacctctaaggtatacaaagtttctcagaaaacagttactattctagatcatattacttgtaatgaaggttgtactccctttaggctctagtttcttttgaactaaatattacaatgcaaacttaattttaaaagacttactttggctattccgtatagtcattaaactataacaaaaaagacatcatatcattgtcaaaggcactgaaaacacaaatctctgaaataaaagtcactgaataatcacagatgatttatcatggcttttattcatactgaacattctcaaattacacaatgctctcctatctcagacggccacatgaatgtaaggtcatctttggattagtcatactcttgtatctgcaagtccagtatgtcttctgcttaatctgtcaattccacccactccctggtttctttaggtgtcatcaacagcattcttgaacattcataaaatatgcaacatacttagaggattttaggaaattaaatcttactagtattacaatatagctaagtattataacataggcacaaatgtggagaaactacttgtgaaagaattattcctaaagttttccaaatactcaacagtattttaaaatttaattgaaatagctttttaaaaaggtaaaacagaatagttggtgactagttgcttttctcactaccgggaagttacagcattttcttgttattgtaaaacatacagagaaggcagacttttatgctagatgaactcactttctgcgtcctacttaaatgaaaacagaaatgctaatatccctacagatacagtgcctagtataatttgtttgttcaatatcgtgaatacaacaaactctcggtacatatttgttaatctgaattttcagtgaaaagtttttatttcaattaatgtgaagttgattgtgcctttgaaaaatactttcagtacggacaatcatcatttgccctgtctataccactttgaggtgtaaggctggattacttatgcagcatgcagttgcatttaaattccatgtgctctcactgaagcatttttaaaggttatggaagctatgtgctggcatatctcttggcagcttctcaaggcacatggcatttaactttcttcagcaacacaaaaacacagagcataactttcaaaccaagatgagagtatctgctctcacttctacttcaacatttttttcatttcttttttgagacagggtcttgctctgtcacccaggctggtgtgcagtgacaccatcatggcttacttcagcctcaacctccccagtttaagtgagcctcctgcctcagcctcctgggtagctgggactacaggtgtgtgccatcaggcctggcaaattgttttcttatttttatagagatgagatctctataaaattgcccaggctggtcttgaattcctggcctcaagtgatcctcctgcctcggcctcccaaagtgctgggattacaggcatgagccactgcacctggccaaaaaattttttttaatcttattctgattactcttaaaagtcttacaattgaaatgcagagtcctttttgcatggaaaaggcaaaatgccttttactaaaatggtaatctaccaacaatctcatgttcaataggcattggttgttgaacttgaaaacttcaaatggagtggttggcagcagcattcagcaatgcggcaacatgtaaattatgaaatgtgtatgcatgtttatatatgtataacgtggtccacttgcagaaggataatattaacaagtcagtaaataccacaaaatgccgaagaaaccatatctctaactcactgtaggtaaagaagctgaggtccagaaaggttaaaggatttactgggatggttgcagaggcaatccagtaccccagtgagtgctcattctgcttgctgggtcagtttgtaatttggtagactccttacccaaaagctaagtaagcctccctcaaaacacatggtaaagcaccctttctttttattccactgcaaaagtcatcattttggtcctggggtattgcaacagcttcctagctttcacagacctttcctctcccaacctatcctgcatactagtattttaaataaaaacatggagaaaaggccctcgtacattgtaagattcactgtagtaggctgtcctgtgtccccacatcactttcttttctctgactcataaacaaatggctctaaactaagcactgcatcaaatttaagctcaaatgcctgacttctaattacagacataatctcggccattctacctcagcacacattgttctcactaaaaccaaatttattctttgtttttagttaggtcaccctttgtcatatgtgccatgtactgctgccaccctgccactcccccattactgtgctggccacccctccccatcttcagggtcatttaaatcattccctttcttcaaggtcttgcgtaggtcccacctcctctgggaagtttgtccagtttacactgatttctctcttctgaaattatttgttcttctagatagtattataccccttcctgcactttcccatgtgtgctacttttgtctctcctcaaagattagctgcaggaatgtattattaatggaaaaatcaagttgcatactagaatgcatgtaccttaattccatttatgtttgaacatacacacacatatgcacgtgtatgtctgcaaatacacggaaagtctggaagcatatacattatacttttgatagtatttatctctggaggtgaaattataggtaactttaacttttcagtgacacatttcagtaatttttttttttaacagtgaattacaaacagaaaaagcatttcaaaagtaaagaaatcttctttcctcttgagttaattttacttgacttacaggaagtcattaactgtgcacacataaaaataatcaaagcagttacccaagaggcagaaaatcacagagaaacagcagaggcttgaatatatgtttttagaaaaaaaatcaaaaaacaaaaacacacatacgcacacaaaggagaacgtcatgcaatatttaagggaccgactcagaatcctgactgatgaagtagaaaccaaaagttcatttaggtttgacctgcaattttcactgaattacatcgacttgaatagaaatgcagtatattttctatatcacagccttaaaaaataggtttccagtggtgctaatttgtttccccagagtggcattcataatataccaattttacatgtccaaggtattaagaatgtcttacagtaattatatgaagtttcctaaagaaagagctgtagaccctagaagattcaaaggatttaaaagaaattttgtgctgaaagtgagtaatcctcagcaagtacaaagcatcagtgattgagaaacacacaaaaagatatttgtgctactatgacataatagagttgtttcaaaatattgaattcagttttttttatctatatcctatgggtctaaatatattaattaatgtcatcataggagctttacctttttcatacattttaaactatcaagagtgggcattaattggttatataatgaaaaatgtagttattaaaatcaaactaataaatttaaaaatgttttaatgcccattaaaaatttttaatctaaatttattaagccagtaatggggaaaaaaaccatatgtaataaaatatttcccatcttgggataaaatgtgtgttaagaaaagtatcattttaaaacaacctagtgccatacaacctaattacctgtcaagttgtaaatcccagtgtttagtgttagtaccaatttttgctaatgtttccttaaaattgtaaatatgctctggaataactcggttggcaaataacataaaaagccatgtgagtttctgcccaaactatttcttttaagtaatagaacactgactttgactttttgttttcctgattaaggatgttacaacccttttttttttttggtgatttttatttggctatatataaaaaagtgaacatgctagtttaatatgtataaaatcttcaggcattttgaataacattcttaaaaattctcagaggtttacataatatctagatgagctgaaaggctttacagtacagcaagcatatagggatatggttaaatattttggtcattttgggtaaaactttagaatactgcctgaaaaatatataaagccattaattcataaaatttagttcatactttctctttaatcctgagttagaactgcagatctttccatcttggtttaggcaagatcaaattctcaagtagtcaaatatgcacactttatggagtctggctttacttacatagaataaaagtctagcatctttaaggtaaaatcttgtgaaaagggaagcctgtcagtgcagcatggctctcaccatcctccccaaggatacacagaattctgtaaagaacaaaggagccctgcttgcaatctccctttgttgctactatgtgatttatcttagttttttcagtaaggactttttctaaacatgtgaaaataaaaatttttattgcagattaagtcatcagttaattccctctaagcattttcaatcagctctatctttaaaatacaactaaaataaaccactttcatcaccttctagggtcactgatactactctagtccaagccaccatcatcaactctcctctggattgctctattagtttgttctcatgctgctataaaggactgcctgagactgggtaatttataaaggaaagaagtttaactgactcacatttccacagaactggggaggcctcaggaaacttacaatcatggcagaaggggaagcaaacacatccttcttcacgtgatggcaggaaggagaagtgccaagcaaaaggaggaaaagccccttataaaaacatcagatctcctgagaactcactcactatgatgagaacagaagcatgggggtaactgccccccatgattcaatgacctcccaatgggtccttcccatgacacatggggattatgggaactacaattcaagatgagatttgagtggggacacagccaaaccatattaattccatcccagctcctcccagatctcatgtcctcacatttcaaaaccaatcatgccttcccaacatcccccaaagtcttttttgcctgtttgttttttcttgagacggagtctcactctgtcgcccaggctggagtgcagtggtgcaatctcggctcactgcaagctccgcctcctgggttcatgccattctcctgcctcagcatcccgagtagctgggacaacaggcgcctgccaccacacccggctaattttttttgtatttttagtagagacggggtttcaccatgttagccaggatggtctctatctcctgaccttgtgatctgtccacctcggcctcccaaagtgctgggattacaggcatgagccactgcgcccagccaacatcccccaaagtcttaactcattccagcattaacccaaaagtccaagtccaaagtctcatctgagacaagaccagtcccttccacttacaagcctgtaaaatcaaagacaagttagttacttcctagatacaatggtggtacaggcattgggtaaacatacccattctaaatgggagaaattggccaaaatgaaggggttacaggccccacataagtccaaaatccagtggggcagtcaaatcttaaaactccaaaatgatctcttttgactccatgtctcatatccaggtcgcacggattcaagagaggtggggtcccagggcctcttgtcagctacgcccctgtggctttgtagggcacagctcccctcccagatgctttcatgggctggtgttgagtatctgcggcttttccaggaacacagtgcaagctgtcagtggatctaccattctgcgatctggagaatggtggcccttttacagctctactaggcagtgccccagtagggacctgtgtggtggctccaaccccacatttcctttctgcactgccctagtagaggttttccaggagggctctgccccggcaacacacccctgcctagacatccaggtgtttccatacatcctgtgaagtctaggtggaggttcccaaacctcaattctagacttctttgctcccacagactcaacaccatgtggaagctgccaaggcttgggacttgcaccctctgaagccacaactcttttagccatgctgggacacagggcaccaattcccaaaactgcacaaagcagcaaggccctgggcctgactcatgaaaccattttttcctcctacgcctctgggcctgtgatgggaggggttgccgtgaagacctctgacatgccttggagacattttcccctgttttggcaattaacattttgctcctcattatttatgcaaatttctgcagcaggcttgagtttcttctcagaaaataggtttatcttttctatcatatcacgaggctgcaaattttccaaagttttatgctctggttcccttttaaacataagttccaattccaaagtgtctctgtaaatacataaaactgaatactttttacagcacccaaggaacctcttgaatgacttgttgcttaaaaatttcttctgctatataccctaaatcatctctccccagttcaaagttccacagacctctagggcagggaaaaaatgctgccagtctctttgctaaaacacagcaagagtcaccattattttagttcccaacaacttcctcatctccatctgggaccaccttagcctggacttcattgtttacattactgtcagcattttggtcaaagccattcaacaagtctgtaggaatttccaaactttcctacatcttcatgtctcctgagccctccaagtctctaggaagtttcagactttcccatattttcctgtcttcttctgaggcctccaaactgttccgaccttggcctgttaccaacttccaaagtcacttccacattttcaggtatttttacagcagcacaccactacctggtaccaatttcctatattaatctgttttcacactgctaataaagacataccagagattgggtaatttataaaggaaaatggtttaattgactcacagttctgcagggctggggaggtctcaggaaacttacaatcatggcagaaggggaagcaaatacatccttcttcacatggtggcagcaaagaggagaagccccttataaaaccatcagatctcctgagaactcacttactaccatgaaaacagcatggaggtaacagcccccataattcaattaccttccaccaggtccctcccacgacacgtgaggattatgggaactacaattccagatgagatttgggtggggacacagccaaactgtatcaattgctataacagactcctaatgagtcttcctgctatggctcacatatattaggtaacttgtccaaggttgctaagcaatgtgtgctgcaatctgaaatgagatctgtcttactctaaagtttatgctctttttactacaaaaggggtttggctacgtgtgtatatgctgggtggggtaggtgtatgtgaacatttgaaaatatgtatttgtgtatatatatattcatatatacatgtttgtatatataaatatatatatgtctgtataactatatacacacatatatgtataatgtgtgtgtataaattgtgtgtgtttgtgtttgtgtaatttaagagataccttatggaaccctcataaatgaaggtgctgaaaccagagatgctttgatagaggtgagggaagaagactcacagtcctccaatattctttctcctctgcaaagtacttctcaatgaaataccaaaaactgcaaaacacaacttgaaaactactgtactatacacattgccgtcccttcaaggagtaagcattgtgcttctggtttcaaaacagaggccatttcacaggaagatcatggtaccaaaggaaaaagtaatccccacacaccggacaaagtgaccttttaaaaatgcaaatcatgctgtgtcatttctatcaaaaccctccttggtcctgacatcatggtctgttgcaaaaatgacaggctatctataaagcacttaggaaaaactgctcctaaaacagactagaacaaatgttgctatatttaacttccctgagtcaatacaataagacctctcttcacctctgataaaaattctataccctatgtgaaagctaccctactgctgccagaaatgttaatgagtagcagagataactggctcaatgatgtattaagatgaccagtttattgggaggccgaggcaggtggatcacctgaggtcaggagttcgagaccagcctgaccaatatggtaagaccccgtctctactaaaaatacaaaaattagctgggcatggtggtgggtgcctgtaatcctagctagtcgggaggttgaggcaggggaatcacttgaacccaggaggcggagggtgcagtgagcagagatcgggccactgcactccagcctgggtgacacagcaagactccatctcaaacaaacaaacaaacaaacaaaaaagacgaccagtttatagcttttactatctgtaatttatcttcttagtttcactctcccagtttataaatattttaaaagttgactctttatatagaaaaccataagtattctaactaacgaactaagttgggcctaaatgcccatcaaccaacaactgaataaagaaaatgtggtatatatataccatggaatactactcagccataaaaaggaatgaaataatggcatctgcagcaagctggatggagttggagatcattattctaagtgaattatctcaggaatgaaaaactaattatcttatgttctcacttataagtaagaactaagctatgaagatgcaaaggcataagaatgatataaggaactttggagacttggtgggaagggtgggagggggtgagggataaaagactacacttgggtacagtgtacactgctcgggttacagtgcaccaaaatcttagaaatcaccactaaagaacttatacacgtaaccaaaaaccacctgttcctcaaacactattgggaaaaaaattgaaatgtcaatatacttggaaagagtcctattaataatataaacatcaaattacttctgatttttgataagcagagtaagtaaaatgatgagctcattattaaaaaaaagaaaatatgaaaaaagcaaactcatgctgagtatgtcatgctccagtaaggaaacaatgccaccagtgtgggaaaaattctcgaggaaaaataggcttttataactggatagcatttgagttaagattagaaacaaaacaaacaaaattaaattatttattcctctaaatggaacgttcttaatcatcttaatgctaaagtttcctttcttgtaattggctgagttgttttcacgaatcagaaatgagcaagtccatcaatagaaatctgtcacagagactgatctaagctagaagcatgagttaacataaaacaaaaggaagaaaatttttttcctgagaatgccaagatttagtcactaagaaaaggagaaaatgatagtctttaccaagtatgactatcacgaagatacaagaataatcataacaatcaaaaatgctttgcttcagatgtagtaaacgtaaattcctaaatacttaagaaaaagcagaaatgtctacacatttggaaaattaatgtcttttttttttttcttgagacagagtctcactctgttgcccaggctggagtgcagtggcgcaatcttggctcactgcaatctctgcctccagggctcgagagattctcctgcctcagcgtcccgaatagctgggaatacaggtgaccacaaccatgcctggctaattttttgtatttttagtagagacggggtttcaccatgttggctaggctggtttcaaactcctgacctcaagtgatctgcccgcttcagcctcccaaagtgctaggattacaggcatgaggcactgcgcccggccatattttgaattcttatctgaaaagtctacttacctaaactaaaaatattttttaaaaacagaaataatctttaaaataattgtgggtgtgaaaatctttgaattataaagtcttgcagggacttttctcttgaagaaggcttggctatacttagattcagtataggtatttcaagtagcctgaacacaatggctgtcccttgagcttctaagaatgcagaagagcaaaatcctctgcaatcataagtgcaaaacctgtaattatggttatttaacaaaatggtttctgttaagatatttgatgatgaaatttccactctcttagatgtcagtgcccacattttattcaggctttactcatgagtaaatgtattataactgttatttgattaaatgtcagtggccaccaggcctagttcataagcaagaagcttaaagaaggcaagccacagagggtgtggaatgattacaaagaaagatgatgaaaggagaattgtttttgcaacttggtgatgtgaggcagtgtttcaccttaaataaagtaaccacaaaagctttaaagaagcaaaggactattttggcagcaagaggaagggaagatcagtaaaatgggtaaagtcaagtaaggaagaatcacagcatagaacagcagtattttaaagttttatgtatactgccttatttacatgtttatccactcaacagctgtgtcagggagaaagataagctattattacatttccatttatagaagaaactgaaacttactgattctctggattttttaaaaatactttttaaaaaaaatttttgaactaattttagatttgcagaaaaacttcaaaaatagtacagagagttcctgtatactcttcaccccaccttgccaccctacatgcatcttatctgatctcacaagctaaactgggtcaggtttgtttagtacttggatgagagttttgtggtttttcaccaaggtaaaatatattgctagaaagagtttaagattcctattccaaaatcagtgctctttctactatactactgacttctacacaaaactccttattcagatataaaattttctatctgatcaagtaaaattatgcagttcacttgacattactactacatgttacaactttagagatgtataaaatttgcaataatctaaaaaattctacgtgaaatgctctgtagtggccctgataagaaactggttttgttttatagaattgaaaccctcagattgcgctacatgcagttttcataagatctagaaatgtattctaaaatgaatacattgcttaatgaaatataagtggacgaatgtcatggaattatcatagtgcctactgaatattcagactacattttctgagtcattttactcggtggtagtagtaaatattacatattccactaacttgatgttatgcatgctgcaaatcctttgattctgattctagtcactatgaagggaagattatttctaaagtaaattccataggaatattgctatattatatattttcataaagaagattctgtcaatgacagctaccatttcttaaacacccatgtgctgaactgagccaggtatattacatatgttatcacaaatccttcccaacacttctaagatgcaggtccagataaaggaatctgagactcagaaacatgtagtaatttgtccaggttagtaacataccttggataaagaatggaactgtgattttaatatgtaggtctatatgaccccaaagcccatgctctggtcataataccatacaatctaaagagagtatcagaaaaaagacaagtatactacaaacagtttggtaaaagataaaaactgtcattctataataaagaaaatgatgcagagggaagagatagatttgctaaacaatgagaatatgcatactgtgtatgtttcattagtttgtaggctttaagtgggaacacagtgttgtgacatagcatggtctcatctgtctgggaaggtcatccttcctttctattcgttctaagtaatagaataatagttattctattgagtaagaagcaacatgaaggatccacatgggaggactagggtgagggtgaaagtagggagagagtttggtctgtcagaacaggctaaaaaccctataatcactggggcaacaggtttcatgaccagattgcccaaacgttgtatgcagattagaaacaaaacaaaacatggacaacattgaaataagtaacagaaatccacacaatgaaaatatgtccttgccaaaataataaattaatattcttcaaagcacaaaagcaatcctgttaatattcttttctattggtgccttttaggtacatttacaacatgataaactaaattggattttatacaattcttaagtaatactcctattgtaccacaccaggtatcccatatagttaaatgaacacgccttgttactttgcataccctcctttgcataatgttctttagaggtagaaaaacacacagcccagatggtacttatttttctgtagcacagtattttaatttctcaagtcgcagaacgaatattttgattaacaaaaaagcctaaaatcaaatcctcccattttctttcagaatttaagagacaagaaacatactaataaatactgaatgatttcttcaaccatttgataggttgataggtttcaatgaacaaaattcttcaaattagtatgagtcttaggctaaaacatgttaagatattaacacttggcctatggttatgattgttctttgaaaatcataaaccatgacaaaatactctttcaatacaaaaagtaaactcagtttttatcaattatctgtgaaagaatgaacaaagtgtgtgtgggggggggaaatcaatgttctatgtaaaaggttaagtggagctttggaattgacagtgaaagcccacacaaaagctaggatgagtaatctctacagcctccttgacccattaaaaggtgatgagtttgtgtgacagccaagaattatctgctctcatgacatgggacaaaaaaagttcgttttacatcttatgaacttacgagttcatttcattggcacaaattagaaataagactatgagataacctggatttcttcaagcatcaggtaaaacagaacgcaattactgtcaaacagattggaattattaagttctttccatttaccaaactgttaactaaaacaatttttatagtagaccaggtctaccttaagacactaattattttcttgaagtacgttcttatcaatccagggggctcattcacgttttattagttaagattatttctggctacatatataagccaaaattatagttgcttaggcaagatcaaagtttatttttcctcacataaatgaattctggagataggtattcaggctttacacaaacactgactgaagtctccagggcctcaatctcctccagtatctgctctgacattttgtgattcagaatgtcttggcttctaaagctccagccttgaatctgcataaaatagacaaatgcagaaagggtagggagtgtaccctttctctaaaaaaaaaaaaaagaaaaaatgacagtaagtcctcacttcatctcattgataagttctcggaaactgaaaatttatgtgaaacaacatataacaaaatcatttttttctttgtccctcatcaatgttataacaaaatgacagtgaaggaaaggaagttgagggcctgctgtacaatgatgttacgtgagggcttattgtactaaggattcccatagaatgcttacatttcattggccacaactcagtcgtgtgaccaaacgtggctgagggtaagagaaatgcagattttctttctttcttcttgtttggtctagatgttaaaatacccagctacaaatcagttttgttacaaaggaaggagaacatggatactgagtggcaagtagttgtgtctacatggtggtatatgactgaggttaaaaattcattacatctatgtgacccatcataatcatttccagaactgatttttagcagtcataggaacctctaataagtttaagaatgaggattctcttccttcacatcacttacaaacatttttttaaatgcaatttatgtagctttaaacttcactagagtactttcagaggataaggagaaggcaaagttaagtcaaataaccatgtctaataactgtcctaattccaaaaagattaagaagcgcacgtctgaagaagtagatttagtggcatttaatctattcataccttagagttagcataacaactcctcaaggaaggcaagtgacaggaaaaggggtttgacaaatgattcactccaatgcctacttaaatgctttgccgttttgcgtaaatgccagctggtgggatggatcactgctactgacatgttctactctaactctttactggaagcccagctatagctgctatccatctcaaacttcatcttagggagaaatacactacaggatatgaggggtaaagtgattccaagaacaaggaacttgaaagtaacagagaatatttgcagagctgggtataaataaatgaaggatggattttaatgaagaagtcatatacctggaaaatattgcttcacttgttaacaaaaagcatgaaattacatttttgtcgttttattttgatgagagagatatgaataaagcaaatgacatttaagatatatttgaaaaggaatggactgggtacatcatagggtaaatacgattccaacccaatcccaatacattctgtatatcaacagtgcttaagtgttgtaactcagtggcaaatgagttttaatcataacccaaatattttgaaatattcttctataatattgagaaacattttataccattagaaaaagattagcgtgagtggtaataggaatgtttacctgggaatcagaagatctggactctaggtctcagttttacctctaacacaagatgggactctctaggttaagttgcttcatctcactgtgactgagttctctcttctttaatatagctctgagattctgtggttctacgtgtattctcttatctcagggaactcctgaaagccttagaaacattttggctgggcatggtagctcatgcctgtaatctcagcactttgggaggtgaaactccatctctacatgacatgaaaaaaaaaaaaaaaagcaaaactagctagggaccatggtgcgtgcctgtagtcccagctactggggaggctaaagtgggaggatcgcttgagcacaggagtttgacactgcagtgagcaatgatctcactattgtgctccagcctggtcaacagagtgagatcctgtgtctaaaacaaagcaaagcaaaacaaaagaaaagaaaaagaaatttaaaaagcaaagaaatatttcatagttctaagatttaagagataagacaacctggccaaatccacactgagaaaatttcaagctgtttgcaatgattctttttgtttgtttgtttgtttgtttgagacagtctcactctgtcacccaggctttttttttgagatggagtctcgctctgtcgcccaggctggagtgctgtggcacaatatcagctcactgcaagctctgcctcctgggttcacaccattttcctgcctcagcctcccgagtagctgggactacaagtgcccgccaccacgtctggctaattttttgtatttttagtagagacagtgtttcaccgtgttagccaggatggcctccatctcctgacctcaatctcctggcctcctgaagcgctgggattacaggcgtgagccaccatgcccagcccgattctttatatagaagaaatgtcactggaagaagccataagggtcctaacttctggtaaacatccagatacttcaaaactatgagtgtgttagaatcacttcacttgtatcaaagatacagctatgtactctcctgtatcaactttgtattagtctcctatctctcctctatcttgcacagaagaattttttgctgatttagagaatgaagaggccttgtgatagtgataatgaaagacagactatggcattcgtaagaatctgtactttcataacagagaatggaaaaataattcaggtacttcttaaagtcaagaaaataaaaggataggaaaaacaccactactctggcttcaaatagttcctcctagagatgctcgtatagtgaattaggtccaacacaagaaatctaagaagatgttctaaagaactttgcaaaaggtaccaatcaccatgggattcacatagaggctaaatattaaatctgtctttttaagataaaatatatgttgaaagctattatcaatagttgtttttgagagaagtatatctaagagattatggtattcaaatgtatgtcaatgctctttgaaaataagtgtaaaaaattctaaatggatgtttgagtcacataagcatagatgagcagaagcaaatgtaaactcccaaatcaaataatgtcagttatttgtagatcaccatagcctcatacttttccactatattagtctatacagggtgacttgttaggtaaaagtggacattctagattacaagaaagtctttggttttctgataataaggagataaagtgagccttcaaaaatttacattaaatttattggacacattttaagaaagtgaaagttcattttctaatagctaatgaaggcagtgtgtaccttcagtaggcaaggaatgtgaacatacctttacatattctttgagaaaagcatatcctatcccattaactgaagaaagaaagaaagaaaaaaaatcccctaccatgtccctattaaaaagaaatcaggcttggtatgcttatgacacttcaaagagcatattatgtgggaaaacaaaataaacatttaacctggcaaatgaaaatggacttggggttttgacatacttggcagacaggtagaattaaattcaagtaaagaatgcagagaaactaatatagtatttaaatatttgcttaagtaatatagtatttaaaataacattcaaagaaccgtttttattgaaatgttttacaggtttagtgaggatgttttttaactgaaagagcttgactggaagtacactttactttctctctgtcattctgtgaactttagtgaggttttctatttactttttcattaggcattttcctgtaagtctaagataactgtacagtatgctctgtagctttttaaagaaaatttagatgacaaaagtcatttttgaaataaaataccgacagtctcaagatcaacctagcatatatatggcatattatgaatataaatgttgagtggatgaatgaatagagggtctaatctagtaaggagctaaggcactgtctgcctcctcttgcctccatctccgcaaggttgcctagaagcctctatgtgagagaggtgtaacaggatcctgccttctagcgatggtgccaagtccaggcctggacactagacacagctgaatcaaacagaggccatttcctgagacttaagattggtaatccagtgagctgggcctgcctctctcaaggtgatgaagctaacttgggaactactggtggcatgtaaccctctaagtataaagcatagctcaacaaggagagaaaaattaagcctatgtagagagaagtggagatcagaaatagtgaataaaatttttattttattggtgtctgagttgtagttcttgaggcccagttgtatacccatctgtaggttgcttagaagatacacatccttataaaatgagaaatttgtctatgtagttaactatttttccaaacaacatgtcaaatagagtataagtgaatatatatttagcatctttgcgatccccagtctctacatgaatccatgatctctgtatagtctgtcaccaattgcaggaagaacagtagcaactcccaatgaaataaaactcccatcgcaactttgcttcagcatcctgacaaaactgacctctttcctatatgtaactaacttttattactagtagcacacttaattaatatacatgttttaattaccataaggacattaaccatcagggcattgccagaaacataaacataaattacataaaggccaaaagatcaacacaaagtcctttacatagtaggaaatattatcttcctaaatagcccataataaatcaggtagaggtgccaaattttgctcagtattcatctgtaatactagttttctgttcccagagaaaacaagcttgatgaaagagttttgggggatgacggacagttttgtgtcattgaaaatttgtgatcacaaaaaagtcacattcaaaactaaaatataggctgggtatggcagctcatgcctgtaatcctcgtgttctgggaggctgtgatggaaagactgcttgaggccaggagttcagaaccagcctggttaacaaagcaagacctcatctctaccaaataaataaataaataaataaataaataaataaataaataaaataaaataaaataaaataaataaataaaatagccaggcatggtggcacgcatctgtagtcccagctacttaggagtctgaggtaagaggatcgcttgagctcagttcaaggatgcagtgtgctacgatggcaccactgcactccagcttgggtgacacagtgagactctttatccaaaaagttaaaaataaaagaagatatagaatctcccaattcataaatacgttgtatcctaaaagtctgtttagggtacaacatcctaaacaaatccatcttcccatagaaacactgtcctaaatggtggttaggttcccaagtaatctacaaaaacctctttaacccatatgcacctggacatactcagtttatgcaggaatcagaagggacatatttaagaaaattttgtcctctttctacaagtaccagtattacgcaaaattctgaaagcataaagttggtctttgacatattttcactttatttctgaaatcttctcaacttcttagcatctctctctagaattttctccttccaacaagtacagcacctcacttaatattccctactctttaaggttcaaaactactttacctctactctttgccaaacaaaattctttaaagtccctcttagctaatgatcaagaggtaagcaatctgattcacactaatatgtaaataactgagtgtccttggcccttcatgtgtttttaaaatttttgaaagaagataaagtaatctcttatcaactatggttttataaattgtggacttaagataatgagggttcacgtttgtaaaccaagtatgataagtccattatcttttaatatgtgattctgttcagaaattgacatggccaagcaaaagtaaaatatctttatcagccttaaaattagggagcctagcaactatacataacaaaactcgagaagtttcttccagataaagaccagaatggaagaaatataaaactttcccaatactttccttttccagatagtgcatgcacagaggagattgctttcctggtacttttcactttgtaactgtgaccctagacaagttacctaatctctgtgcttcagtgtccccaactataaagtgaacagggtaacagaaactatcccatgggtagactgtgaagaaaggaatacatcagataatacatatattagggtttagaacagtatctggcatgcagtaagtgcaatgaatgactctggtactactactactaatactattgaggacactacaatttattgcacttggtagagggaaatgtcttggctatggtcaattaaaattataccatcagtagtcgaaatctttacaatactttgagttgagatgcagaatgaatgtcaaaatcctttatcctacccaaaggttcactggttcgctctaagcaaagtaattaaagtaattaaaggtggttattatgaaatttctgaacagaatcacatactaaagatattttcattatttgtttatataaaatatatttattgagcatctactattattacactctgttcagggtaccggagatactgcagtgaacataatagatgaagctcttgtctcctggagctttctcctcaagtagaggaagacagaaaaaaaaacaacatataaaagatcacggatgataagtgccatgaataatatagtagagtaaggatttagaaaaggattgatatatgggaagtacactgttccttttgtcagtctgctggggctgccataacaaaataccatagaataggtggcttaaacaacagaaatatatttctcccggttctgaaggctagaggttcaacatcagggtgccagcacactctggttctggtgagggctctcttcctggcttacagatagctgtcttctccctatgtcctcacatggcagagatctctagaggttcttcctgttcttacaaaacactaatcccatcatgaaactctactctcatgacttagtctaaacctaattaactcccaaaggtcccatctccaaataccatcacactgggcattgggagtcagggcttcaacatataaattgggcggggggtgggtgggaagagggcaattcagtccatagcccctttttatgggatggtcagagaaaatctctctgaaaatatgatatgtgagtagagatctgaggaaaatgagagagctagaaaacagcacatgcaaaattctggaagtggcagtgtgctggttcagttcagggccactgagagctgatatccagagaaagatggagatggagaattgaccaatgtatttggcaacaatggaggttagtagcaaccttaacaagagtaatttcttgtagagtgctgaggatgaaagcatgattcaagtgggttctaaagagaatggaaggagaggaaatgtaacctcttttgagaagttttatgctgaatgagagcagaaaaatatagttgaaagctttttttgtttgtttaagatgggggaaattataacatttttctgtgctgataaaaattaaccaataatgtatgtcggtgctctggtagcgtgtgaaagtactcttccgattacttcttttttctcagtgcaacaagatgaagtgaatctggagaatgagtgaactaggaatgaagctggaaaagggaagaagtgcaaaaagtctgaagagaggaaaaggtttaaataatcattaagtaccacgggagaatgggtacactagggaatgttctaggattgctgggcagcgccaagggtatttgagattcttagtgaagtaagaaagtaagattagtctgcttatttttctccagttgtgttctgctactgaggaatagacataatatagctatgaaatgggcaaagagtgagatctaaccaggattggggttttactagggcaggcattggtgcagtgtgagttttcaaatttttactgaagagggtctgtggtcaaaaaaaatttcggagactaaggatgaaaaagcactaagtactactaatactgatgatctagaagatacttgaaaatcttcctaacctgtccacggaacagttgtaaaaagccactacatatcaatgtcaccaagaaaattctaataaattccttatgctaatatatctaacaatctaactactatgcaacaaaacaactaaaatacctaataaaggaagaaacatataaaacacccagccatttggaaaatatatatctatatattttaaatattataagtaaattaggccaaagggcaattcaaaagggaaattacagactatgtatgaaaggcttaaataaaaaaaaaaaaaaaaaaaaaaaatttatgggctacaccaaaagcaatattaagatgaaagtttacaacactaatatttctattgttaaataaaaattttcctatttttaaaaaaaagactacatttgattttaaaacatatttgtaaaattatttccctaggagagtacctagaaatgcaatttctgcatcaaataacatataatggtttttaacatgtatttgatagatattgccacatgtatttccagaaagctgtatcaatatatgcttccactaatatgagattgtctatttctccacacccaagcaaacactggataattcttggtacaaattaaacaaattacattttctagcttaaataaagtgtggcttcttttcttcctggttttgatttggtttctggggtggggagattcaatattattagaatttattacgaatgaattgtaaattttcttatagatgtctcatgcctcagagatcccacaattctttgaataacacacatttggcctatagttgtatgtgaaagtacccaagtcccacacaagtggatggaatgatttataataacatgagacattaaaagaatatttaaaaatatctgatgagtttgagatgactgatatcccaaggaaataaaatccaggccaccaaaataacccatcaccctttggttacactgcatgtataagtgagatcatgtagtatttttctttctgtgtctggcttactgcacttagcataatatactctaggttcattcatgtagtcacaaatggcacaatatccacttttttgaaggctgagtaatattttattatatatgtgtgtatatctatttcacaatttctttatccattcacctgctgacaggtcaggtaggctgtttccacatcttggctatcttggctattgtgaattatgctgcaatgaacatgggaatgcaggcatctctttgaggtatcaagatcatttcttttggatatatacccagaagcagcattgctggatcatctgatagtctacttttaactttttgaggaacttccatgctgttttccgtaatgactgtaccaaacttcctttcccacaaataacgtacaaaggttcctattcctccacgccctaacacttacctcttgtctttttaataaaggccatcctaataggtgtgaggtgatacatctcactgcagctttgatttgcatttccctgatgattagtactgttaagcatcttttcatatacttgttagccatttttatgtcttctttggaaaaatgtctcgtcaggtcctttgttcctttttttaattgggttgttattttgctattgagttgtgtgagttccttatatattttgggtattaactccttatcagatgtatgatttgcaaatatttctcccaacccacaggtttccttttcatattgttgactttttcctttgccatgcagaagctttttagagtgatatagtccaaattgtttatttttgtttttgcttcatgagcttttggtgtgatatccaaaaaatcttaccaaggccaacgtcaaggagctttgccctatgttttctcctaggagttttacacttttatgtttatcttcaatccatctgagttaattacggtgagagataaggattcaatttcatttttttttcgcatgtggatattcacttttaccaacaccatttattgaagagactatcctttccccattgtgcattcttgacacctttgtcgaagattagttgaccacatgcgtgtaggtttatttctgggctttctgttccattggtctctgtgtctgtttttatggcaaatctcatgttaaaatgtgatttccagtgttggaggtggggcctggtaggaggtgattgaatcatgggggcagtagggtactgttttgattactatagcttggtaacataattggagatcagggtgtgatgcctcccactttgttctttctcaaggttgctgatatggtttggatattcttcccctctaaatcatatgttaaaatgtgattcccagtgttggaaatggggcctggttgggggtgattggatcatgggggcaagcccatcatgaatagacaatggaactttacacagagctactctctaggaacaaaggcttcacttcttcatccattcatctctctctttttcttcccctacctcatttctttgtctctccctcacttgaataacttctacagttacagtaaaggtatacggtagtattctttgcagatatttgtgtatgtattaaattttggcaaagtcttattttaaattacttaaaagaacaatgatttaaaataaatttattattttaataaacaagttatttattaaaataattattatacttttatgtaatacaagtattcttgcaaaatgaaaacaattacccagtgattttggatttttctaaagtttgttttcctaaaggtggccacttttgtaatttaacctctatatttgagagcagctcaacgaatccattagtcatgactgtcttctactatttgaggtgagaataatgaggaaataaaagtcctttcttcaaggtaggacatgtaaaagtaagatataataaatatttttaaaaaatgagataaaatgcccaaattgttaatacttattatttatctgaaaattaaacactcaaaagtttatttcatggctattaattgtgagagtaaaaattttcggaatttctatagcaatgcaaaacactgccctttgtaactgaatattaagtgccatagtggtgacagtaataatcatattaatcccatgctaaggaattaagactgctctctagaaaatggagaatcatgaaaaggagaagcctggtaggatctgatctgcctttttgactgatgctatgaaaagttccaaacggatatgctaatacaatagattatactaatcactaaatatttatggcttaatccaaaattctttttatttatttatttatttatttatttttagatggagtctccctctgttgcctacgctggagtacagtgacacgacctcagctcactgcaacctccgccttgtgggttcaagcgttaatccaaaattattaattctaaatgaggaacacaatgatatagaaaaaaatcgaattacattaaacagcttgatttgcacattttctataaagtagtggcaacaataagaattaaactaaaggcagctcctcagcatggatgcacataaagaaatgggggaaattatctataccaaacaaataatgatctgttaattccactaaataaactgaaacattaaaaagacaaaaatcttgccagagaatacacttgttttcatatttagaaacactaacttggtgagattaaaccaataaagataaataaaggccaaactatgtaacaaccatctgcccacctactgtggggaatgtgggtaaggagaaagaatagggaaatataatccacaaaatattcaaggcaaaaatattttggttattacaacaaccacaatttgagaactataaacattaaatgtaaattagtggcaaatcttgtggtgttcttaaattcaatgatattttaaaattcatctttgccaaggtgttttacaaacaagctagaagactgatctctaagaaaacccttgaaaagtattttttaaaagagaaggatctcattttaaaaagaacaaactgaaattacttgagacagaaaatattgagtgattctataaaaaacttaattgaacagtataatcaccatgtggcagtcaaatatccgtttaggcaagactaaaaacagcagcccggtaaggcctgcatcatgcatcaccaacagtggacacgagtgttcacagtgtgcagtgctgatgtctatctttacccaaataaatgactctgttttacttcccttgatgtaggaaaggtggaaataaatagcaatcattattccaatgctttcctaccaaatccagatagaaaatatcatgtccccataacaaaagatacttgtgaatatcagataatatattctgatctggattagggaaaataggattactatgagtatggtttcaatgctgccaccatgtattttgctcccctgcagactaaagaaaggaatagggggaagaaaacttttaaatttcatccaaaaactaacagtaaagaatctaaataggtccaagggtgggggacaaatgggaatggtactaatattgtttttaaaaagatggcagtcatttgattaatcctgctataaaatttctctacagcaaagcaacaactgtaagagattatatatccagaaatgttagagaatgattaaaaaacagtgccaggcttggtgcctcacacctataatcccagcattttgggaggctaagatgggaggattgcttgagcccaggagtttgagaccagcctggacaacatagtaagaccctgtctctacaaaaatatgaaaatttggtgggtgtggtggcacgttcctgtagtctcaactacttgggaggctcaggctagaggatcgatcaagcctgggaggttgaggctgcagtgagctgtgattgggccatggcatttcagcctggggaacagaaggagactctgtctttaaaacaaaacaaaacaaaaacagaataaaacaaacacaaccactctagtttcacacctgtatgtgaggtgctctaatcatcaaagcagaagtcagactccaccctcagctgaagctcatatttcacaaggttaagaaaagcataaaaagatcccttgagagccatcttcaaattggatatagtaagctacagaaaaatagggatctaggtaagagttaggttagagttccatttttatagatctgtaacttgctttttatttcattaactgaaaaatgccttctccagaaggcactttccccaattttagacaagcacttatgacaacaaatacacaattctttaccattatatcataaaagtacagctatagctatgggtaaaatgtaatttgatagtataaaaagtcacagacggaaatcactttcagagctacatattacatctattttgggttcttctaaatcaaataatactacctcgtctacagttcctatgccagaataacatatactgaatgacattaatcctgcactgtgcagctagatttaccacaggtatcttgttggtatttctactaatactcccttcagaataatttcataagtattttgaaattgtttgaacaaaaattaacctttaataaacataacaatgagttatcctaatgaaactcttccaggaactaaccttgacgtattacattgtttcatgtttttcaatgcaccctagcccttttcaagtttattttgcaaaccacactgaagctaattcaatgaccctgcctaaatgtcttaaagaagtaatgtgccctatgtcagaataaactaaatttcaaattatgtagcaagtagaaaatatatggctcaaaaacaaaaccaataatccattaagaaggttcaaaattaaaaacaaatatagtaataattagaatagtaacccatttattgaggctgtattcacctttactagatacttacttttgattggtcagttattactctaggactgtgagggcaaaggccatattttatctttttttaatagtcacagcctcaggacctagaacagtgattgacttaaaaaatctcaataaataaatgtttaataaataaaggagtgaaagcatggatggacgatttgcttgactccaaagaaaaagatttgcattcatttttaccacgttgtgtcttagagaaaacttcctagagagttgaacagagcgccaagattctaagacatcattctactaattcacactgccgtaatgttaaagacctttacactgaaggacctttgtggctatcttttcacacccattacttcttcctaaagttccagagatccagggttttgctgaagtctgactgtacactcaacttcagggatgaagcatacagcttagggtaagccagacaggacatttcatcctactagctactgccactggcagggactggggagatgttgtgacccaagcctttttaagagtaaatcttgggacaaaggcattctctctccacctggacctaaaacttctatagtcatttgtgctcctatgtgagaaataaatattcaatatgacctgaagattaggccaacaaaaacataaaagggcaggaaaagcagaatagggaattggagctagaaatccaatgtacattgtgaacttcaatatcaaaccttgcttgaagccaaatctacctctgggctttgttatctgaaacaaaacctttccctagctgcttaattttgtttgaattggttttttttttttaattaactgcaatcaatagcatcatgcaaaaatattaactgttttcaacttttacatcattattactgctctgaagatggtctgtatgacactatgtagggttatagtcccctactcttcaattatatgatgtaatattatacctatacatcttcaaattggaacagcagctttctgaaatatttgagaatctaaactcaaactatagctgaataaaacatttaaaggactaaaaataaacaccaatattaatatctattgatatttatttattgagagcatctaatagatgttactgcatttatacaaaaatacccatgaaactagaatcttcctgatataatcatgtctcaaataaaatgcaaaataaactttattactttcagtatgacaattcacagacaactttttcttccctaaagatctattttattccctacctctttaaactgtcttgcatctagaaacaagggacaattaaaaggaaaaacatgcataagaaacaactgcttacttagcaaatcacaactaaaccaccatactttcttatgtctaaaatttaactgacactttacgagtttctaactgctagtatttcaatctggcaacaagcgccttctctagatgagaaaaaatcaatggtacatctttttgcacaacatgcatttacttgtatttacatgcatattatatgtgtatattgcttcatacattcatctgttcagtcttaactgcaagcatctaaagagcctatttaatttgcttcataaagcatatccttcagcaccacttacaaagtaaatacttctgatgggaaaaataaaataaaatgaaaagagaaattgcagaacaaaggaaatcaaatgaggattaagagaaacataacagagatggtaaatatgtaaattcaaaacagcataaatttataaattcaataaacttgtaaatctcatcctccactgtcagccactattagcatgttggtatatttctccttgcagccttaatttcaatgtgtttgcgaaacatgaatattcccttatcatcaggtaaacagggttctcagcccatttccaatactatgaaaaacattgtgatgaatagttttgtgcatatgaatgtgcacatgaacaaaattcctgatatctaaagagaaattaccaaatgtaggtctactaggctgcagtatattaatgcttctaatgcttctaactgaattgatattttaaaatactttctcggttttactaatctacatttccacagttaatgtgttaccactcccatcttacttttgaccattttatatacaaaaatggcattatttcaataccagtaagtagatactttatatatttatttttatttcttcttgtttttcatatcctttgccaattttcctactagaatgttcttactgattttaaaagagctatataaatgatactgatagttttgtcatatttttattcatttgccttttaataatttttgtgtttttgaaacagacataatttttataagatcaaatttaaaagtcacttcctttgtgattttttcacccccaaactgggctctgagtgacctttcagaatattttaatagagtctatttcctctcttgaaaaattcacaaaatttagcatacaaaaccctctgaaaattcctaaaagaaacttcttaaaagtttgaacttagcatttcacaaacttatttgaaaacagaccactccctactcccacagtgtatttgacaacatcttgaggaacagcatttctcaaaagctttgaaacaaaagcctagaaagtccttccatattacctgtggttatttgtattttttaaaaatggttttactttttataccaattttttaatattctggaatgtattttgatgcatgtgtaaggttaagagttatcattatgttttctttttcagtagttctataattgtcttggcatctttctcccactgatttctaataccatctttattgtgactaattcttctttatatttaattgtatcatttattctcttcacaggagtgcctgtgggttttacactagtaccacactattttgactgtcgtagtttcatggaatcttatattatttggtggtattaggttggtgcaaaagtaattgtggttttgccattaaattaaactcaatctcctactcttctttaatgaaaatttcttggctatcctaattttttataacttcagatgaagtctaatatcattttataaagttttttttaaatcctgctgagatttctgtttaaacaacattaagccaatacattaatgtggaaacaactgagctatttacaacatttagtctatatccaggaacatagtgctttttcatttatacactcatgtctcagtacattattaaaaatgagttacatatttcttttacattttttgttaatataaagttcatctccaaataatttttttcttgtattattctgattgacactgtcttttttctcaattctactattgaatattactgaatttattattgagtattactgaattatggaagaagctcctaattttggtcagtgtctatctgacttaatgaagacttttactggcttcagtactttttacattgatgctcaaggattaccaaaattaataaattatgttatctgtacataatgataaatttttgtctcctgccaatagcaatgccttttattgcactgcctagtgctccttgaactctcgcaaataaaagtggtaacagtgggcattccagaatttgacagaactcttaatatttttaaaactatcatgatgtctgttcatttaagtgagatattttttatcatgaagtagaaggacttttctatatctagtttattaagattttctaaaaagtctaggaagtgaattttgtcatatctctttttattaccaattaaaactatcatatggttattcttatttgacctagctatttgatatatgatagtaatatattttctaatattgaagcatactcgaactcaaggaaaaaatcctactcagttgtgatacatttttcattatatatactttcaaattaaaattgctaatactttaagatttatgcatctatattcctaaggaaggtattatgataattttcattcatttgagctctgtctgaagttatgcttgctttttaaaatttaatgacaagttctcctttttttttcttttctatgctctgagatagcttggatagcatgataattaactatttcatgaattaaagagctcttccataaactgggttagattcagagacttctgagcatacaactgtttaaaaaaatttgtcatttctttgagttactgatttatccaggtttagtacttcctgatgagtaaaaattacacatttatattttcttagaaaaacactcattcatcaagatttataaataaattggttactaaattatcgagcatctatggctatatcattattcactgctaatttttagtattgattggtgcaaaagtaattgcggtttttgcctttttaaatggcaaaatgataaattgtggtcttctgtcaatagctataccttttattgagagctccttgaactctggcaaataaaagtggtaacagtgggcattctagaattaaattttttagtggcaaaaactgcaattacttttgcaccaacctaatacttattttttatttttcttatttagaggtgacacagattcattctaccactttgttcttatatttgcaaagaatttcttaagttgataaatttaattatatgtcttctttttatttctgcttatctttgtattttcatttttcctgtcttctctattttattgtaaaatttctatgctttagttgaatgtttggtttattttcattatttccaatttaataatgaaagacttaaaagcaaaaaagttgcttctctttttaacaaagctttgtctacacttgtttaattttatatggacttttctcgttgttactatctaaacagtctgtgacagtacagttaaatttatttttggttcattagttgcctctgtgattttttttccctttttaattttcaatcagtcaaggttttgtttgttagtttaacttccgttattactttctaggttttctttccattctggtaaagtaatatgccctataaatttttgcatttttggagtttgttgactgtatgtgtgtgagagaaagcgacagtaagaaagagagtgagagtgaaggtgggtgtgagagacagagaaagattttgtttgattcttcatggatggttgaatagtgtttcggtttttcgtttttaacagacaaggtcttgctatgttgcccaggttggacttgaactcctaggctcaaatgactcagtctcctgaatagctgggactacaggcgtacaccaccacgtgcacctgaagggtggtgttttgtaacgattttcgattttaaaaaacagtgaatcactttcttcactgatgatatgtacagccattacatataattgaacatgtgctggttgaaggtgtgagggcagatggaggctacagccccaccaaacctcttctctcttccctgaagagacccatggaatccttggagttgtacgattttaagactattgctcatttataaaacattatatatgcatctattagataaacttagatatttattaaagtcttttttttcccttgaattaatcagtcaaagatggggatggtgtgttctagtctccacaacaaatgtttttctctgacctctctccacatactagaagctttcaatgctctggaatttgatgattaacagtttgcacctactatattttcactataggtgtatcttttagtaacataaaattattgcctttattccattttaaagcttctctccttaaattctcttttctctgaaattaatactgtaacccccagtattacagggtttgtatgatatacctctgattgttctttaacttttaccttttaaataatctagaaaaattacatttctatttctatatatgtatatatgggcatagtgtatacatgtatgtacatgaatttgcatatgtaaatgtatatacacatataaatgtatatacacagatatatacatacatgtatttattatgtacatatgtaaactacatatatctttgtagtatataattctatctttatttcacagtcccatatattataacatatttaagagtttcagtttttaactcaactttttaaacttttctggtatttgtgaatgtttatcttactgggattagcctttttcttttatgttaagtattatgtaagatatttttggactgttagctttacagacattttattttccttttccttataactgaaataaatcatgataggtagaaatgggaatggtagaaagacttcaaaaacaggagatggacaacttctacaggcatccacctatttcttcttcaatgagttttctagtccacttacctccaaaaaccataaccctgggactcaaaatctccaggcatcataaccatgccacacttgggcacaactgaatgatatatctgatttctcttattattcagtctttatgagaaactatatgttttcaaatctatggtcagttcatttcaggttaagcaaattcagatgactacctggcaccttatttaatttaaagcttattatcaacaaattttaagctgccttaaatgttatgtatatcactctgctttctctctagattccactattaagcctctgatatgaaaacacaagataaaaagtcactagggattttctgcaccccaaactgtttaaaagctgctctctctggtaagctctaatccttgctctcttgtttacttttatcaatttgaggattactctgaaggtagagttctctcaactttttaagcacccattgtttacatctctttacaaacttaggggcttacaagactagatagtttacttgattattgacaaacttgagcttctcaggttcctctacaagcagcaaagcaggttcttaggcacagctcttctgtgggtgaccacagttcctcactgacaagaaaactcaaagctatttgaagctttcagtgactgtattttggtctttggttgacaatatttgattagatgaaaaaattagaatgaaagaaacattagctacacttagacacacctgccttattttaggatggaggtgggtggggttggagggaagctatagttgtatgtatttccctgctcttctttctcagtccctcaaatacactaaagcaactctgagcattatttaatctttatttgatcatttaaaaggatgttctgagatcatggatctctactataggtatgcccaagtgctagaatctggtgctagagaaaaataaatgtgtaagagttagctaactatcacgatgatgaactagtaaggcaaaatggatgtaaaaattcagatttttttatatttcaagtcacataaactaatagtaatgaagtaaattatggatgaaactaaagccaagcacacatacatcagctgaaaacaataggaaagaactcaggctgttttttgtatgtttgctcaatgttttgagaagaagctagaataccaagtgagtttttatatctataaagaagaaagaaaactaaaattaagcctgttggtaggtctataccattttcatacatgctaggggagaaggtagtaaacaaagtttctgcaaccataagtgatgcttggaggaaagttaagtcattgaatgatgccaggactgattattctactgaactttaaaagcaagagattgcagtctctgagtccaaagtggtttcatatgaactgccacagttgtggttaactcttgaaactataacctatcaaattagaagcaggcaaggcctatgctcttaacagttccactttctactgtctacagttaagttatgtctacaagcccagcatatttttttcagttaaactgttatttggatgagtagaatataaaagctactctgttatgttggccagagaagatttttgttatgatacaaagcttaacgaagttgccagtctcatgtttatttgtacatatgaagattttcactgtaactagttttatcaacttctgatattttattatcctggttaccagtatgtaatacataactataaagaagaagtgtacagactgcataagtacccaagctttttctaccctgcatctccagatattttattgactttagtaccctgctgacccccagttttctaggtctacagtagcctgctattatagagctacaaaatgttccatttcttctcttcttgattgtggaatgcccttttaggtaacaggtttggctagccaagatcttcccatcaaaattgaaaagttacctgttcaattttactaatgctttatgtattatgctttattccttaatgaacctttctcagtggccatttttataatataaaaatatttaaaaaataaagcataaacaatatttgctctttgtgtaatgcatcataagtgaaaccatgccactaaacaaccatatcctgtttgggcaatgatgacatcagaaatacatgtttatcatctgctttggacaacttagcatgtttttggcccaaggcaaagttgaactaaaattatttgcagttgtaccaaaccaagataaccacacatttctaaagtaattgatacctaaaagaacactgcctttagatcacagttcatgatccaagcctgctaattctttaaaggttgttgaagtttataaagcatgtatgtctactggacctcctccaaagtttaacataaaataattatatcttcagcatgcatagaaactataaaaaagttggcacttagcacatcttttgcaattctgaaattacctccattgcccaactgaaagagaaggggaaaatggagattccttatatgtgaaagtatgataatagcaatatgaactgtgaaaatactgtcttgtaatttggaaggcactcaaatgcaataaatcattttactttaaatttttcctttagtgtttaaagaaataataattttatgtatagatagctaaggtaaaaagaagacatataattttcaaatgcattgttaagacatatccagggaatccaaatacatgtcactaattttgtcttgcagtgatataaagcatgtaactgccctgggtactaccctagctagtaagtccaatcagagcctgcaactatagccagaagaatagctcttcacactatatatgccaacataaaagcagtaagaattagttttgtttacaaataaaactggatgatttgaaacaagaaaggtaaatatttaattagaaattagcttcataaaataaaatcagtaaatgtcagatccagagtagggaaacctaatcattttcaaaacgggaaataaggaaacagaaaacagaagttgtttcccaaagttgatgctgaaggcagatctgactcccacttcaggggctgatcctctgcacatcgctgccatcagacataaaaccactgacttagagatttcagacaacatttaaagaacatgagaataggaccaaacagcataggcactgcaatgattgttctatttctgtaaaaagggaagaatgtactatacctccattctttcttgtttaacttcatcaatttcgtcatcttcaaacattgctaaaagttctcctgtctggtcaatagagttgaggaagtcctgagcaatcttttgtcttttgttcgcattattgctgccactcaatttgtcttcatgaagtcaagggaaagaaaaaaagaaatgttctcaataggtttacatcagcactaattattacatgtattaaatatagtataccaaattcagaattgggattctctgaaaataatcttttaaaaaattcttgcattcaaaataaaagtataagtcatacagaattaaataatttttcatgtcacaaattagaatgaaagaatagaaccaaatgatcaattatcaaagtaagtgtgaaagggctaattaaatcccttataaaaaggagagagtggtgtgctcagatttggaaaaagaatactgttatatagtatttataacaaacacctctgaaatgaaatgacaatacaaaaaatgatgagtaaggatatgctaggcaaatacaagctaagaaagcagaactggtaacattaacgttagaaaatacagctcaagaccaaaaacactaaaggagacagggtgaaatactatctagtaataaaaggaattttaaacggccataaacttttatgtaacaaaataatagcaaaatgaataacacaaaggaaatcttaaaaagcacaattattgtgagatatctgaatatatatatttttaaatttgacaacttaaggttacagaagatttaaaaaatatatatctctaagcacattaacaactatatacatataagaatctatattatcatcttaggtccatagatctttttcttcatttttatcatttcttttaaatttttaaatcaaaaagttttataaacatctataaattaaaatatattaaaatatcacatatcatttttgcttgattactctttcccatttccttcccttttacatgatcagccaaattccaactcaaaatcttgtaactcatattaacaccacccaatatgtattctccatgctcatatatccataaaaatacattcatttatagagctgttttattcatttatattttctagaaaagggttcttatgatattccttctatttctttctggtcttgcacttcatgtttcttcgtcaattaggaagaaaaatccctccaagtcaactggtacagccctgattccttcttaacggctgtgtaatattttacagtatgtatgtaccacagctttccagccaatcccctattgatgggcataaactttgtttcaggtttttgctacccaggggaaatgcagtaatgaacatcccatccatatggcattctgtatggttggcttaatgtttatggcatagattcacaaggatggaactactgagttaaaaggtacaaacattttaatggaagttaagagattgtttaccagtgcattaaccttcaagtttccaagactaatgaggaatgccttgtctctccatgagaaaagcctaataaatgtaaagtgatacatcattgtgattaaaatatttaatttccctaatgaatctaaacatgttttcccatatgtttgttagctatctgaataagcctttctgttaattgtctagttttatcctttgcccattttcaactgggttgcctttttcttaacaattcaaagggctcttttatattacccctttgttatctaagttaaaaatgtttatcctagtctttcatttgcctatgaattttaaagcatcttttgccactaaaaaatttaaaatttgccaggcgtggtggctcacgcctgtaatcccagcactttgggaggctgaggcgggcggatcacctgaggtcaggagtttgagaccagcctgaccaacatggagagaccctgtgtctactataatcacagctactcgggaggctgaggcaggagaatcgcttgaacccgggatacagaggttgtggtgagccgagattgctccattgcactccagcctgggcaacaagtgcaaaactcgtctcaaaaaaaaaaaaaaaaatttaatttctatattgtcaaataagttcattttttcttttataacttttgtttgagatgacttctctccactcacacagatggaatggatcctatcagatatctattcttatttaaatttgtaaaggtttactttgtggccaattttacaattaagttttgtaaatgttctgtagatatattgaaaaaattcatagaccctctattccagataaatacaggtcgaagcatatcttgctattttgctgatttactatttagtgcttatgggtctattatgttaaaaattgtgtcttctataattattcctctttatcctgttttattattattattattaccctttatccttctataaaatattcctctttgttctgtttgggcttttaatgttaaattatagcttgcatgatgctaatattgccacttccgctttctttgcatttgtgtatgcatttatttaccatttatttgttcatcgcattatttataacctttctttatgttcaagttttatttttgtggttgtttataatgtctcaatgtaagaatttaatccatttcataattagtgcaatgaccgatatatttcatttttattattttctcttgctttatatttggtatttatttcatattcttgttttttccttttcctttcttcatttttaatggtttggccatgttgatagtccttccatttcttctcattgttaatttgaaattgtaatatacttttctattctgttaacgtttaccacccctttttccattttctttaatgtttacctcgctcttttctggttggacacattgcttgaacatattttagacaacagtttccattattatttaaagtaagatatcaattatactcctaccaagaggtaacattttcccaatcaagtaactttttcttctaacgtttcaccctttccagtatcaagagaccttcagaacactttcattttccctatctcagcttcctatcaatagacctttgaaaaatttttacttcaccccttctccatctctaaacttttggctttccgatgaaaaggggtattatttttacagtattaacagaatttcaccagtattttaagaaatttagcgcttatattgcatgttctcacatattgtatcattagagataaatactgagtccaaacaagattaactactcaacatacttctttcctattcttcctttttctaactttgaagtttatcactgggatctatggatgatttactttctgcatttgcatttactttctgcacttgatatttgcatattgtcgaatatgtttctttagcactatagacagatatcttatcttggttgggtataaagtccttggattgcagtcccttcctctcatgaatcgataaatatgattctagtgccttctagcttccggtgttatacatgagaagtccaattataatgtgattcatttaataattccttttttggaggtagaggaggctgagcttttgtaagattttctcattatgtttagagatcaagaattttactaagacattccaggtgtttatctactcaactttttttactctgcagtcttggattattcttagctctataatttattaataattgcctctcctccatctcctacttttactttctgaaatgcctatcatatgcatcttaactcctccgaatttatcctctatatctcttacctttttccctcataattttcatatctttacatttttctatgtgctttgagataactattgcattttattctccctaattaggtctgaagagtgactttttgacaaaaaatcatttagttgtgaattactgtgtgttaactctagaaaatctcttttgtgctacatttgagtcccactattgttctccttactttttaaaatttaagttgtcatctaatcccaactattttgctggcagatattacgttctgtcttagcttcctctatgttggtgcattactcccctcaccctaagtattcccccccacttttttttttttttgctgcttgatgggattcagttgtaatgtaatcaatggtaagggtttgagtggaggattttaatgggattttaaatgattccctatctcaatcttcccctccaccaactctaggcaaccactactctacactccatctctttagatttgcctattccagacatttcatataaatagaataaaatatctggtctttgtgattggtttctttcatttagcttaatattttcaaggttcatccatgttttagcatatatcagtatttaattcctttttatagccaaataatattcctttatatgaatattccatacttatttatccattcatccactgatagacatttgggctatttccttttttattatcatgaatgctgctgctaacactcatgtacaaatttttatgtgaatacatattttcatttatcttattccacttcttttgctaggaatggaatttctggttcagttggtaaatctatgtttacccttttgaggaacttccaaaatgctttctgaattgtctgcaccattttatactctaacaacttaagaaggttctagctctccatgtcctcaacagcacttgttattatcattttgtgtgtttgtttgtttttaatagatagggtctcgctctgttgccaggctggaatgaagtggtgcagtcacagcatactgcagcctctaactcctgggctcaagtaatcttcccacctcagcctcctgagtagctgggtccacaggcacatgccactgagactggctaattaattttttttttctagagatggggtcttgctttgttgcccaggctggtttcaaaatcctggcttaaagtgatcctcctgcctcagcctcccaaaatgctgggattatagatatgagccaccatactcggccttgtttttatctttttgatcacagtcatcctagtgggtgtggagtattatatcaatgtggttttgatttgcatttctctgatggctaatgacttttttttttttgagatggaatctccctctattgcccaggctggtgtgcaatggcacaatcacggctcactgcaacctctgcctcctgtttcagggtattctattgcctcagcctcccaggtaactgggattacaggcacacaccactatacccagctcattttttgtatttttagtagagatggggttttactatgttggccaggctggtcttgaactcctgacctcaagtgatccacccgcttcagcctcctcaagtgctgggattatttataggcatgatttttaagtatctttttcagtgtctattgtccattagttaatcttctttgtagaaatctctattcagaccctttgcccatttttaaattgggccactgtctttttattgttaagttgcatgcattcttgatatattctatacaaaagtaccctatcagatatataagaaaaattttcttccattctgtggtttgtcttttcactttcttgatgttgctctttgaaacataaaacttttaaaattgatcagttaatttattagtcattgttttgactttgaaataattgatcaagtccaattttccctttttcttttgctgtttgtgcttttggtgtcatacattcagaatgctttgcctcctccaaagtcatcaacatttattactgtatttctttttaagaattttatagtttgagcccttgtatttaggtctatgatccatattgggttaactttgtgtactgtgttgttgtaggtgcccaaattctttctcttggacgtggatatccagttgctccagcaatatttgtcaaaatggctattttttccctatcaaattctcttgaaatccttgtcaatatcaactgatcctaaatgctcattactgaactctcattccattccatttcattgacaaatatgtctacacttatgccagtactgctctatcgtaattactgtagctttatggtaagttttgaaatcagtaagcatgagtcctctgactttattctttgttaagattgttctaggtattctagttccctcacgacctagatgagtcatttccatatcagaatctggtatttctatatgattggtagaatcagcgtattcatgattggtagaatcagtgtattcatttctacaaaaaagcagatgaaatctgtaggccaagttggagagtattaacactttaataatactgaatgttccaatccatgaacgtaggatgtctttccattactatctaggccttctttcaacaatattttgtaattttcagtacataaatcttgcaggtctttagtaattttattccaaaatattttattctttttgatgctattgtaaatggcattgttttcttaatttcatttttgaggtgtgcatagctgatatattaaaatatgcttgatttttgcatatttctcttatatccagcaaacacatcgaaccagtctattagttgtaatagtttttattgaatttcttagaattttctatatacaaaattatgttatctgtaaacagaggtagttgtacttctttttttctaatctggatgcccttcatttctctttctgactaaacacctggctaaaaccttcagtacaatattgcatataagtgccattaatggacatctttgtcttgttcccgatcttataagggaaagcatacagtcttttaccattaactatgatgttaggtgtgggttttccatatatgtctgtcttagctcaggctgctacaacaaatacatcataaactgggaggcttaaacaacaaacatttatttctcacagttctggaggttgggaagtctaagatcaaggtgccagtagatttagtgtctggtgaaggcctgcttcatggcttacagatgacatgatcttgttgtatccacatatggtggacagcagaaacagaagaaacaaactttcttgtgtctcttctcagaaatgccctaatcataaaggttccatccttatgacctaatttttaatgcttcccacaattctcatctccaaatactaccacactgggaattaggcttcaacatatatattcagagggtgaggagggacaaaaacattcagtccatgcaatcatctttatcaagttaaagaggtttccttctcttcctggtttgttgaatgtccctctcattaaacacttttggaattttgttaaatgcttttcctacatttattgaggtgatcatgtgatttttctcctttattctgttaatttgatgcattacatgaattgttttctaagtttaaaacaactttatatccctatgacaaatcccatttggtcatggtttataatcctttctatacttgctgaattcagtttaatggcattctgttgaggatttttgcatctgtattaaaaaacattgcagtctggttttcttttcttgtgatatctttgtctggttttcatatcaggctcaatctatattacctttatagaattagttgggaaataattggtattcttctttaaacatttggtggaattcaacagtgaaataatctgtgactgagcttttctttgtggaaatttttaagctactaatttaaccttttgctattgtcctgttcagattttccattccttcttgattcagtttcagtggtctgtgtcttcatagtagaccaactgtatatttatatagtttgttatattaaccattttatttgccacttctggttcttttcatttctttctataacttgaggtgccatttccttaccccagtacagcattattaccacttacctcattcgtgtcattactgtcaaatatattatatttccaaacattacagacccaacataacaatttttatatacatagtgttttatatagctgctttataaatcaattttaaaaaggaaatatacaattatactatctcttatatttatgtacttaattatctttataaatgtgtgaattcaaattatttggtgcagcttgcttttagacaactatactttctcttatatttatgtacttaattatctttataaatgtgtggattcaaattatttggtgcagcttgcttttagccttaaaaacttttcttacatgggtctgacggcaagaaattctcctggtttttgtttatctgggaatgtattttgcattcatttttgaaagatagttttgctggatataagtttctcggtggagaagttttttctttcagcactttgaatatatcatcccactgccttctgattgctatgttgatgagaagtcagccataaatattgtcagggtccccctgtatatgcttttttcttgtgactttcatgattttttgtctgtttttttttttcccacatttttggtaaaagtgtcttagtgtagatttctttatgtttatcctaattggagcttgttgatatgcttgaattagtagactggtagttttcatcaaatttgggaggttttcagtcattatttcttgaatatttgtttttctactttttctctcatcttctgatactctcattatgtgtatttttacacacttaatggtgctctacatttctctgaagctgttaatttttctttattattttttcacttttttcttcagattgtaaactctttaatgatgtcttcaagttcagattctttcttctgccagctgaaaacaactattgagcccttctgaattttttcatttcagtaattgtattcttgaactccgtaatttctattttttaaaataaattctgtctctattgatactctttactttgtgagacgctattatcatatcttccttttttaaaaattttatttcctttagttatttgaacacatacataatagcccctttgatgtttttgtctgctaagtcctacatctgggcccccaaaaagcagtttctattgtctactttttttttgtctcctttttattgttcacacttacctattacttggcatatctagtattttgttgttgttgttgaaaagggacactttagataatacagtgtagcaaatctagacaactccctcccctccctggggcttgtcattgtttatttcatgacttggctgaactagtacaatgaagtctcttcccttgcagtatgcagcctctgatgttgttcttcagagggtgcagccttgagtatgcaaacaatctcctccataaccagagatgactgtagttttagtcagggggtgtttggctgttaccttccctgatctccctattaagtttctggctgttttgcctctactgttatcacatacagctgttagcccccactaattgacagctgtttgctccactgtttctgataatacccttgggcataaattgctccagagattgattgatctaaataatgttgggcccctgtgaaatgttgccagcctttaagttttgctctgactgcaggagggctctttttaactatctctttcccttgttttctttgtttaacatctagctgacccactgttttgctttttgctaccagtatcatggagctaccagtcccctcttaatcactcatcaccaggatcttcattgttgttgttgttatttttacaatgaacttaggtatgaacttccacacactctgttccaagcagtgacgtggaagagctgcagagctttctgctcctaaggtctgagccgaacatctgtaccactgtactgaagctgagggtggacctgcaattaacttctcctggaaagacttccctggatctgagaatggtgatctggaaagggaagcaacccctagacttctaggcttgtctattctggtatgtagctttgctccctatgagagctagggtggtggcaatcagagcccagtattctcagactaccatgtctgaggtagagcttttatcctatgagctgaggttaagtgagaaaagggagccccagtcatctcagctgtgcctgcctagaataaagcttttgcaacatggggctgagggagatgagagatgcctacctcttgccccttctggggtaaaattgttgccctagaataagaactggaggggcaagctacactcactcagagtagagcttctgtcacactgagttaaggtggcagaatggtgaagagtgatcatgtgagcaggtcatggtttaaatgcaacagactctcaatactgttcttaacaagatttagttgatcttgaatatgtgttgccctgcttgctgtacgtgcttaggacaatttctacagactttaaatgattatttcaaaaaaaatttaccagttaaatgtgtttcactggggagagactctgccatccttacatagccatttcagaagtcccacgtcaagattagatgtgttctacctgaatattttactttataatttctatcaactgttttttttttaagttttagtgtgctttttgtaagacacacaaaattagaacatacaaatgaagataagggggaagatttgaaatgaatgagaggacatcaaactaatatgatggtttagcaaaactgaatattactcttaccatcccaaacttcatggtgtctgaagcatggtgttaactgctatcattcatttagtggcaggcaggtatcaagtgcttttcatatattatgctaaactctcctaagcactccacgtgttacacaatataatttccctccacataaatgaggaaactgaccctcaaggtcacacaaagaaagcagagaactggtattgattggaattccggtctgttttactctaagtctgcattcactatgtgctccataaaaagaaacatttcaattcatctgcagaactatttttcaagaattagaatctatgagaagtgtagtaatattaaataggtaacacggtataatatgttttatcagaaatatatacttttgcaagggtattccacttgatttgttgacagtaaacaaaattaactagttctccagttacattggaattgcataaatgtgttatccagcacacatgtgtcataagctcatgttttagttttgtgttttgttttggttaccttcgagaagatcatcctcatcgatgcctttgacaatctttgatttgtagtctcggataaacatgtattttagcagtcttctaagttttttctattaaaaatataaaataagtaaataagaaaacctatacatatattcactttactgattaaagactactataaccaaatttaataaacttgtaccccatgatatcagagaaagtaaagtaatccttagcatactgctatgacataaaaaggtagtcatcaaacacaaaggctaaaatacaagtcttttaaaaagcagttttcatttacaaatattcggatgttccagaatcacaatactcacacattgcttaatgaaggggatctaagaaatgcctcctcaggagacttcatcgttttgtgaacatcactgaatacacttacacaaacctagatggaacagtctaatgcacacctaggctacatggtgcggcctactattcatgggctacaaactggtatgcaagggtaagaaaatggtaagtatttgtatatctaaacatttctaaatatacaaaaattagttaaaataccatgtaaatgacaaaaaatgatacatttgtagagggcatataccatgaatgaagcttgtaggacctgaagttgctctggttgagtccatgaatgagtggcaagtgaatttgagggcctaggacattactgcatgctattgcagactttatttttaaaaaagctgtacacttaggctacactacatttaaaatttttctttcttcaataataaatgtgccttagcttacttactgtaactattttactttatagacttaatttaaaaaatacttcactcttacagtaatacttagcttaaaacacaaacaccttacacaattgtacaaaaacgtttttcctttatatccttattctataaacttttttctacttttaaatttcttatagctttttaaacttctctgttaaaaactaagatgcacacacgcgcgcgcacacacacacacacacacacgcctatgcctacatagggtcaggaccgtcaatatcactgtcttccacctccacatcctgtcccactggaaggtcttcaagggcaatagcatgcatggaactgtcagctcccttgataactgcttttttattggtatatctcatgaaggaacaacctcaggtggttcacagttaagtgttttttgcaaatagtacactctaaaataatgatggagtattataaatacataaacaagtaacaatcatttattatctttatcaagtattatgtactatacataattttatgtgctatgcttttataccatcagcagtgcagaggtatacaccagcatcaccacaaagtcgagtcatgcattgcactacaatgttagtatgatacctacaacatcacttgataattggaattgttcagctccattataatcttatgggactactgctgtatttgcagtacatttttgaaaaacagttcatcatatggtacctgactataattgttttttaaatttttttttatttatttttttattttattattactatactttaagttttagggtacatgtgcacaatgggcaggttagttacatatgtatacatgtgccatgctggtgtgctgcacccattaactcgtcatttagcattaggtatatctcatgctaaccctcccccctccccccaccccacaacagtccccagagtgtgatgttccccttactgtgtccatgtgttctcattgttgaactcccatctatgagtgagaacatgcagtgtttggttttttgtccttgtgatagtttactgagaatgatgatttccaatttcatccatgtccctacaaaggacatgaactcatcacgttttatggctgcatagtattccatcgtgtatatgtgccacattttcttaatccagtctatcattgttggacatttgggttggttccaagtctttgctattgtgagtagtgccacaataaacatacatgtgcatgtgtcattataacagcatgatttacactcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgaacatttttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttctcaattttggcttttgttgccattgcttttggtgttttagacatgaagtccttgcccatgcctatgtcctgaatggtaatgcctaggttttcttccagggtttttatggttttaggtctaacatttaagtctttaatccatcttgaattaatttttgtataaggagtaaggaagggatccagtttcagctttctacatgtggctagccagttttcccagcaccatttattaaatagggaatcctttccccattgcttgtttttctcaggtttgtcaaagaccagatagttgtagatatgcagcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgtgggctctgttttggttccatatgaactttaaagtagttttttccaattctgtgaagaaagtcattggtagctttatggggatggcattgaatctgtaaattaccttgggcagtatggccattttcacgatattgattcttcctacccatgagcatggaatgttcttccatttgtttgtatcctcttttatttccttgagcaatggtttgtagttctccttgaagaggtccttcatgtcccttgtaagttggattcctaggtattttattctctttgaagcaattgtgaatgggagttcactcatgagttggctctctgtttgtctgttattggtgtataagaatgcttgtgatttttgtacattgattttgtatcctgagattttgctgaagttgcttatcaacttaaggagattttgggctgagacgatggggttttctagatatataatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccattaatacctaatttattgagcgtttttagcatgaagggttgttgaattttgtcaaaggccttttctgcatctattgagataatcatgtggtttttgtctttggctctgtttatatgctggattacatttattgatttgcgtatattgaactagccttgcataccatggatgaagcccacttgatcatggtggataagctttttgatgtgctgctggattcagtttgccagtattttattgaggatttttgcatcaatgttcatcaaggatattggtctaaaattctcttttttggttgtgtctctgcccagctttggtatcaggatgatgctggcctcataaaatgagttagggaggattccctctttttctattgattggaatagtttcagaaggaatcgtaccagttcctccttgtacctctggtagaattcggctgtgaatccatctggtcctggactctttttggttggtaagctattgattattgccacaatttcagattctgttgttggtctattcagagattcaacttcttcctggtttagtcttgggagagtgtatctgtcaaggaatttatccatttcttctagattttctagtttatttgcgtagaggtgtttgtagtattctctgatggtagtttgtatttctgtgggattggtggtgatatcccctttatcattttttattatgtctatttgattcttgtctctttttttctttattagtcttgctagcggtctatcagttttgttgatcctttcaaaaaaccagctcctggattcattaattttttgaagggtttttttgtgtgtctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagatttattagaccgtaatgctgcttaatttttaaagtaactgataatcctttgtagcttgttctatgcttacacttagaatgtattatcactcgttcttgaccttcaggttcaagatttctattaatagctgaaacatactgcattttacacagttctttagatgcacattatttgatatcttcaatagtttctttgcatctggcgccttgtacctaagactgcctcaccctgggcagaaactttcactttaaaaaatcctacagtctctccatctaatcatacaaccttgaagtttcatgagtcttaaaattcttcttcaagtaaatcatatagataccctataccaaataataattttcttaatagtgaagattttcattttgtaatattcttcatatcatctaagagttgattaactgaaacatgtaaaatattagagaatatttttgactacctactcatgaaaaataattatggcaaaattagacacacaaatatcagcttaaatattttaataccagatttcaaagagtaagaaaggtaggcctttgttcaaaaacagaaattatggcatatgtttatcccactgaaaattaatctttattaatttacttttttcaataaggtagagctacagactaaactttgtatttcaggcttaaaaaattactctatgaaagtctataatcctggtaatgttaatctgtaagaagaggagaaaaataaatatgccattcagttatatcccacttatgacaacagaacatagagtcagtatttagtgagtatcatgtagcaatgaaagtgtctgcatagacgcataaggataagtgagggttcgctgttagcacagtttttatataagtgcttttgtccacataataaatatcaattcttttgtaaacacattttgtcgtccaaaccatgaagactaaaacatcagttcaatagttattattttaatttgaaaggtacataacaaggatatatagtttccacatgcaagttcaattaaacaaaacgtggattttaatacaataaaattatgttatattaccttatctttgcgcatcaaaaacagaagatcttcaggagtgattacccttgctccccgcagctgagaaacttcagcagcttgctgtaactaacaataatgaaaatttagaaatttttctcagtaacacaaattatatatagtacagtcatgatgtctctaaagagataaatatactaagagttaaaaacctttgggaaataatccagcaatcacattactgcttttaagagtaaaatgtcttatgtttttaagatataaaacatgcaattaaattaacttatgagcccacctgtaaccaatacaataaacagaaatcttttatttctttcttgcaaaagaaaaatcatacacagcttccagaaatgcattaatgcacctgaaaatgatttcatgaaattttatccttcatactcatgtgagcaatggtttcactcagtatcactagttgaataagtatattattaatctgagctcccatgctgctctgatttgaaataggcccattcagaactttaaaagatcaacaaaaacagtagctgtttctaatatccaaaggaaaaaaaatacgtttagttttggcaagtcttcagtgggtaaaggattcagtccataaatcataatactggactgcattaatttctttccatactaatcacatgcacacaaaaagttaactgtatctggaatatacaacacaaaacattactgcactaaaagttagattccccctgaaatgttcatctagccccttatatctacaaagtcaagatttttcaggaattcataagtcctagaaacataatcttacttaaaaatgacatggaaaataaaagaatgtgaaaaatgatagttccgttttttggcacaggcaaactcaatttcttattttgattagttggaagcaacataaaatacgcccatctgaaaaaaataaagatgctacagaaaacactataaaaatgtgtctgtaacttcttccaaatttgatcaaatcttacggattgcaccaaaccaagtctatccaatatgaaatactataaaaagttacatataaaagctgttcctgaatgcatccttcttttaaaagataaacctaacacattttcttgagaactaatctttaaaatgtgacacactattatctcaacaaatatatgaaatcaaatagtacatttgtgctaaagaaattctgcttgaatgtttaatcctttttgctaagtaagcttcaaaccttctctaaatacacagactacaaaatagactataaactcgctatgtgtcagctttaccactgaatttcctggatactgcggttggtatataaacactatcctatctaaatatagaaatttaaatttaactgtgaaccatttaaaaagaaatcttggtgggggggtaggtttttaaaaagatgatgttatctactcagaaactgttttcagcaggcatgaacatattttttctaaaaattggtagagtgagggaaatatatgtgcacatgcttttcaaataaaaatatttctatcacagtctaaaatacaggcaatcagtgttgagaagaatatgggctatatatacatttgtctggacacatacacagtaaatttattttcttaaatgaagaatgctgatcatttgaaatctgaaaaacactatacagacacatgtaattttactcacattaagaaggatcaggagaaatatgtatccctaaatagttttctcaattaatcaacagtttatgcacactacatataaataatctctattcataacattctccaaagtatcagtttacaaacatattagccaggataagtatgataatagaaaataaagacacagaagagttgaacatttggaatcactgttttttttttttttttttattttcagaaccaatacatgaccactgtaaggatctggaatttatatcatggttatcctgtcgtatgtagtaggaaaagtttatctttgttttttatttacctgtttttctaatttatctcaaccaacataatatccttactaggactagcattggtaccactcccttgtctgccttggacctctgcctagttagtatgtctctggaactgaaagtatcactatgttaccttaccaaggcctgcctatcccggatgtgtcccaaaccccaaaattacctctcccaaactctgacctcctcttctctaccaagtgaagacagaaatcttattagctaattaaagtaactcatacaaaagtcatctactacccccataccaaaatactcaagtcctgcacttagccctatggaacctgtgtatccaaaaagtcagccctccttatagaggagtttcacatctcaggaatactattttccatccatgtttggttgaaaaaaatctgcatataagtgggaccatgcagttcaagcccaagttggtcaagggtcaactgtgttattatgcattggtttacttctcctgcaaatttttgcctactaccagaaagactaaagaaagttttctttaacaatacaaacttcaaaaacaggtgagcattaaaaagtgggcaaaggagaagaacagacacttttccaaagacgacatagatgtggccaacaagcatttgaaaaaaaaagctcagtaacactgatcattaagagaaatgcaaatcaaaagcacaatgagataccatcttacagcagtcagaatggctattattaaaaagtcaaaaaaaaaaaacaaaccagatgctggcaaggctgtggagaaaagggaacacttatacactgttaatgggagtgtaaattagttcaaccattgtggaaagcggtatggtgattcctcagagctaaaagcagaactaccattggacccagcaatcctattactgggtatataccccaaggggtataaatcattctaccataaagacacatgcacacaaatgttcactgcagtactgttcacaataacaaggacatggaatcaacttaaatgcccatcaatgacagattaaagaaaatgtggtatatatacaccatggaatattatgcagccacaaaaaagaatgagatcatgtcttttgtgggaacatggatggagtcggaggctaactaatgcagaaacagaaaaccaaatactgcatgttctcacttataagtgggagctaaatgatgagcacttatgaacacaaaaaaggaaacatagacactggggcctacttgaaggtggaaggagggagaggagaagaaaggataactcttgggtagtgggcttaattcctgggtgatgaaataatctgtataacaaaccccagtgacatgagtttacctatgtaacaaaccttcacatgtacccctgaacctaaaataaaagttaaaaacaaaacaaaacaaaacaaaaaacaggtgagcaactgggcagtccaattccacaggcattaaacttaaaattggtgcatttaatgtgaaaacaatagtagaactgggaaaccaatatcaaaaatgttcctcaaaacttcagtgttaacagcagttcagttatagcatttctgtttttttctgattaatattacttctatttgtcaaagtaaacaaaatattaacttgtaacaactttgttaggaaaaaactccctaaaatattaaaactcatgtttacattttaagtatgttataatactttattaggaggttgagaagtaaaaggtacactattacatgtcacctcaaatgccacatctttgaccctataaataaatctgttctcaatttcacattgctatccatgacattcattttttttctcactgtattatattttcaccaatttctgtttattttgttgtttcttttaatcttctcaggggtcttgaatgtgctatttccaccatatttgttctactataatctcccttaaatataatgtctgaattcttgctctaagattaataattccctgttatctaaattcaatgtggtctttaaagctcgaatgattcacatattttccctgcctttccactaattatatttattgtttttctctcatataattctacatttaggctccaataattttggttctttttacctttgtgtacttgtgatggttaattttgtgtgtcaatttgactggaccgcggggtacatagacatttggtcaagcattattccgggagtgactatgagggtgtttctggatgagattaacagttcaatcagtagactgagtagcagactgtcctccttaatgtgggtgggccccatccaatcagttgaagacatggatagaacagaaaaggctgagtaagaggaaacaacttctgtctgaatgcataacctgggacactgggccttttctggcctttggtctcagactgaaacatcaggttttcttgtgttctgaggctgctggctttcatactggaactaaacatctacacattggctttcctgggtctccagcttgccaaatgaagattttgggaatccttagactccataattgcataattataatttattatccttataataatacataaatctctctcatacacacaggtgtgcacactcacacatacttactgccggtctctaatatagtactatagttaaattatgagaaaatcctgattctttataagatgtggcactttttctttaaaatacgagctttaaaataattttctcagaaaaataagatgtatgattattttcacacaacagtgtttctcatctaacgtagatagaaaacttaaatgcagttcataatagcttaattgcacttgttatcaagttttgtaacactcctgcctcccaaatttcttttgaattatacacgtaggtccagaaccattgaccctgaacaggcaatttataaatgtttgttaaatgttggcaatccatcttcccctccatgattttcagtttttcaatttaaatgtaacagaaatgagttaagctatgtaaaatcgatggccttttgcatttggctggggcccacataaattcagcacaaagatttctctaaagttctaaaaggtttaaaatgtacaacagaattggccgggcgcggtggctcacgcctgtaatcccagcactttgggaggccgagacaggcggatcatgaggtcaggagattgagaccatcctggctaacatggtgaaacacagtctctactaaaaatacaaaaaatgagcctggcgtggtggtgggcgcctgtagtctcagctgctcgggaggctgaggcaggagaatggcgtgaacccaagaggcggagctttcagtgagctgagatagcgccactgcactctcgcctggatgacagagcgagactccgtctcaaaaaaaaaaaaaaaaaatgtacaacagaattaagttgattattccacaattactaagctactgaaagtattttaatgagacttccattgcagctctttcttttaggttttgcctaagaccttggatttgtcctttttgaagataaatggtaaacggtaggagttgtggtgagctagtatcatgaagaggcagaatcctaggtaaggttatcgcctggcttaaaattatttatttttccctctattagtctatctattatgcactcattatccatcaggccagattctaggttaggctatgaatggtcagctctgcttgcaaccatatttgctagccagagataacctcaaaggtcttctcttaaatcctccatgataagactgaaagaacctggagttaaatttcctaagttggagttaggaaactccagtgtagtttcatcactaagtgattgcacaaccttagatacatcaaataagttctctagatttgtgggtttatgtttctcttttatttgaaatgggtaatcaatgactttaattactagtagaattataatcttagtggtaataatagtggccatatattgtgtccctaatttgtgccaggtgctgtgctatgtgtcttatatttaacttttaaattttatatctaatttaaaaaatatataaaacattaaaagtcaaataatactataaattttatgacagataggaataccttgccacacttcttctgaatctgtaattctgcttccagtggcaatcacctttaactttttaagcttgtttctattttatttaccaacatatttgaaataagcttataatacttgttttatttttcagctttaaaaattatcagatgacttattatgagaggtgaaaaagatttagtgttcttagacaccccaaatttgaccatctctcctcttgactttacctatgaaatataatttttgtttaaatatacagtgtttatgttataccaaactatttttgaaaaatttgaaatgtatcagaatttatttcagttttgcttttgatgagacatctcatctggagccctccagacttcccttctactcttctgctttggatccttttttttttttttttttttttgagacagggtctcactctgtcatccaggctggagtgcagtggtgtgatcacagctcactgcagcctcaacctcctaggcactatagatccttccacctcagcctcctgagtagctgggactataggcgtgcatcatcacatctggataatttctgtatttttttgcagagacagggttctgccacgttgaccaggctggctgggaacttctgggctcaagtaatctgcccactttggtgtcccaaagtgctgggattacaggcacgtaggagctaccgtgcccagactggattgttgttttcttgaccccatttctgctctttctcatttccttcctcatttacttcctcatttcagcaaagcatattatctgaaagtttcctttttagttgatgagcatagttatgatagctgctttaaaatccttgtacattaattttaacatctgtgtcatcttggaatcagtctccattgactattttttcttggctttgggtcatgttttcctgttatttcagattttaagtaatctagtgttttatctgagatattgtgactaacataccgtaggaactctggattttgttgtattcctttgaagattaaaaaataggcacttaactagaacggattcaaactacaacatctttttctcccctgtggtgggctacagctgaaatatacttgatattacagttttctgagaaagggtgcaagggaaataaatttttaaaaatcttgtatgtctcaaaatgtgtttatgtcatccttctattcaattgataatctggctgagtatacagaattctagattaaaaataattttccctcagaattttcaaggcactgctaccttttcttctagcttaaaatgttgctgttgacaagtcgattacattatgattcctaagcctttgtgtgacttttcccctagtctgagaaacttttactattgttctttttatacttcaagttctgaaaattcgtgatgcttctttgaaggtctatcttgaaatatttttctaaatactcataacaatacttcaacctgtatgttcttgtcctttacatttgaaaaatgttcttggactattttgaaaatttctattgtctgttttttgttttgtttgttttcctgaaatgtctattaaatgaatgctggtggacttgtgtctaggatttctaatactggagatcattttatttcacctttccacaaagtaaagttatactattttgccagaatggcacaggggtagctaatggcctacatggtttggatagggtactgggataaaattatgccttttaccaatcttcctgtttttagtctacacaagacttctttcttcagaggaaccttcaatcccaaacttttccatgttccaaagtttcattttcctcaggtctattaagcctgtctacccactttaagctttcagatttttttttttttgacagttctcacctgctatttagtcctctcccattttctacatcttgtaagtttatacacttaaaattattttgttatttagtggagttttcagagtttgaagcatgtgtactacccgtatttaacaggaagctgacactcgttttttatgctaacatttatagaatttattatcctatgcttcatgtcttctatatattatctcatttaaccttcacagcaaacttatgagagatgtccaaacacacaaaactattactaagtaatacatgtttaacattaagccattcatgtttctctcctagatttcttattcagaatagaggaagatgcgttcactaaatcaagccttacattgcatagaaaagtctaaccataaaaatgtttatttgcctttcaaaacattttctttcttggtgaataaacagttgccaaaaaaaaaaaaaaaaaaaaaaaaagaaagaaagataaaaggtttggatcaaaacatccaagccagtggctccatgcagacccagcctaaggattgtgagctaagtaagtatttgaaaggaaatgtatttgtaactaaagttaacattcagaatactctacatttaaggtatttgacgtagtattttcctaccatataatcgtattattcttttttgatgattggtattgttttcttagacatttgaaacataaatgagtatataaattgataaaagatgtgcctaactttttagagtttcattttaactgttctttttagaatagtaagtcaagcacagttaagtcaggttttaaaaaatatataaggctataattaccaggatctcatggctcaaaaaattcattcatatatactatgtgtgtatatatgacatatttgtatgtgtatatatatatatatatacatattctttaaaatatgtgtgtgtacatatattgcatgtgtatatatatataattactcagttacaatcaatgtgacctctaaagcttaaaaaatatccaataaacaataactatatatttactgtatgaagatagcagccttaacatggaactaattctgtggttactctgtgatttaaatgtgaaattaggagaacaagaagcaataatcatttgaacattttcttttaacctgttttgcacacaagctattcataagcaactttcaactctaaatatatctaagttttgaatgtaagcaaaggcacattttagaaatttttaaaagttgaaattaaataaagtcatagtttaaataacatagtattttagtattaattaactgtaattgataactgttttaaaatttttctttttaagagacagggtcttgctctgtcacccaggctggagtgctgtggcactaccttggctcactgcagcctcaaactcctgggctcaaatgatcctcccacctcagcctcctgaagagctgggactacaggcacatgccatcatgcctagctaatttttgtattctttttgtagagacaggatctcactttattgtaggctgttttcgaactccttggctcaagtgatactcctgccttggcctcccagagtgctgggattacaggtgtgagctatcacacacagcctctttaaaatttaactatttagtatttaactattgaaatgaaaatacaatttgactatttactgaatctaaaatacaattaaaattgcagaacgacagaagcgtaccttgaatttgttcaacataatatatagttatcctttggtaactcagtaactggaaattgatgtatttttgaagtctaagaaaaggttacatttgcatttcttaaaattcagaaccataagatattttggttgcctatataatatgtgctttacttgactacattaataatgcctcttctttctcagcttacttcttggcatgtccacacccctttccatattcccttctgttcacatttgtaaacaggcatctactgaacgggttgtagcccttacttgtttcttcaaaggacaaaaatataacatgtaagagactgaatttcttagtttttttcagaactcttcctcatttgtttttacaagatagcctgatttcatttcaccctagaatgttcaggaataaacacaggtcttgtgctaagtcttcatggctggatcagggtactaaaagcactgaattacaccagaccacacacaggccaatgtaatgattagaaaagttaccaaatggaaagaataaagtcctgctttagaataattatggggagtaaggaaagttgatatctaattttatctctattactaattacccttgttttggcaaaagcaactttataattttgtctttttgttgagaaaatatatagagaaagtgccaattttagatttgcagcttctgatgctggatctaagaacctgatccatgcagagggcaaggatctgctatgaaactcggttaaaatgtggcctcctctgttagtgtggtacatcccgaagagtgttccagaatctttagattattacctccaagttatagtcgaatacagtagtcgaagctttaaaaatcattacttagaaaatgtttcccaaaccatcttgactttctttgtctcataacattttttaaatgcctatgatttcatgttttagtgaggtaacatcatgcagcatatagctagcctgacgtaaatgttattgacatttatttagaaaagataaattaaattgtgaagaactcataaaaaagtttataacttttagtactcacaaagattaaaggttattatcaaattattattaagtattaatgacattttcccattaaaaaatttaggatgtaaataatttgtggataaatgtatttgtatatatgtgtgatatttttatccttaattataatacatatttgtgtgtgcatacatagatacataccaaacatgtctgtacatcactagaatcactttcttgtaaaatgtaagctaactttcatccaaacttcaagggaaaaataatgtgggcttttttgatagagaacgaattgtttctctaataatttctcatgtaaaattacctcaaaatgaaatacaatgcacacattagttttgttgttacggtttttaacagaatagctgatctttttggtcctcaggttcttcaagtgagaactaaagagaggtgaatatcaaataagctccaaagatccttttggcttttctgattctagtgtttaaccctgggtatagttttggttccataattaagcacttacatcaataagagaaaaaataaagaggaaccataagaaagaatggcgcaacttggtaaggtgcagatgggagtcaatgctctaagggaaactcacttagtcataccagtggaaatagcaaccagctcaactagctgcaagtgcatgaaaggaagtatggggttgggttcttatttagcagtaatgacttatcttaccatgtttaccatggtacacaaatcagcaggtgatataattactttagtattctattcaatagttccaggtgtatttgaaagccaaagacagttgcaaaatgggattatagcaatgcaattgctaattaatatgtaaaagacattggtctctatccatttctcatctgccctatgctttcatcatatgatgaacagagataatttgtatatacttctccctcagtttgtcagagaaagtagcccttattcaaattctgtatccaaagattgcttgcataggaaaaccaatacatgttgtatacagtatttatcaaattagatgcagtatatgtaaaatgaaatgaaaagtcgggtttccctaagctcagatgtcagttccatatttcactatcaggttattaaaaagggctcaggaaggtgacaaagtacagattttattacacttacagatcattgtaaagattaaatgaaataatgtagtaaagacaaatagagaactataaaacactatacctgcataagtattgcttagggatggctcatttttggctagggagaagttaagacagcaatgtatatagaaaaggaaaagagattccactaataacttggtaggctgagaaaatgtttagctctggtcactaaaaccaaaatcaggatattcctgggagattcattcacatcaggataaaatggtacaattacgcaacactcatacagttacattctaaggaagcaaacagcgtagagaagatggaacctcataaccttcataaataaaagtgagacatcactgtctctttgaggtcttctctaacacaagcatagacctaagcactccctttccattgtactgcccaggtcctcatagaacttcagccaacttaccactcagcactcttctctacaaagctctctttataagaaggcggcttcctttctactaggatgcaaactctccattaatgtgtgttagaatgagctaaaacagtatttaagcaattcagtaaaagcctctgaagactctgagttgtaggcagatgtaggggaacaggcacaggaagtagagtaggaagactgagcgctgctggctcctactgtgtgctctgtgagaatgtgatcaataactaaatatagagaagattgtactaactcaccaaaacaaaaaagcaaatataagagtaataccagtttccttgcagatatgttaagaagaacaagtaaggggaaaaaaacagagaaaagataatgtctgaaatatagtaacagcccaacatatattaaccttttatttctatcttgtgattcttagggcagtaatatcacaaaagagaagtctcagaaggataaatcttcaaactacagtattgtggttgaacctaaaataaaataagcaagcatggagatttaaaaaatctattatttttagttaaacactggtagcctctttgttccttcaatatatacttattgagcacctagtataggccagtcatggggctgagaaaggaaattatgctaaccagaagcaaaccaaagcaagtacacaaacaacaaaaccaagaagaaaacaaatgaaaacatggtccttcacctcacagggcttacagactgattacttttagatgtacaataaatattgtacagatattatgactatcactatgaaaagtttattctaaaataatttcaatgagtttatgctagaaatcagacaactgcaagataggtatcataacttatatactatattgaggagtgtgtaaagttaacatctttctaaagttgcacaaggaagccagactatattaaggttatggattttaagtgtctcaaagagactgccacagattatctaaaatatctaaagaaaatattcctacccatcttgagttagtgttcagttagatactagccatgatgaattttaagcctgaaggcaaatcagattatgcctccaagtctctaatcagaatttggaaaaagttcaattttgagaatttaactggctgaatctcagctaatatatgtgtgtctgaggcatctttggggatgaccccaatggaagtattaatattgatttgaatatatgtatattagtcaggggcttggagggaaacagcatagttaaactgtgtaactgaagaagagcttaatacaggaactgtttataaaaatgtggggaaggctttagggaaatgaccagggagattgtggtgcctcctcaccatcctacctcctcctcctccaacagcagcatgaaaccattactaaacctaggcctagaggattaagggggaattagctgttacctgaagctggaggctagagaagcccacctgatagggatacaaccaaccctgtacattcatcccactctcagagctccccagtcccctcccacaggccaaaatcaaccagaagtcagagggcaagagagatccaaagagactagcctcctggaacacagaaaagaacaaagggtgaaaaaaggatctagagagagaaagagaagacatttagtgtcatataagtctttagaattatcaagaacagcctcaccagggccattttccacttaaaacacttaaagcagaatgtttttagtcctctttaaaagtagttctgttcagactatttaaaaacataaatggtgggaggtgtccagcaccagataaacactatggtccaatgatgaaaattgtaattccagattcagagacttaatttaagaaaggacaacaccaataataacagtaacaagaacataaattagcatttgttgaatacaacatgaaatttctgacactttacattatttttacaaaactgttagttctactaacccttgtaaaaaccttgttaggtgatgtcagtgttttattatttttaatagatattttacagataagaaatctgtagttgagaacagctaagtgacaaaaatgggatttgaacaaatctatcagacaataactcctgtctccaccgtagtccacagctagtagacaacttttcccattttccttaggacactaatatttaatagtttgctcatggaagctaatatttaaatatgtaaaattcagtaatttgaccaatcaacatccagcatgctagaggacttacacagaattagtttaatatagtttctatggagtatttaaagtctctgataaatttctgttaagtatttctatgtaaacatgttttgtttttggtgtagggtaagaatttttcatatggtttataacagatgtactcttaaaatgcattactaagactttcattaaattcaaagttttcagttgatggattagacctgacactgttatgtgactttgtgctaggtaactgatgtctcttaccttcaatctcccaatttttaatatggatgtaatgatacctgcacttcaggagtgtgtatggaccatattaagctatgtatacaaagtgtctggtactgtttattatcagactctcaagaaatattcatttgtatcctcactgttttatgtccaaaaggttgtatggagaggtaatctgaaaagtactagcactctgactccttactaggtaaggatggaggtggagcttagttgcgaattgttaccaactcaactggatgccaatgccattcatgtacagactctgattacttccctacctccatcaatatttatatcatgtattttaaaaatgtgtttagttaatgtattgccacagtcgtaggtatgaattagaagggaaaaattatccaaaaccgtatttattttagtgacactgtgacctgataaaggtaaatagttattacagattgtgaagtaactgtgggtagaaaactcactttccgttttaatttgcttctcttaaaacacttgagtctagtatattagtaattaactaagacaaaaaatgaaaaataaaaaaggtaagttagaggattaatacagttccaatatcccaaaatggatgttctggaagagaaagaaaaaaaaaagaggtgaaaaaactattgaagaatcaattcaagaaaatttcccagaaatgaaaaaatcggatttttcaaactgaatctactattataattcctaggcacaatggatgaaaagagaccataccaagtcacattcactattcatattgaaaatccaacagaattctcaatggtagggacacagcattgaataaaaacagataacgcccatgttgtcatgaagcttatcgtttagtggtcaggaggacaaataataaacaacttgcaatgtcataataactgctatgccaaataagaagagtaggaaggatcaggtgaggggagtttgtggattactttatacagggtaatcagggcagtactcacgaacaccccatgcaaagggaataggaagtgcaaaggttctgaggcaagactttgcttgaacatgttggaggaaagggaaggagctaacacagctacagtatactaagaataaggagagtggctggggatgagatcagaaaagtagccaaggtggggtgggggacatgtcatgtaaaagattctagacatatcattgtgaaatttcaaaattctgatgaacagtaatactaaaaacagggataagaaaaaatgaggtcacaggtaaagcttaaaaagttacattgccatttcattctaactgtttaagttataataattctaaacaccagaaaataatgaaaaaatgccttcataatctgaggaaaaataatttcaaacctaaaagttttcacacacagccaaactgtcaacaacctgtgaaggtagattaaggtagtttaagacatgcaaaatatataaaaattcaccactcatggactctttctcaggaagtagaggatgtgttccagcaaaataaggtaataaatccaagtaagaagatgacttttcattggtttatgcctaagaagtaagataggacatagggggtcccaaacagaatagaggaagtccccaagatgtaagggtagatcccaggatggatgtgcaggaagcttaaagagcaacttccaaagcaagcagacagaagaatctaggagaggtattccccaaaaagatgatattgtgggaaatacttattttatttatattgacaagagagtcgcactcagagctggatatgaattactggtacatagaaaactaaacaaaggaataagataattattgtgaggaaaataaaacaaaattataagaaaatgcaaatatagtaccatacacaattcagctatgaattcaggtgatttcagagccaaaacgatgaccaataaattaactgaaaattatgatataattgtattagaaagctttggtaggagtggctgcagtggaagggggtaagaaatggagggagaaaagaaaagatgcagaaaaaaaaagaaaagaagagactatgaaagtagatgaacataatgataagatagaaatatatggcagggcgcagtggctcatgtctgtaatcccagcactttgggaggctgaggcggggggatcacaaggtcaggagttagagaccagcctggccgatatggtgaaaccctgtctctactaaaaatacaaaaaaaaaaagaaaaaaaaagttagccaggtgttgtgatgcattcctgtaatcccagctactcgggaggctgaggcaggagaactgtttgaacccgggaagtggaggttgcaatgagctgagatcatgccactgcactccagcctggatgacagagcgagactccatattaaaaattaaataattaattaattaaataaaaaaatgaaagaaatatatgagaatttaagataaaataaaaggggtagtttatttcagtaggaaaacagaattaattaaccagcctgggcaacaagagcgaaactcagtctcaaaaaaaaaaaaatactaaggagtagttatatctagataacaaaatcatatgtgatttttattttctataactttctgtatttttcaaattctctacaattaacttttcttacttttacactaatacagttatacaattaatgcttttaaactatctcttcaagtttaaaggataggtttaatcatgtaaatattttgtcactgaggaaattttaactggggctcatagactttctgaaattatacgtaaaatgttgtattagatgggaaggaatccacagtcttgttagagtcttgacgacatccatgacaaatcaatgaaagataaaattaaaaagaataaaaacaccctaaaaatatccagttcatttataaaaactactcaagttttacttatgctatgaatagtctcaaatttatctccctgggcccaaagagaaactgctagctggcttgttcagagggtactcaaattaattcatcaaggtcctccaaaaatcaaagtactttcttctttagataggttttactagcattaaaacacatatgacaagttgtaaaatcaaaatggatgaaaagagctgtgtgtctaacacccaccaacagctcacaatgcctaatgattagagtagctattcatattgagagctattcatgttttttgtttttacatcatttgtcataataatcagaaatgaatgatttccacttcatcgtacctagaaacattgaataatattggttagtaagtgactgagtccacttttggctttaaaacatgtacaaatagctatctcattatatgtaaacaggaaagactcctctggttgttatactgtttgaagtattaggacttctttaattctgtaattttttttaataacattaggagaaaactatttttcaatataaacaaggcaagtgaatacagcacataaaatacacatacacaatttgaaggaaatgattttgacaaagtttaaaggtgtattataccttggtataaaaactaaaacttgataaggactaatttggcaattcattaaattatactttactgggtgtatatattgcatggcactgatttttaaataactgaatagttattaaaatcttggtattatttcaaagtagcatgtaactagatttaatcatcagatatttccagggaaaaattatgtttctgttctttaaggtgtatttttaaattaacattcatttctcaaggacattgatttgaaagagctatttcacttcccgttagtgcaaggaaaaaggataccatttaaactttggaagggcacagaaaaaaaataaacaaatctgctgaacataatttcctctttattgcttttgaaaagttatgaaatcaaatctattatttaattacattggatcaagaaacaggaagaaaaagacgcatttaagtcacaacactcctaaaagaataaattactatacttcctttgggaagaaaagtgttttaatatgtggatgggtattgtccaaacatttcaaatctactttgctgaggtggtacgtgtgataggctttaaacaaaaaatcaaaacaaaatagcaaaatgtcaaaattgaaggaattaaaaaaactgctaggattgatttcagtatttctgtactattaaagaatttaatttttgctctcaaatctgtttccatcacctaactttaaaaaaatacaactcctgggccgggcatgtaatccagcaatttgagaggctaaggctggtggatcactcgaggtcaagagttcgagaccagccaggccaacacggtgaaaccctgtctctactaaaaatacaaaatttagctgggcgtggtgttgggctcctgtattcccagctacttgggaggctaaggcaggataatcgcttgaacctgggaggtggaggttccactgcagtgagccgagattgcaccactgcactccagcctaggcaactaagagagactatgtctcaaaaaaagaaaaaaacaaaaacaaaaaacaaacaaaaaaaaccctctgacctaatcacagcaaaaaaaaaaaattttgctagataaatagggtttatctttgctatgcttgaataaaatgcacaagatgttccagattaggacaactgttatacaaataagaataaaggctttcagctttttaaactggcaacaggattttgcagttggtcagactctgtcaggggacttatgggatgaacagtgatcacacagtcactgcccttataccatctgcagcagggtttgacaaacttttaatataaaggaccaaataataaatatcatcagctttttaggccatatgctgtttcatctattcaaccccaaggttgtggcatgaaatcaaccataaacaatacataagtgaatgagcatggctgtgttctgacaaaactctatttacgaaaataagcaaaggatgccgtatttggcccatggggctgtagtttgctgacccctggtctactgtagtgtggggaaaatatgaaaattatatagtgggaggaaaaatgctatactataatgtaaaacaaaaacgagcagtactgaacatgaacttagactttattgcaatctacattcgtacatgcagattaagaatagtcacaataagaaatagttgtttgaaagttttgacacaactgtatgaagtattgttaagacagcattcggaaatgttgacagttaattgcaaattatatacttgcaaagtcctgttttctcctaatgctttcaccattaccaacacagagtggcttttcaaaaacaaaaacaaacaaaaaagcttttcaaagagaaattcatactcttgaacaacacattaaatattctgtttttactgttcttatttgctctcaaataataatactaattaccaataatcctgttgaataacagagaagccccacaactttaacatgtgtaattaattaaatatattgaggttgatacggaaattcagacaacaaacccacaatatgtcacaagtttttaacttgttagttttaaactgaatattctgtttccttctcttgagagatttgtccctcccttatatgtgaggccaagtaattggaccccaagctctcaatgagcaatttattttttccatttcaaaatcttagcaaacaaatctcaccagagaactggtggctactttctatcttgtcctagagaagcaagactaaagtgagctttagttttcaattcgttttcattcatttacttaaccatacttactgagtgcccactacacactaaacactgtgctaggagctagggtgccatcgtgataaaaacagcaatatccctagcttcaaggggcttccattacgttagggaataaataaataaataaatgaaatatttacaagtcataataagtaaaataaaaaactcagttcactgaaactgcacttaaaggcaggggagacacctacattagacaatgatgtcaaggaatgcctttctaagtgggtgaccttttagctgagacttaaaatccaacggattaaagggctctggttattcaaagggcattcactggagagagagtggtggtgagtagctaccaggtacagggaagaacatgtccaaagacttctggacagcaaataacttggtctatatgagaaactgagagatgacaatggtgaaagagaaataagaatgaacaagtgaggacacagaaaaaggcagttgccaactgatgcagggcagtgttggctatttgtttataaaccttcaaaattaatgaataataaatgccaaattttccaaatcagaaaaattgcttttgaaacagaaatttccaggagcagctgaaaatgcaaagaaaaaacatgccatttttcttaccttccaccttctttttcttctttaacatctaaacatttcttcctcactagtcagtagtcctaggtacaggtaaaattaagtgtctcctaccaataggatattgtaaagatatctgtatattctcaggactcagtaatttttctgggttccaatgtcctcatttcaaatattggataatggctactccttcttagggttatgagatgattatgggcttatcctacaaagtataaagataccatggtacgcaggcctccatcaagggtaaaacaaagtgaagcataagtgtgcagcacgtcttccagaagtgtcaactatattagagacagtaaataaagtatcatttttatgttaaaaaatacagatacagtatggcatagaataaaaaacttgaatttaatattatgaaagaaagctttttaaaaaacatcaaacttgtttaaaaatccattcagtctggctgggcgtggtggctcacacctataatcccagcactttgggaggccgaggcaggctgatcatctgaggtcaggaatttgagaccagcctggccaacatggtgaaatcctgtctctactaaaaataaaaaaattagctgggcattttggcaggcacctgtaatcccagctacttgggaggctgaggcaggagaattgcttgagcctgagaggcagaggtcgcagtgagccgacatcatggcattgcactccagcctgaggcacaagagggagacttcgtctcaaaacaaaatccattcagtctaatccctccttatagtggtaaatgcatacctagaacatgatatggttgcttactatatgtctggaatagggcagatactcatatttggtatcataagggaaaattagttgttgttttttttaattatactttaagttttagggtacatgtgcacaacgtgctggagaggatgtggagaaataggaacacttttacactgttggtggaactgtaaactagttaaccattgtggaagtcagtgtggcgattcctcagggatctagaactagaaataccatttgacccagcaatcccattactgggtatatacccaaaggattataaatcatgctgctataaagacacatgcacatgtatgtttactgcagcactattcacaatagcagacttggaaccaagccaaatgtccaacaatgatagaatggattaagaaaatgtggaaaattagtttttaatgcttaaaaaaactgctagaagctaagttatatacctataactatttattttattaaaaaattaccctttctcaacattttgttcaaagaaggatttttacaaaacggcagtgtcctcccttactaaatatttaaagcaatatagcatacatgaaaaaagaatcttttctgtttcattggttatttgaactatcccataagaagtacacttttctgggagccttgtatcttacatacacacatacacacacacacacacacacacacacacgcacacacacaaacaccaaaaccaaggcaaattacaaaaagagtataaaatctttaacttaattaacacctatttaattttgttttgttctccatgaaaatgagagaaatgacaaatgcacacaaatagaaataaacggtcttatttatttttccaacctttattttagtgtcagggatatatgtacaggtttgttacatgggtgagttgtgtgtcactgaggtttggtgtatgaatgatccagtcacccaagtagtgagcatggtacctgagataatgttagttttaacacagtccttttcctcctcaggcaaaattcccacagggagcaatgatgagacttacacctaagttaaaaatcccttcatgacataaattctgaacatttattctacacgcagacacaatattagatgctttttagaattggaaatgaagaacaaaaagaggtgaaaacatggaaagcaaaaatgtcccagcttgccttcaaggagcttattctactatggaagactatacacatattaaaggctgaaaaaaaaggaaagaaattcacaaataaatatgatctgattatagctatgcaccattactatttgatgaaaccacattaattcagctttcactaatttcaaatttataattgttggggcatggtagagattgaaattcagcttttactcactatgaataaaactaaatgaactgaagctacaaacaactcagggctttcaagaaccccttactgcctttctaaaaatgagaaactcagaaatgtacaccatattaacagaatttattaatttcaggtatgtaagtcaagaaaaatacatttttcctatactttcatttgtaacaaagtgggctgaattatttattcaaattaagctactacagttccctcccatttacctaaacatctaaaatgctaatgctgctaataaaatagcagtagtagtagaggcagtgcagtgttaatgctaatggtagtgtccattcattgatttcttaagcctctgtgccaatctctattatcatttccaacctcgcccctatgcacttttcactgcagggctgagttctctacacaaatcctgctttgtatgcctttgaatcctttatcaggttggaataatctttccaattttgtctagctaactcctattcaacctttgaaactcagctcaggtttcatatcctcggggaaacccctaatcccctggttctcagggtatctacagcactagggaataggtgatagcactgtaatgttaggctagatctccttttctacctccactacttatctgtaaatcacttgtagtcaggaatcacatcttaccttattatgcatccaaacagctatcattagaagagacagtcaatatattacttattgaatgaatgagtcaggcactataccaggaatttaattatggtaaaacaaatactttaaaattttactgctaaaaatagcttgagagatggaatataacatgatcaaggtctcatggttactgggtgatggaatcagaaataaatccaggcctgctgggtttcaggccaggtgaccctacgctttcaactcaaagtgttatcttagattcttaggtcttagattcttggatgggatctcttccagttttagaataaagccacttctctctggccaactgaggagtcaattttaagcatgcaaactgggatttcagttaaaaaataaaaattattttagtgttacaaattgtcagtgaaggactttctcaaagctttaatcatataaatagtttgacatctctaaggtagcagttctcaatttcatattgtggattatttcacgagaggaaaaaagagtgaccaactccatctatacccactatgtcactgaaaagaaacctcatcatgactcatgggaagaatggcatctgaaaaaatacttaagaaatgtcacaagtaaattattaatccatgccataaaacagactacagatactgtcatattataaaccttagaatttcaagaaaccagctggaagaccacccagagaatcctagaagaccatcagtggtctatggggaccatactttgagaactaccgttataagaaatgaaactgcttcctcctcaggaacttcatctttttgttgggggaacacactgtccttcaagccaaaaacatcaaagtattaagacctctaaattcttctaaaatactgtcataaccccaaactaccttgttcatgggatgtagtcatgtagttgtaaatgcagatctgcttatctattgttggtgtataggaatgcttgtgatttttgcacattgattttctatcctgagactgtggaagttgcttatcagcttaaggagttttggggctaagacactggggttttctaaatacagaatcatgtcatctgcaaacagagacaatatgacttcctctcttcctatttgaatatccttttttctttctcttgcctgattgccctggccagagcttccaatattttcacatgtgcttactggtcattcacatatattcttttataaagtgtctatacaagtttttttacctgtttatcattggattctttgtcacattattactgattaataaagagtactgtatatattctaaaggcaaattctttgtcagatatatgcatcacaaatattttttgcctgtaagctgccttttcattttcttgacagtatctttcagagtgcaagttttttaatgttggtgaagttcaatgtatcactttttcttttgttgttcttcatgctttctatgttctatctaagaagtctgtctaactgaggtcatgatatttggtgaaaggggcatccttgacttgttctcattcttaaggtgaaggttttctcctacacatttttctagaagtttaataattttagctattttaatatttgcacatggcacgaagaaaggattgagattgtttttccacatggatacccagttgcttcagcaccatttgttataaataacctttccccattaaattatctaacctgtcaaactgcagaaattcaactcaacatatgcttgtctttatatctgcatttcttattctgttccattgatgtatatgtatgtctatctttatgtcattaccacactgcttgtttttttttgtttgtttgtttgttttgagatggagtcttactctgctgcccaggctggagtgcagtggcacgatctcagctcactgcaacctccgcctgccagattcaagtgataatctcacctcagccttccaagcagctgggaccacagctgtacaccaccacgccaggctaatatttgtatttttagtagagaggaagtttcaccatgttggccaggctggtctcaaactcctgacctcaagtaatccacccacctcggcctcctaaagtgctgggattacaggcgtgagccaccgctctcagcccatactgctttactataggtttacagtgagttttaaaacaaacatctaactgttcttttctaaaagtgttttgactttctaagtcctttgcatttccacattaattttagaattagctgtcaatatttagaaaacagcctgctggccttttaatagaggctgcaatgaatctgtagaacaatttggggaaaaatgatgcccaacaatattgagctttctaattcctgaaaaattactcctctcaatatagttaaggcttcttaaacttcatttagcaatgttttataattttttgtgtacaggtattatatacaatttgttaaatttacccatagataccttatgtttttggtactaaattctgatgtcactgccggtatataaaaatacaattacaattgaattttgtcgattaacattgtatctttgaccttgctaaattcatttattaattctagaaaaacttctttggtaaattgtataggattttctagctatatgattatgtttcctgcaactaaagtcagttttacttttttctttttatttgctatggcttttttcttattgttccttatgcaatgtgtagggcatctgatacaaaatggtcaagatacttggtgaaaggagcatccttgccttgttctcattcttaaggtgaaggcattcagtcttgagctttactaagtaggtttgtattggtagaggtactggtatggcaatcctgcaaccatttcttatgtattagagcactgaacaaataagtaagaatattagggttgttggtaatcaagttcttagtatgcaagaaaggagaataacatacaaaataagcaagaattggactgtgggaaaagtgatggggaaacaggaattaaagatggcccatacaaacaactattttaaggaattttgctattaagggtagcagctatagaaagaaggtttttaaaaaaggagttttcagatgggagaaataacagcatgtctttattctgataagaataatctatttttaatttttttaaggaaaatccatactattttccatatggctgtactaatttatattcccaccactagtgtgcaaaggttctcttttctccacatcctctcaaacacttcatatctgtcatctttttgacgacagccattctaacatatgcaaagtcatatctcattgtggttttaatttgcatttctctgatgatttgtgatgttcagtaatttttcatatatgtgttggccatttctatgtcttattttgagatatgtctatatacagtctttgcccatttttttttttacactgtcctaatatcaaatctttattccattaacaatcaaacttttacatcatcgccaaggctttttgttcacttaagatttggtagtctttggactagactctggaatagacaaagagcatcagtggaaaaatgcaaaatccaaataaagtttggattttagttaatagtaaagtgtattattttcttactattgagttccttatagattctgaatattaatcccttatcagatatatggcttgcgaatattttctctcattttgtaagttgtctctctactctttttttttttttttttttttttttggcagaggctttttagtttgatgtaatcccattcatctattttcacttctgttgcctatgcttttgggttcatatccaaaaaatcattgcccagatcaatgtcatggagctttcctcctgtgttttcttctagtagttttacagtttcagatctcacatttaactctttaatccattttgagttgatttttgcatatgaaataagagtctaatttcattcttttatatgtgaatatccagttgtctcaacaccatttaaaacagaactaccatatgatccatcaatctcattattgggtacatattcaaaagaagtaaacttagtatgtttaagaggtagcattactcctatgttcactgcagtattattcacaatagccaagatggaatcaacctaggagtccatcagtgggtaaacggataaagaaaatgtgctatatacaatggattgttattcagccttaaaaaggtaggaagttctgtcatttttgacaacatggatgaatctagaggatattatgttaagtgaaataagccaggcatggaaagacaaatgccacatgatctcatatgtggaatctaaaacgtttgacctcacggaagtagagagtagaatgatggttaccaggagctgagggggagggaggggttatagaagggttggggaggttttggccaaaggatacaaaacttcagttacacaggaaaacatacaagagaactgtacagcatagtgactatagttaataacaaatgtattctcgcaaattgctaagagtgcatatgtcttctcactacaaaaaaattaatatgtgaagtaatacatatattaattagctcaatttagcccttccacaatgtacacgtgtttccaaacatagtgtacatgacaaatatatacaattgttacttgtcaattaaaacaattttttaaaaaatcagcttagaaagaaaatgagaagaaaagaaggatgccaagagttcagccaccgatctgcttccaaccctgagacttctggtgctggatctcatttatgtggatcctttaaaagataaccttcattattcagggatgctccaaggggcctctgtcccacacaatcagccttactcaaacagtcaacacaagttacactcattcacagggataaaaacaggaagttaggtctacatgtgacagcatgagtcacttctcctttccacaactcaacttttaccttcacaaaataaggggtatggattttctaggtccccttttattttcctaagttcttgtatcaaatgaaactataatgacatttcacgacttgcctgccactaattttgctgcccgctggcaaccaaactcacagttgcgccaactcagagtttaagtgactgtaagagcagggccttggttaaagtagtctttgagtatacacaagtagcttcattgtttatagcttaactcagaaagaaaacgaaaacaaacaagcaaaaaaccccttcactttttactatatttacctcctgatggaattatttctacccaattctaatccttataaaataaggacaatattgataatatactcttaaagcagccccttacaattaaaatacagatcaatttgcataatagttacataataatatggaaaaattcatgttatgtatccatcaataaaataagaaccaaaagaataaccacaataagactaattacttgacagtaagataaatatttggtaccctctttttaagcagcagaatgttctggggaaaatgaaatcatatatgaaaccccttaccatgaacaggtaaaacagagctcctttaattcaagtactccaagtatggcaagtctaggattccacccacaaggacatcattatctcctgagtaaaatctcctgaagtacttctataaaagacagtttgaaagccactgcagcagattatctaggtaagctatagcttaagaaacaggatactcagagccaccttgccagtcagtccacacacatggtttagcaaacactgctttttctgcagtgtgtgtgtgtgtgtgtgtgtgtgtgtgtgtaaaaagaagatacttccatttgaaatacctataaaccacaaaatcatctgggatcatggacattttcccaagaatatttgcataacacaattaacacaaaataacacaagaagttaatacagaagcattgaaaggcaaagaaaaaaaaaacccatagtttggttttccatttaggaaattttcatgggggcgggcagggaaagagagggaggcacaataatcatttgaacctataaattaaattacaattactaaaatgttcttggtctccactgcagtattcagtagaaaataaaccatgccacatatatttgatattaattttgttttaaagcctcacggaagacagttttctgattttgcatgttgataatacaaggtcaatgagtaggcatgttacatttcaaaagctactttctcacattccccagtgttcaaatacttagaaacttgatgttaagtttatatattggctaattattctccgaataatctagtaaagagtagaaatgtaataatgcaggagagaaaagtgctgatgtccttgtgtgtataagagggtatgggattttttttttttttttttttttttgagatggagtctcgctctgtagcccaggctggagtgcagtggcatgatctcgactcactgcaagctccgcctcccaggttcatgccattctcctgactcagcctcctgagtagctgggactacaggggcctgccgccatgcccagctaattttttgcatttttaatagagatggagttttgctgtgttagtcaggataggatggtctcgaactcctgacctcgtgatccacccgcctcggcctcccaaagtgctgggattacaggcgtgagccactgcgcccagcctgagggtatgggagtttaagaacaagtggagaggttggggaatagacagttaagctacaatatggggagggaagacaggtatgtgggcataagtacaggaaaagagcagatgaagtagaaacatatgaaaggcctgttatatttcctcatacttccttagagaggtaggaagcacagctataagctgagaatcaggataggaaataacttgttagaaattcaaagaaaaagaaaaaggtataacacatcatccaggatactgggagagtgaaataaatagggaaaaatttatgtataatacatatttattaaatatatatttatcaaatgtatgtatgtatatatatttattaaatatatgtatttatacatatatcacaggacagtattaacaactcattaaaactctaaagttagtggtcaggaattactgtaagcatgttgtatttatctctagcaatattcagctgcattggtacagtttaaaagctgctaaagagcagaatttaaccagtgttgagtattgccagctgaataagacaaatgaaatgaggccaagggtactaagtacatatgcaaaggagtaattataactattgagcataaacctttaaattaggtgacagacaatgggaggtggtgattggagagtagaatactctaaattgaagttacacaggagttgcagtcattgtaaacaacaaggtctagggtacaatcatggaattaatggctgaaataaattggaggacagtgccattggagagaaaatgaaaaactgaaagtccaggatactagaaggatcatgcacatggctactgaaatgatcaagaattgtaacaggagtattatagacaaaagcacaatgagccagacaataaaatcttttgagaaatcagagggaatcacctaggtatttggcagtattgtctgatagaatgatatatttagttacaaggaggtgcacaaaaagctcttttgaagagagtcggtgatagaagattcggaatatattttctgaaatgggataattaactggtggaaagactatgtcattaagtagttatgagtttttaaaaagcccatttaaaaatgagattgctgtaatttatttatgttgtgatattcattctgaaatttaaattaaaattaaagaaaagcatgaaacttgtttatcaggtgacaagagctaaggactgttgcagatacatagctataccaagttacattgaaaggttttataggaatgtgctaaatacaatttccagattatggcatgactacctttcagtagctttgcaaaaaatccagtcatacaaacagtagcattttgtattgactgcgtttctcagtggatgactgtcaatgtaattagacacctttgactcagacactcttatttagctaaatttaaagcaataacaaaacaaaacctctacataaatacggttcttagaaaatgccccattattaccaacagacattaccttagtcctaaagtcatgagaaataaatccatagactacaccttaccctaaactcctgtactggacactacaccagaggctgggaatgcaaagatgactaaaatgtggtccttaccttaggtagatcatagtttaatgggcaagacagaccagaaaaggaggggtgagtagaagagtatgaaagaggataaggacatttcagatagaacaggcaatgcagaagggggtaaaaaggtatgtgtgatatgagagtgaatagagtgagagaggaaaaaggaagagggagaagagagaggaagacaggtagagagaagggaggtaaaaagggagggaggagagttgagaataatttcttgtttttggtggttttgtttttagagacagagtcttactctgatgcccaggctagagtgcagtggcacaatcatagctcactgcagccacaaacacctgagctcaagcgatcctcctgcctaggccttcttagtagctgggactataggcatgtgccactgggcccagcttttttgttttgttttgcctttttttttttgtggtatagatggggtctcacaatgttgcccaggctggtctccaactcccagcctcaagagattctcctacctgttctcaagggcattgtcgaaaacaacagcaattggtggcaagtaatcaggaataccaagtgtggctaacagaatagcaaccaaaaatttaaaatggaaatctgcagaagatacctgatggggttcaagaaatactaccccaaaatatggcacttcagcatttgagaaaacagtatggtgaggtgcaagaaacacaactccaaaataaggcatcttgaaaattgagaaaatagcagaggcagaaagtccactctcatttctccttcacccttcatccctaaagcaggctataaaacctaaaagggtcactctgatggccgggtgcagtggttcatgcctgtaatcccagcactttgggaggccgaagcaggcggatcaccaggtcaggagatcaagaccatcctgtctaacacggtgaaaccccatctactaaaaatacaaaaaaaaaaaaaaaaaaaaaaaaattagccgggcgtggtgatgggcgcctgtactcccagctcctcgggaggctgaggcagtagaatggcatgaacccaggaggcagagcttgcagtgagctgaggtcacgccactgcactccagcctgggcaacagagcaagactccgtctcaaaaaaaaaaaaaaaaaaagtcactctgactttctccctcccttctcccctgaagaccatcaggtgacaggtgagctcgcctatacccagagagagggaatgaaggcactgaaatgccaagaaaaatctgaacaaacaggacttgctaagttcccttcagtttatgtgtcacataaaatttatattaaataaatttgcatgcctttctattgttaatctgtcttttgttataggggtctcagtcatgaaccttgcaatgactgagaaatcttctcccccctgtaagctgtagtaggaaggtctctcttaccttctcctacccttctcccctgaagcaggccacaaaagaattctctggcctttctctgaagtaggtcttaaggccctcatgtaccccacacacagaggcaaggaatgtcgcacagggatacagagaagactgaacaaaaaggtcttgctgaaatctctccagtttattactattagatcatatctctctttatccaatcagacttctgcacaaatgtccactcttcatttaatgtagcataaaaatagtttttccagtttctttaggttttaatttctgaaggctcctgtgtcatgtaaaatttatatgaaataaatgtgtatgcttttcctttgttagtctatcttttaatacaaatatctcagccatgaaccttgcaataagtgaggaaaagataaatcttttctgccactatgtagccattgggggctttgaaaagttccaatatattcctgagaatctgaacagattacacatgcaccaggttacatgcatgcttaggaaagaccagaaaagtcctcagctgcctacttatcaattgtagaccacgagatcctgtacaccctgagcagactatgaagtgaaaccacaggcagacttgtaaactgcctgaactttgaatgtgtgccctaatatacatacagatttctcagcaaaagtggaagccttatgggttcaaaatgtttgaacccataagaaaacttttaatcactggctgaccattaaaacttgctgccccaggggtaatcactaaaaagccatgtttaagcataatagcaactattaaattaaaaaaaattattaaattaaatttagaaaaaaacttgagcagagacttcagtggttatatacagaaaggcagacagattttatggaattagtaatttcactaaataaacaagaatatgagaaacaacatccctagaggtgacagagattctgagagttgctaaaatatattatctaaaggttccatgctcatggagggtagaatcagtattgtgaaaatgaccatactgccaaaagcaatctactaattcaatgcaattcccatcaaaataccatcatcattcttcacagaactagaaaaaacaatcctaaatttcatatggaaccaaaaagaaggctgcatagacaaagggagactaagcaaaatgaacaaatctggtggcaacacagtacccaacttcaaattatactattaatacatggctgtattcaccaaaacagcagggtactggtataaaaatggcacatagacccatgcaatagcatagagagcccagaaataaagccaaatacagccaactgatcttcgacaaaacaaacaaaaacataaagtggggaaaggacaccctattcaacaaatggtgctgggataattggcaagctacacgtagaagaatgaaactggatccttatctcttaccttatacaaaaatcaactcaagatggatcaaagacttaaatctaagacctgaaaccataaagattctagaggataaccttggaaaaaactcttcttagacactgacttagggaaagacttcatgaccaaaaacccaaaagcaaatgcaacaaaaacaaaggtaaatagatgggacttaattaagccaaaaagcttctgcacagcaaaagaaataatcagcagagtaaacagacaacacacagaatgggagaaaatattagcaaactctgcatataacaaaggactaatatccagaatctacaaggaactcaaacaaatcagcaagaaaaatacaaataatctcatcaaaaaatgggctaaaaacatgaatagataattctcaaaagaatatatacaaatgatcaacaaacatatgaaaaaaatgttcaacatcactaatgatcaggggaatgcaaatcaaaaccacaatgagataccatgccactttactccttctagaatggccataatcaaaaaatcaaaaagtaatagatgctgtcgtggatgtggtgaaaagggaacacttttacactgctggtgggaatgtaaactgtacaaccactatggaaaacagtgtggagattccttaaagaactgaaagtagatctaccatttgatctagcaatcccactcctgggtatctacccagaggaaaataagtcattatatgaaaaagatacttgcatatgcatgtttatagcagcacaattcacaattgcaaaaatatgaaaccagtgccaatgctcatcaatcaatgagtggataaagaaaatgtataggtacatcatggaatactcctcagccataaaaagaaacaaaataatgcagcatttgcatttgcattatttgcatttgcagcaacctgggtggaactggagaccattattctatgtgaagtaactcaggaatgaaaaaccaaacattgtatgttttcacttacaagtgggagctaagctatgaagacacaaaggcatgagaatgacacagtggactttggggacatggagggaaggctgggatggggtgagggataaaagagtatacattggggaaagtgtacactgcgtgggtgattgggtataccaaaatatcagaaatcatcactaaataacttatccatgtaagcaaacattacaagtttcccccaaaccaattgaaattaaaaaaaagttccagtcttaaacaacaacaaaattaccagatatgcaaagaaagagaaaaaatctacagcccacacacaggaaaaaaggcaatcaataaaaagtgtctcagagagagctcagatgttggacttaggagacaaaggctttaaataaggtattataaacatagaattgaaagatgtatttgagtgtatttcacaaagacctaaaacaaatacaattgtctttctaaaacgtaaagaatatattaataacatgagatataccttaggtaaacatagaagttcaccctaaaaataaaagatattgatttaaattgtttaaatgatttctttgataatgtttttcctttttaaaatccttcttattatggactcaatcttttatcaattcttcctagagagaaatcagataatggtaccatattttataatttgaagacaaagtttatatcagtcttttatctcatttctagacatatgtaaaagtacattaaattaaataaagcaatgtttccagcaatgttcacttagaaaaatcaagatttttttcttaaaaaagaattggaacatagaaggtattgtgatgacacaaaacccaacagagcctgacaaaactaactaaactaaaaaaacaaaaaacaaaaaaacaaaacaaaaaaaacctaatagagcctgacaaagtgaaatgctaaactaagctttaggcttctaccttgaggaggactcagagttgagaggatggcagtatttattttgctgttcagtgtaactcatagtttttcagtagtcatgtgtctcattgagacaaaacaaagaatgcttggacaaatgataaccacatattttgcagggcctggaatataaagtttaattattgggtctgtgaacagaggcagttactttgaaaacctggatttgtgaaagactgccatttctgcagacaaactgctgggaaagccacagtgtgagggggaaaatgtcacttcagtcagtaggatcaaaaacaagaaaaaagaaaaatctaggacaaagaattgcttaagtaaacacagcaaaggcagttccagagagaactaacatatcaatgtgacggttactacgtgaaaatgttgacaattttagttatacacatgaaacaatgccaattagagagtgatataagttagttatctaagttaaaagtatctttttagacacacgaatgtgagaaaattatggggtgcttatttttttaactttaatgtgcattagtggattattttgatagaaaacagattccattttaaactccttattattggaaagagtaagacaagagatgaagcaagatgaaactaaaataatccatgtgagatcagagcctccaaacctaaaacaaaccctcacaccagactcttagtcctagaaattatgcacatttttggcagtttagcaattgatttcttatagtcaaggttttgtaccttagtttcctcatctggaaaacagaaacactaataactataatttatattcactatttaaactcttatttatacattcaacaaatatatactgaacaccttctatattctaaggaatatgctatgcatacaattgctgtaaagattaaaataatggatgcaaagtacttagtacagtgtctggcataaaatactgttatattatacagagtgattttcagtttggggatacaccctggcgaggcccttatcagaagtacctgtggggctctttgaaatcttacatactggttttaagattccaacccttcctactaaaaggagcgttcagctattgttgagaaacactgcactacagtataacttcagctccctttccaggttcattatgattcattatcccttcccctgccccatcatttttagctctagccaaactcactacgcattatttactagtctatgaagttgctcatatgaacacctatctgctccttttggctttgaacgttttccctctccacttacccatctttccatgtgaaatcttattcatccagtaagatctacccgaattgcaagtgttttataaagctgtttttgatgctttaagtaggtctgatcgctctcttggttgactatttaagcactttgtacctttttctttatgacacttatatttataatataggtgtaagataggaagcatcaggaggataagatctgagtcttactaatctttgctttcctttccttcatagtattttctacatagcatagaaccaagttttggtatacagtactggaatatactctattcagaaattagggattgttccctgatgaacattggtgcaaaaatcctcaataaagtactggcaaatcgaatccaaaagcacatcaaaaagcttatccaccatgatcaagtcagcttcatccttgggatgcaaggttggctcaacatatgcaaatcaataaatgtaattcatcacataaacagaactaaagacaaaaaccatatgattatttcaatagatgcagaaaaggcctttgataaaattcaacatcctttcatgttaaaaactcccaataaactaggaattgaaggaatatacctcaaaataataagagccatatataagaaacccacagccaatatcatactgaatgggcaaaagctggaagcattccccagaaaaccagcacaagacaaggatgccctctctaatcactcctattcaacattgtattggaagttatggtcagggcaatcaggcaagagaaagaaataaagcatattcaaatagggagagaggaagtcaaattatctttgtttgcagatgacataatcctacatctaaaaaagcccatcgtctcagttcaaaagcttcttaaactgataagcaacttcagcaaattctcaggttataaaatattgattttaaaatgaaaaaatcactagtattcctatacaacaacaacaggcaagcagagagccaaatcataaatgaacacccattcacaattgccacaaaaagaataaaatacctgggaatatagctaacaagggaagtgaaggatctctttgaggagaactatcaaccactgctcaaggaaattacagaggacataaacaaatggaataacattccatgctcatagataggaagaatcaatatcgtgaaaatggccatagtacccaaagtaatttatgaattcaatgctattcccattaaactaccattgacattctttacagaattagaaaaaaaactattttaaaattcatatggaaccaaaaaagagcccgtatagccaagacaatcctaagcaaaaagaacaaagctgaaggcatcatgctacctgacttcaaactatattacaaggatacagtaaccaaaacagcaaggtactggcacaaaaacagatgcatagactaatggaacagaatagagatctcagaaataagaccacacaccctacaaccatctgatatttgacaaaactgacaaaaacaagcaatggggaaaagattccctatttaataaatggtgctgggagaactggctggccatatgcagaaaactgaaactgtacccttcccttacaccttatataaaaattaattcaagatggattaaaaacttaactgtaaaacccaaaactatactagatgaaaatctaagcaatagcattctggacacaggcatgggcaaagatttcatgacaaaaccaccaaaagcagcttcaacaaaagccaaaattgacaaatgggatctaattaaactaaagagcttctgtactgcaaaggaaactatcatcagagtgaacagacaacctaacctacagaatgggagaaaattttgcaatctatccatgagataaaggtctaatatccagagtctacaaggaacttgaacaaatttacaagaaaaaaatacacaaccccattaaaaagtgggcaaaggacgtgaacagacacttctgaaaagaagacattcttgtggcaaacaaacatatgaaaaaaggatcaacatcactgatcattagagaagtgtaaatcaaaaccacaatgagatactatctcatgccagtcagaatggtgattattaaaatgtcaagaaacaagatgctgccaaggctatggagaaataggaacgctttaacactgttggtggggatgtaaattagtttgaccatagtggaagacagcatggcaattcctcaaagatcaagaagcagaaacaccatttgacccagcaatgccattactgggtatatactcaaaggaatataaatcattcaattataaagatacatgcatgtttatgttcactgcagcactactcacaatagcaaagatatggaatcaatccaaatgcccatcaattatacactggataaagaaaatgtggtacatatacaccatggaatactatgctgccataaaaaggaataagatcatgtcctttgcagggacatagatggagctgcaagccgttatcctcagcaaactaatgtaggaagagctaaccaaaaactgcatgttctcatttataagtgggagccaaacgatgagaacacgtagaaacactgtggggaacaacacatggggccttttagagggggcagggagagggagagcatcaggaagaatagctaatgcatgctgggcttaatacctagctgatgggttgatctgtgcagcaaaccaccatggcacaagtttacctatgtaacaaacctgcacgtcctgcacatgtacaccggaacttaaaataaaagttgaagaaacaaacaaaaaaagaaattagggattgtttatgcttttaaaaacaatttcttacaatgtagattgataatctttattataagcttttgcaatatgtgtatagttctaaaatccattatgactatatatatcaatatcagactaatattttatgtgatacttatgaataacataattctagtcatgatatctttgaaaatgataccattgttctgagctgtaaattcagagttacaccccaaaatcaattgtggtacagccagttttttatccataagctgtttttttttttttttttttttggcaaagactcaaattctaattgaaaggtattaaattgggtgatgtgttatatgaacacttacacactaaaacacacactattaaaattagtgttatttaatatccaaattttcttgatattagacattatccagtatcaattcacttttaaacacaaagtaaacaaatttttatatgaatatacaccttatctagtatttacactggcgtctgatatggcaaaggatacagatgcctcttttaggtgaattatttcaattcagtccataataaagttgttgtaatactgttgggaaaagttattacattcatcttagaaagtaatttacaaagtaacacaaataacatttgaaaaagttgaaataataaaaattataaatctacactgtactaaattctagttttcaaggcataaatccagagcattataaatatcataaaattataattctgagacactaacaaatattacagccaagacacactaaatggagcatcaaagcggatcagccttctaaagagtacactgtaggggtgaggagccaagatggccgaataggaacagctccggtctacagctcccagcgtgagcgacgcagaagacgggtgatttctgcatttccatctgaggtaccgggtgcatctcactagggagtgccagacagtgggcgcaggccagtgggtgcgcgcaccatgcgcaagccgaagcagggcgaggcattgcctcacctgggaagcgcgaggggtcaggaagttccctttccgagtcaaagaaaggggtgacggacgcacctggaaaatcgggtcactcccacccgaatattgcgcttttcacaccggcttaaaaagcggcgaaccatgagattatatctcacacctggcttggagggtcctacgcccacggagtctccctgattgctagcacagcagtctgagatcaaactgcaaggcggcagcgaggctgggggaggggcgcctgccattgcccaggcttgcttaggtaaacaaagcagaaaggaaactcgaactgggtggagcccaccacagctcaaggagacctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccgaaaacccatctgtacatcaccatcatcaaagaccaaaagtacataaaaccacaaagatggggaaaaaacagaacagaaactggaaactctaaaatgcagagcgtctctcctcctccaaaggaacgcagctcctcaccagcaacggaacaaagctggacggagaatgactttgacgagctgagagaagaaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagctgatgtgatcaactggaagaaagggtatcagcaatggaagatgaaatgaatgaaatgaagcgagaagggaaggttagagaaaaaagagtaaaaagaaatgagcaaagcctccaagaaatatgggactatgtgaaaagaccaaatctacgtctgattggtgtacctgaaagtgacagggagaatggaaccaagttggaaaacactctgcaggatattatccaggagaacttccccaatctagcaaggcaggccaacgttcagattcaggaaatacagagaacgccacaaagatactcctcaagaagagcaactccaagacacataattgtcagattcaccaaagttgaaatgaaggaaaaaatgttaagggcagccagagagaaaggtcgggttaccctcaaagggaagcccatcagactaacagcggatctcttggcagaaaccctacaagccagaagagaatgggggccaatattcaacattcttaaagaaaagaattttcaacccagaatttcatatccagccaaactaagcttcataagtgaaggagaaataaaatacttcacagacaagcaaatgctgagagattttgtcaccactaggcctgccctaaaagagctcctgaaggaagcgctaaacatggaaaggaacaactggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatcttacgtgcagagatacacagaggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacgcagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagtggacctaatagacatctacagaactctccaccccaaaacaacagaatatacatttttttcagcaccacaccacacctattccaaaattgaccacatactgggaagtaaagctctcctcagcaaatgtaaaagaacagaaattataacaaactatctctcagaccacagtgcaatcaaactagaattcaggattaagaatctcactcaaagccgctcaactatatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaatcaatgaatccaggagctggttttttgaaaggatcaacaaaattgatagaccactagcaagactaataaagaaaaaaagagacaagaatcaaatagacacaataaaaaatgataaaggggatatcaccaccgatcccacagaaatacaaactaccatcagataatactacaaacacctctacgcaaataaactagaaaatctagaagaaatggataaattcctcaacacatacactctcccaagactaaaccaggaagaagttgaatctctgaatagaccaataacaggagctgaaattatggcaataatcgatagtttaccaaccaaaaagagtccaggaccagatggattcacagccgaattctaccagaggtacaaggaggaactggtacgattccttctgaaactattccaatcaatagaaaaagagggaatcctccctcactcattttatgaggccagcatcattctgataccaaagccgggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaataggtgcagaaaaagcctttgacaaaattcaacaactccttcatgctaaaaactctcaataaattaggtattgatgggacgtatttcaaaataataagagctatctatgacaaacccacagccaatatcatactgaatgggcaaaaactggaagcattccctttgaaaaatggcacaagacagggatgccctctctcaccactcctattcaacatagtgttggaagttctggccagggcaattaggcagtagaaggaaataaagggtattcaattaggaaaagaggaagtcaaattgtccctgtttgcagatgacatgattgtatatctagaaaaccccactgtctcagcccaaaatctccttaagctgataagcaacttcagcaaagtctcaggatacaaaatcaatgtacaaaaatcacaagcattcttatacaccaacaacagacaaacagagagccaaatcatgagtgaacacccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccataaagctaccaatgactttcctcacagaattggaaaaaactactttaaagttcatatggaaccaaaaaagagcccgcatcgccaagtcaatcctaagccaaaagaacaaagctggaggcatcacactacctgacttcaaactatactataaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgttgggaaaactggctagccatatgtagaaagctgaaactggatcccttccttacaccttatacaaaaatcaattcaagatggattaaagatttaaacgttagacctaaaaccataaaaaccctagaagaaaacctaggcattacccttcaggacataggcatgggcaaggacttcatttccaaaacaccaaaagcaaaggcaacaaaagccaaaattgacaactgggatctaattaaactaaagagcttctgcacagcaaaagaaactaccatcagagtgaacaggcaaccaacaaaatgggagaaaattttcacaacctactcatctgacaaagggctaatattcagaatctacaatgaactcaaacaaatttacaagaaaaaaaaaacaaccccatcaaaaagtgggcgaaggacatgaacagacacttctcaaaagaagacatttatgcagccaagaaacacatgaaaaaatgctcatcatcactggccatcagagaaatgcaaatcaaaaccactatgagataccatctcacaccagttagaatggcaatcattaaaaagtcaggaaacaacaggtgctggagaggatgtggagaaataggaacacttttacactgttggtgggactgtaaactaattcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatataccatggaatactatgcagccataaaaaatgatgagttcgtgtcctttgtagggacatggatgaaattggaaatcatcattctcagtaaactatcacaagaacaaaaaaccaaacacggcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcacaccagcatggcacatgtatacatatgtaactaacctgcacaatgtgcacatgtaccctaaaacttaaagtataataaaaaaataaaaaaaaaagatagggatgggtagagataaggataggggtaatctcctaaaataaatttcatttctgaaatcggtactaatagcaagttgattgaaaacataacatgatttgttttattccactttatttttggcaatcataagatactgactagtttagaatcaatgtatatattttttccctctgagcccaggcttagtgaattgctgtcaaacatcaactttgttactgtcactgtgtagatcatgtagctagtgtgcttggctcctcatagtgtgtggacttcacactcattttgcctcttcagtctcagtctcccaattgtaacatgttgccacactttaaccagcttaacctgggctttcaagatcatgtgaacacagtatgaattactaatcagtagaatgttcgttccattgatgtcactacttatcccttgattataaaacccccttaaacattctattaaaaaacaaaatgcttgcttgtggagttttactttgcaaaaaaaaaaaaataaaaaaaataaaataaaataaagagtacactgtatagcttccacctgtgattcctagtgtactttacaatgcttagagcacaatagagaatcaataagtactgtattgaacatgtgaatgtaaaatactgaattagaaggtgaaggataaagagggattatctgtggccttgtaaccaagaaaattataaaggtagtaaaagaagataacagattgtaaataccacaataacagtataaaccaattgtattagaggaaccaaaaacttcatgcagaacgtgttaaacaacattctaggactctgagcagggaagagcgacatgacaaaaaacgtgtttaggttgaacagtatgtgttagacagggaggacacaagagggactaacactgaaatctggatatcatcacctggtctaattttatagttgtaagaagagagtaaggaaaaaggatggatctgtggtcctaatattacttagatttataggcccctataaattggcatggcatatttggcttggtttaaaaagtgttttgagggaaaaaatgtaagtatgatccgtataagtatatgtaaactaatggaagaaaacagtacactcatagtcaccttcctatttcctagaaagttcctgtgaagagttttaaaagattaactgcttaagcattatactaaaaataatctgaaatatatgagggcgaggaaaccaccaaaaaatccatagattaactcaacaaaattatattttgcagagaactcttatttatttatttttaaaagtagtcaccgaattggttttattttttcaaaagtatttgaatggtaatatttaattttctgcaggtctcagataacttccatgacacaaaggaaaaaaaaaatacattagctcccttccactgatataaatatgcctagagaggagcctgccaacagctgcgggtagcagcatttctaactgccagaagaggaaaacatctctgctcacttcagcaaaggtgtgcaacaaagtgggcacatttggcagagccatcagatcaatgccaggtatgaatatatcatggtcattcccaaggaggacttctatcagagtctgctttgaagttacctaaagcatagaagaaaatctgcatgttttcataggctatgaatccaatgatatatcattggattttccagattgacttcgcataatctggaaacttaaggggaaaaggaccattgttatccaataaacccattttatcgaaaaaatattcactatattgattgaagttataacacattgaaatttatgagaattatatagagttttcagatcaacagaagatttctgatctttcaagaccacccaaagccaatttggaaaccccaggatccaacctaatcttatttggtattcagaagtatatacttttgttgttgataaggtcacatgcatggacaacagctggtaaaatgaaatgctttggccgggcatggtggctcacgcctgtaatcccagcactttggcagaggcagacggatcacctaaggtcaggagttcgagaccagcctgcccaacatggtgaaaccccgtctctactaaaaatacaaaaaattggccgggcatggcagcacgcgcctgtaatcccagctactcctgaggcaggagaatcacttgaacctgggaggtggaggttgcagtgagctgagattgcaccactgcactccagcctgggtaataagagcaaaactctgtctcaaacaaaaaaaaaaaaaaaaaaaagaaatgctttaatctcaaaatgaaagcaatttctttttacaaactggagtgacgacaaggaagaagtgttactaccagtgtatagcagagagtttatattactaaatttaaaatcaccattaagttcacaggaaacaaagcagatgtataagcaacaaacatccgagccgcaaaacaaattccctattctttgtaagtcttttcttgccatttattcctaattaatcagtatgtttgctatactattaaaataaatatgataaaaagtaatcaaaccaatacagaaaaaagatgtttcccatattttgtctctgtttaccttttttggagaatgtaaaatgaagaaaaatggacatagtaatagaaatatgtatcttcatttcaggcaggttcctatttggcaagagtttcaagttaattgggatatatgaacaatgaaagcatggttaacagacacctgggaaacctaaatttttattaatcccataggtcagtaaaccaaggattccccagacccacatcaagaaaatctaaattatattttaaaattgttagaaacattgaaaaaaattgcaaaagttacacatgaggaaactacctaaccaaacccagtaaactctttattattttcctgtctttttttgccccatgatatccattaaagatcactgatctgcaatctgagtccttattatgcttggagtcaaggagaaagagtcagcagccagaaaagggtaaaagagaatcagttgtcttagcctgatacccaatgcagaggacaggtaagatattatatgttcacatgtcacccaagaaacagctttcccagaaccctgagccatgtatactgtgactggggatctgtcccagttattagggtgcactccagttttcttttgggactagagtcctactgagaacattgatctgtccaaaatgagccctgacaagccatcttaagtctttactagattcctctctctgagaagggagatcatgactttctatcaattgcttactaaagacctgtttcagctcattcagacatacatccttcaatgtgatacagatctctgatgcccagacctaccaaagaaatgcaaggctgttggtattccctggattatacctgaattcaaaggtccttgagagccagctctttgaggaggggtaatctcctggcatgctaataatctctctacagtgccctgtcattgagttcctatgaggaaaagtctgggtgagtatgacaatatgctttaatatatatgacattcctactacgtccagtcaagtgatttccacaaattttcttatttaatgattacaacaatgctatgaagtcagaactaatattatccccactttacaatcaaaaggctcaggcttagaaatgatatgggacttcctccaaagttaactaggcagtcagactcctaaaacaatgcttttaaagaaattaggcaatatacaccaactatttcatcaaacctctaacaccaccaagtgtaagatcaccattattttggtgggttaagaaaaaaaagacacaatgaaaattaaactgataaaatgttttcttttcagtgccactcaaaatgtggaccctgaccagtgccagaccataaactgttatcagtctacaaggtcagaaaataagagtgtttagaaacttttgtaacattttaatattgcagtgaaaatttcaaatatattttataaaagtggtgaaggtagaaaacaaaaaactagaccttggcttcagatagtctaagaagcattgacttagaatttttattttattctcatttttaaagttcttttagattcaaggcatagattatcattatagatcatacttgggcattattgtttcacttcagcataaaaaggaggaaaacagcagcaaaaaaaattggttaaagtattcgtaaaatgttttcacattcagagtctgactcttctgaatctctttttgatgcagagtaattggtacccatctttctttgtgttaccaaggctgcccaatctaggattaaaagctcctgggttttaatctgaggcactgacaccttcttcaaacttggatactggccctctctctatcttaccagaactcaggaaataacagctgtgtcaccacaaatccaaacatcagaaagttaaaaagtttaaaaaaaaagtacatcttagaagccacgaaacaatagtatcatttattgttctgtcatttctaagatttcttgatgttttctgatgtttatttgcctaaatatgaatttgaaagaaatgactttctccgttaaagtctatttctcatctcttatctatactcacagacaagattttggttgatactttgacagatagtcttcattatctacgctgaagatatgtaggtattccatgagcagtgtcattcaaacatatgtgtctatataactcaaacaatataatgaaacctaccaactgaaagcattctagaagctcaattctgtcttctatttatatcagcttgagaattcattaatcaaagtgccctagtatctacatataccttgttaattaattagactaccaaaagtttagagaatacaatctacccatggatttgttataaaagcaataaatgtttatcatggaaagctcagaaaatacaaaaaaaagcttaataaagataaaaatcacaaataattcaaaactcaaatccaaaaatggatcttccaatttatgtcagtttatggcgaactgataaaatatatttaatgtaaaaaaccacaaagccatctcctttgatgggatgcatcccaaaatgaacacagatgactaggaaattttatatagaatagtcactaatttatgctactatatctaataccttgatttatactactataccaaataccttaacatgttaggggcatcatgttctcaaaccacagctaaatagtttcagaaaatacttaagatcttttgacttgttttgtgaggtactgaagttcgtttctttactatcagctatgaaaagggcaagaaaaaggagctatataaggtgagaataggaggagggatacaggatagaagttagatacaaattctacagatcacttcttattgacagaattaattgattcttgagtatttctatggaagagaacagaaaactgcaatgagtgctgacatcaatttgttgaaatgttatgaaagacacagcttagtgattcactagtggttaaacctgcaagggttcagaaaagcacctaaacagaaaagcaattaaattaaaggaggaaagagaataaaaatgttaactctatatgtaattttagtcacacagtcctttatttatgtccaaaaatgttgctgaaacacaggtaacaaatgttactgaaacagctaaatggaaaacaaaaaagctccactatctatctaactcaatacctaaaaaataattaaatatggaccacaaaattaagcataaaaactataaccataaagataataggtaccatataactataaagataatagataccatataaacattaagaaacctaacagaaagtcttcttgacctttgggtatgcaaagatttcttggacaaaacatagaaagtattaataacccaataaaaaggaacaaaaagtttgaatagacacaccacaaagtgagatatatgaaaggcaataagccaagtgaaaggtgctcaatatcattcatctttaaggaaacagaaatgaaaatcacaataaaataatactgcacacccactagaatacataaaataaaaaagactaacaaaaccaaggaaagctagacacaaaagggcacactctatgtaattgcacttacatgacatccaagaacagacacgctaaactatggtaatagaaaccactggaggaagtaagaaagttgtgactggaaaggagaactttctaaagtacaggaaatactattccttgcttttggggtgctggttacatgggagtgcagaactgtcaaaactccctgagttaagcacttacaatctgcactttttctgttaatcttatgtatacaaatatgtgtatttacagatattatacatacacacatagatacagtttaagaaaggtgttaatataattaagtcttggtacaataatttaataaacatacatatactgagtttctgctatgtgcttcgtgctacaaattatttatttttgtgttaaaaatgaatgtcttaaatttacttaagcgttctaacacaaatactgtgactgaagtagaccattctttaaatctctctcctaaggaatgatagcttgtcaattctcagagactaacatggttcagtgccttttcggcatacaattaatatattccatatcttttaaaacaggaatatgccactattagcagaaatgaaaactataattatagtattttgaaaattattcgtttgccatcagttactttccacttatgtgcttgtacatttttaaataccttcctaaacagttaaccaaggcctgagaaaagcacctttacaacagtggccctaataccagatatggtcatacttgatgttacactatattgaatcaccagaaatgtccttggcttctctgactacatggtatttgtgagcaatacttaggtttctccagactagaacatttccaacacaacagtattaatcatctacaaaacaaccactgaataacaaaatatttccttcggagagaaatgcttactgtcttctgcttaaattgttctgcctgagtcattacattatctggtaaattttctcgtcatgaaattccatctcatgatagcaaatcctcaatactgttgttacagatctttcacaagtatgtgttgttagaaattcatgtgctttgtgatttcaaaattgctatttatataacgactgcaagttccaggcagaagaaactattattatttaacatacacgatatacctgcagaatgcaaagcactgcccaggatgaatttttaattcttccaagttccacagtagttctaaattcaattaagggaaaaaaaaagaagtcttcttcctgatttataattctgagccatttcttttcataaataataatgatctaaaattactatgcttgtgtgtacctaggattataataaatgccatgtgtcaaagggggtattactagaataattttcagtatctatataattagttcatataatatatttaatggcctgttacatgtttagctggcaagtttctacatttattaacctcataattttaaattagaaaattatattttgacctacctactgcttttattttgactgcatcccaaatatattaatagtggcatatatgtttaataaatgagccattatttctccaaggtgtataaccatacacacagtgatgtcaattgcgttaaatgttcctgccaaacagggaaacatttaagttgtgttaactataaaatcaggattacaataattttaatgaaagatttacttttttagaaaacttcagacatacagtcatgtgaatggtaatgtaatgctgactgtataaaatatgaactatgcaaaggttttacagctggttttgatcagcttcctttgtttaacattaaaagttaacttccagaagacacatacaagctctacatcctacaggtaatgattaccagatggagatgttcttcctgttacgtgtctgattatcataaagaatatactacaagaagaaaaaaaaaaaactagggcagagactctgatgtattctctgatacaaacaggctcttccaaactttagtcaatgaagtcagactcacactcaaaaatgcttttgtacttgtaaaatagtgatacaaggttatattctgcatatatggtcaaatgttttaaataattaaattgacgcctttaatcattagccccctttggctgtcaaaatgattaagttgcagcctactgagtaacactaatgatttcttacaatctgcttgaaagaaaatccaacctattgtcaagccctggcagtctagatgcccagtttcctagcagggccccctagaaatggcctccttgcctcaaattattccatgcacaatactgggttatcagctaaaaacaccagctgaaactaggctcaaaactttaaatggctctaaatttctaccgaatatggtttggtagttttttaatctccctttgttccttttcatgcatgctatgttcccctcaaaatgttctattcacttttcttgacttgttctcctacctgtacttcccactgtctcaactctctttctaatctctatgtggtcagataccaccacttccaataccagcataaaaatgatttcccccacgaagctttccctcattcttttaaggaagaagtaatttctccctttttgaaccactgtgacactttataaaacattacatcttcattagtagtatattcattcctgaacagaccatataccatacaaactatatcctctctattgagatagaaggccttgtccatagtaccaaccataggattttgcttatgataggtgtttaagaaatgttcataggctgggcatggtggctcatgcctataatcccagcactttggcaggttgaagtgggaggatcgcttaagtccaggagtttgaaaccagcctgggcaacatagtgaaaccctgtctctacaaaaactttaaaaactagccaggtgtggtggcctgtgcctatagtcccagctattcaggaggctgtggtgggaggatcacttgagcccaggagattgaagctgcagtgagccataatcgtgccactgcactccagcctaggtgacagagtgagaccttgtttcaaaaaaaaaaaaaaaagaaaagaaaaaaaaaagtgttcatgaaacaaatcaataaaaatctgtatttctgcaaggccaagtgcatttctacttatagtgtcacattatcagtagaaaaactcaataaacacaaaagtaaagaaagatagatcaaaatgacaaatagcccacacctcaactttttgttttgcctaaaatttcaagaagttttaaaaaggtgtattttggaggaaaaaagaaaagcttcaaaaacaattttggaaaataaagaatggtattagtgagccaaaactgaggaattgctaaaaacagaaattaaacaaaatcagatggatagaaggactggttgggggggtgggggaacacacaatctaaaacataagaaagacaggactgtcagtacacctggctaatttcagtattttcagtagagacagagtttcgccatgttggccagactggtcttgaactcctgacttcaagtgatctgcccgccttggcctcccaaagtgctgggattacaggtgtgagccaccatgtccagtcctccggtcattttatacctcctttcttcctttcatgctctactgtttactgctttggttttgttctcttttttgtttgtatatctgctgtaattaattaaatgttggtcacataaaaatactctcgacttttccactctgccacacaatttatatttctgtggccttaatttacatttttatttattatgtgttccttagccaacattgcagttgttgtttttgaccattttgaccttaaaccttcatattagttgactgaaagatttacacagtatcgttacagcattggggtgttcttagttttattataaatttagctctattggtgagttttatactttcacatgttttcattacaatgattctcacctttttatttcctgttgtagcattcctttaagaatttcttgtaagtctggtcaagtggtgataaattccctcagcttttgctcctctgggaaggtctctttttctctttcatttcgaaaggagagctttgttggatacagtatacttggctgacaggtttttttatttgtttgtttgtttgttttccttcctttcctttcctttcagcactttgaatacaacacctcattctcttctggcctacaaagtttatgttggtaaatatacggatagtctaatggaaattcccttatatgtgactcagtgtttttcttttgcagcttttagaattctctgtctttgacttttgacagtttaattataatgtgctccagagaatctttttcacttgaatctaacatgggacatttgtgctttcttgatctcaatgtccacatctctccccatacttgggaagttttcagctattattttgttacatatattgctgggcgcggtggctcatgcctataatcccagcactttgggaggccgaggctggtggatcactaggtaaggagatcgagaccatctggctaatatagtgaaaccccgtctctacaacaaaatacaaaaaattagccaggcgtggcagcacaggcctgtagtcccagctacttgggaggctgaggcaggagaatcgcttgaacctgggaggcagaggttgcagtgagctgagatcacactaccgcactccagcctgggcgccagagtgagactccacaaaaggcccagaatagccaaaccacactcagcaaaaaggaagaaaaagaaagaagaaaaaagaagaggaggaggagaagtggaagaaggaagaagtggggaggagaaggaagaagaagggggaagaggaggaagaagaagggggaagaggaggaagaagaaggggaaaggaggaggaaggaggaagaaaaaaaggaaggaaggaaaaaaacctagaagaaccatgttacctcacttcaaataatattactgggctatagtaaccaaaactgtatggtgttggcatcaaaacagatacacagaacagtggaacagaaaagagaacccagaacaaatacatacatctacagtgaactcactttcgagaaagatgccaagaacatacattgggcaaaggacagtctcttcaataaacagttctgggaaaattggatatccatatgcagaagaatgaaactagacccacatctcttgccatgtacagaagtcaagtcaaaatggattaaagacttaaatctaagacctcaaactatgaaactattcatagaactcactaggaatactctatagggcattggactggacaaagatttcttgagtaataccccaccagcataggcaatcaaagtaaaaatgaacaaatgagattacatcaaattgcaaagcttctgcacagcaaaggaaacaatcaacaaagtaagagacaacccacaaaatgggagaaaatatttgtaaactatccatctcacaagggttcaataaccagaatatataaggagctcaaacaattcaataggaaaaaatctaataatctgattaaaacatgggcaaaagatctgaagagacatttctcaaaagaagacaaacagtacacaagtatatgaaaaagtgctttacaactgatcgtcagagaaatgcaaatcaaaactaaaatgaggtagtatctcaccccagttaaaatggcttttatccaaaaggcaataacaaatattggtgagaatgtggaggaaagggaactctcatacatgttggtttgaatgtaaattagtacaatcactacgcagaacagtttggaggttcctcagaaatctaaaaacagagctaccatatgatccagatatacctctgctaggtatatcccagaaaaaaggaaatcaatatattgaaaagatatctgcattcccgtgtttactagtcacaatagtaaagatttggaagcaacataagtgtccatcaacagaagaatgaataaagaaaatgtggcatatacgcaatgaagtactattcagccattaaaaaaaaaagattctgttatttgcaacaacatagatggaactggaggtcattaagtgaaataagccaggcacacaaaaaccgacttcacttgttctcacttatttatggaggctaaaaattaaaacaattgaactcatggacacagagagtagacagatggttaccagaggctgagaagggaaatgaagaagtggaggtaaagtggggatggttaatgggtacaaaaaacagaaagaataaataaggtctagtatgtgacagcagaacagagtgactacaatcaataataatttaactatagctgtaaaaataactaagagtataaatggattgcagtagaaagcacaaatgcttgaggtgatggatgcctcatttaccctgataaaattactatccattttatgcctgtatcagaaaatctcatatatcccatatatatatgtacatatatacgtatatatgtacatatatatatacaactatgtatccacaagaatttaaaaattaagaaattaaatgaataaataaacaaaaccttctctcctgaacaaagccaaagagagtgaaattgacagagagaaaaacaatgcctacataatctggtccctatcttacttttacatttcagctcgtcccatttgatccttaactcacttcactccagaaatactgatatttctgtttctggagtacattccaatctcagtacctttatactccctgttaatacatggtattctccttcacattatttaattctttgctcatgtatcatcttctctgaggtaatctaacattattactcccagtccttgtcctagattatttccttcatagtagttaacactatgtgatactatttattcatttacttattgtccttcttgcataccaaaatataagctccattagagaagagactttcttgtatataccattatatccccagtacctaaaacaatggttgccacatttatcaataagtctttgatgagtgaatgaatgatagagctcctctgtggctagaaatcaccatccaatctaactctacgtcttatatatacactataattgtggaaacaggattttctatcatatctgaatccacatacttatacaccatttaacagggttctaccttaagagtggcaataaaaacactgcagtagctgcagaatattttactcttgggcctgataaaatattgacagaaacaattctaaaagaactgcctgctcagcaatttcagccaatttttgagcctggaaaaaatagggggaaaaaatcaagtgaactttcactcagttacatgaaaatgcaatgcattagttttatttcatttgggcttctaaataaaataagcaatttaaataaagccaatcaacttgcaaataaagaaagtgccacatctatggcattttacacaaactagaaaatctagaggaaatggataaattcctggaaatacataacctcccaatattaaatcaggaagaaattgaaactctgaacagaccaatactgagttccagaattaaatcagtaataaaaagcctaccaaccagaaaaagccccagaccagacagattaacagctgaactctaccagacatacaaagagttgatatcaattctactgaaactattccaaaaaaatgaggaagagggactcctccctaactcattctatgaaactagcatcactctgatgccaaaagctggcaaagacacaacaacaacaacaaaaagaaaacttcaggccaatatctctgacaattgtagacacaaaaatcattaacaaaatactagcaaaccaagtccagcagcacatcaaaaagttaactgaccacgatcaattaggctttattcctgagatgcaatgtttgttcaacatatatgtcaataaatgtaattcattacataaacagaattaaaaacaaaaaccatatgagtatctcaacagacacagaaagagctctcagtaaaatcccacattctttcacgataaaagccctcaagaaactaggcatcaaaggacatactatcatatcatactaccaacatcatagtaaaaaggcaaaagcttgaaagcattctccctaagaataggaacaaagtatggatgctcactttgactacttctactcaacatagtactggaagtcctaaccagagcaatcaggcaggagagagaaataaaaggcacccaaataggaaaatactaagtcaaattatctctcttcagagacaataggattcgacacctagaaaaccctaaagacctgaccagaaggctcctagaaatgataaatgactttagtaaagtttcaggatataaaatcaacatacaaaaatcagtagcacttccatacatttataacattttagctgaaagccaaatcaagaacacaatcccatttacaatagtcatagtcacacaaatatctaggaatacatctaacaaaggaggtgaaagatctacaaggagaactataaaaccctgctgtaagaaatcacagaatgacacaaatggaaaaacattccatgttcatagatattaaagaatcattattattattattattattattattattattattatttttcagacggagtctcactctgtagcccaggccggagtgcagtggcgttatctcggctcaatgcaacctccgcctcccaggttcaagcgattctcttacctcagcctcctgagtagctgggattataggcacacgccaccacacccggctaatttttgtatttttaatagagacagggtttcaccatgttggccaggctggtcttgaactcctgacctcataatccacccgcctcagcctcccaaactgctgggattgcaggcatgagccactgtgcccggccaagaatcactatctttaaaaaggccatatggcttaaagcagggtacagattcaatgttattcctatcaaactaccaacactgtttttaccccaattagaaaaaactcttctaaaattcttacagaaccaataaaaagcttgaatacccagagcaatcctaagtaaaatgaacagtcagaggcatcatatacctgacttcataagggtacagtaaaaaaaaaaaaaccaaacaccatcggtctagtataaaaacagacacatagactaatgaaacagaatagataagccagaaataaagccacacatctacaaccatctgatctttgacaaagttgacaaaactaagcaatggagaaaggattccatattcaataaatggtgccgggataactggctaactatagaccttcattggatacatttagctagctagccagttatcccagcaccatgcagaagaatgaaactggactcctacctttcaccatatacagaaattaactcaagatacattaaagatttaaatgtaagacctcaaactgtaagaatcctagaagaatatccatgaaacaccactttggacactgaccttggcaaagaattcatgactaaatcctcaaaagcaagcgcaacacaaaaaaaattgacaagtgagacctaattaaatcaaagagcttctgcacagcaaaagaaactattgacagagtacgttagaaaacttgcagaatgggagaaaacattcacaaatacccatgcgacaaaggtctacgtctagaatctataaggaacttaaacaatccaacaagcaagaaacaaatgatcccattaaaaagtgggcaaaggacatgaacagacacttctgaaaagaaaacatacaagctaccaacaacatatgaaaaaaatttccatatcattcgtcatcagagagatacaaatcaaaaccacaatgaggtaccatctcataccaatcaaaataacatgttggcgaggctgcaaagaaaaagaaactttcatacactgctggtaggaatgtaaagtagttcaaccactgtggaaagcagtttggagatttcacaaagaacttaaaacagaagtatcatctgacccaggatcctattaatgtgtatacactcaaaggaaaatagatcattctaccaaaaccacacatgcactcatgttcatcacagccctattcacaatagcaaagacatggaatcaatctaggtgtccatcaacagtatattggataaagcaagtgtgttacatacacaccacgaaatcctatgcagccataaaaaagaatgaaatcatgtcctttgcagaaacattgatatagctggaggccattatcctaagtgagttaatgcaggaacagaaagccaaatactgcatgttttcacctgttagtgggagctaaacactgggtacaaatgatgtaaagatgggaacaacagacactgggaactataggaggtaagagggagggagggggccaagggtttaaaactacctgttgggtcctatgctaacaccctgggggatgggatccttcatatcccaaacctcagtgtcactcaacatacccatgtaacaaaccagcacataaatcccttaatctgaaataaaagttgaaattttttaaaaaattaattaaaaataaataaaaatgtagaaaagaaagtgcaaacatctatacatttgcactaagtgccaggggaaaaatgtgatttgaaattttttctgtcctgtctcccaacacaggtttaaatatttaattaaatattctgaagcatctctatgcacccagaaacaaagtatttatatacatttttgctattgctggaatttttattcaacataaatgtgtgtgacattctcaaatgataattttcaacccatttaaagccaagggaaaactacatactccatactacctgttttgtttctcctttttttacatctgacaaagttcctttcagaccttttgggtcacctgttctagagatacaactgaacatatttggtacctcatttctaagaacttggttaattctagaatgaacttgatgattatggaaaaaattattcagaaattatggaaatccacccaaaaacctgattatatgagaaatgtagcagaaagtatttaacactgtaatcaaaattcctttctacttatctcttgcttgtatatgttttccacatttctatatacttatcttttctgttaattaagacaacatgaatgacaacttcatttggcactttatctcttgaatgagattcaatcgaatactggatgattaataagtagttgatgaatggatcaaaagaagaatgataatttttgcttgtctggggaaaaggtattacacgaattataaaacaacggcttattaggtagaaataaaaaacacaagtatattaaaaacatcataactattatttaaaacaactcaattataatcctcctatatttaaaatgtttgatctttaggtatgagaaacatacttctctgaaaattacatttggaaagtcaaacactgaaggttgcaggagttctatcagaaattacttgaaacttagtttctgtcactgactttgtaaagttaagcataaattaaaggctcaatcttagctaaaaattttcatcctattagtaatatcattccccattttaatgagagacacaaaaaataaaatgaacaaatttcattatctgtattggccaactatatttctgacataccaaatgcttactgcacaaataaattttctccgaattatatatacagtttcacctagttgtgtaaaatcggatattaatcgacacctttaaaccttattactaggaaatctggggcattaaaatcatccttaggaactcataggaaatggtaaacatataatatcaccaagtctccctttttgaaaattagaaataactcaatcatgctccattcctggtcaaccaagaattttaaatttataatgcttgcatgactaaatgtgattttgttctatgacacagagactaagcatacataaactaaatcagccacttagacacgtagcttgaagtacttatgtacataacaaagcactgggattttaagaatcttggttttaaaaactccctccagcaattcttccatctctaaaactctaggcttcttagagttttgttgcattcaaaatggcctcagcaattggttcataatgatgtcacaggagtaaccagaaaaactgtgcatcactggtactgaaaatgagagttatttatctgtgaataggtacacggctaaaatatgttgaacgtaaatctatttccataattattaataaataaaatttaatatttaagatatcagtaatagtgaacactaggtgtcagtgtaagaaacggaaaaatatttttaaaaacctgttgtttccaatcaggtgtataacaataaaatcaaaagcagctgtgaccacatttacttataattacataattcggttaacaagccaatctttctttcaaacaaaaatttctgttccaaaaccatcaagagtttaaaatcagattaagctaattattagaagttacaagtcttttgtaaccttggctacataaagcatagcaaatttttacttttaagaatatatattttgaagaaaattctacttttaggaatacatattttgaagtgttaaagtgcagaactactatactgcattattttcgttggttatttttcaaaataataatgctggatgattaataaatgatactgaattttaagcttttccccaaacagaagtttcccacataaatttcaagttattaaaagttaaaatgtttaaagggtcaattcacaaggaaagggcacacgaacttaggaagtacaattgcttctcttaaaattttagtacctagaatttttctaaagtataaatgctatcatttatactaaaaatatcatctaataactttaccaatatttcagataaagagttttctctatagacttttgagggtaaatgcttttaaaacacaagttttaaaaagattattattagcaataataataaaaggaaatgtcaacatcaaaacagtgtccctagttttatgaaaaggcactttacaatttacaaacacattcatagtattacttaatttacacctaataataataatataagaaatctatactcattttagcacactggtcaagtttgggggcttgagctctctgtttcatctacctatttatccatttctctgtttcacctccctcaaactccacattactatgtacttatgaaatcatgtatttttcaagaatgttgggaaatttcttcacacaatattctgaaaaccatcaagtttgaaaaagaaacaaaactaaacatagaagtcgccactaaaatacaatatcttaggactcgaagatcatttaggagaatattcaaggatttgctggataaaaataagtgctttcagtcaatgctgtttcttatttcaatgatagttaagttctattccaattatagagataaaacgagaaggcataaaattaatggaaaagcttcctaagtctccaggattgaaatgaattaaatttagatcattctgcgtctgcaggtttcttctcagggacataaaatcagacgggaactgacaagaaaggaacaaggaaactcatgtttaataaattatctaaactgggttttaagaatgttgaggtatctaagaatattggcaataaaaagtagaggtaggagaaatagtgacaaaactgtataaggcatgacatgctaaagcagaagggtggcctcagaaatactgcatgctatgaatcttcgagcgctctttctgcctcttagtgtctttgcctttgacactctgttactccaaatgtcaaaaaattttttggctgccattaatcctgttcccattggcaaataatgtagaccagtgttaggtcatttacacacattatcttatataatgcctatgatgtaggtaaattccaagagatgactaaatgaggacttggattaaggaatatgctcaagactgtataactggcaagttatgaagccaagattcaaatccagcaatgtttgtctccaaaaacattccagtctacaagcatttaccaactcatggctcacgaaccctgtgggttttgcaaaagtaatcagggatcaggggagtcacatctagaacagtgattaccaaatgagaatataccaagttagtacatataaatgtactaacaactcagtatttctatcagtttctcactcagatcaatactgacagctgtcatggtagatttgattgttatatgattttaaattcatttattctctgtgatatggaatttaatttatacccatactgaactattgtttacaggtagtaagcataagtagttgaagctaaaacaaaataatatataacaattacactaactttgtaaatttgatatctttctttaccagaataagatgtattcatctgaaggaaagtagaattcagtacattgagatatggacttcaaaatatcatatgaatggaaaatatagtagcaagtatacacaatttagctttttgtttatccatatcagaaaattttatggcaaaatgcttgccaagagtagcctataacattttcctttagtccaccttaaaacaaaagtaaaaatatataggtttttaaaaacatcccattcatttcaaagcattatgagtaagaattccaaaaacagcagttttgtatcattctaataaaattaaatttcaatctatatgttacatttcttatttcaatgatgttcttcccttttacaatcaggactcaattcttctcttttcaagattcctgggtatcctcttgagtggcgtcacccatttcacttgtaaccaggcctctttgtaggcaaacagtatcttcctgaaatgccattcgccttattctaaaacccttcttcttctgcgtctctcatcagagcttcaaattcatgtctaaaaccaccatttctcttccaaatctgtgctttctgacctatttcaattcacaaatctgtcattctcccaattgcttaggaaatatctctgacttgctctcccttatcttttatttaaccttcctggccctgaattcctgaacccatgaaatcttgcatattgcagctctacatttttttttcaaactaggatgtgttagttcagaatctgtaactgtgcaacttagagctagcaacaacttttgcctaaatactgcaatatcctccttataactgacctctccagaagcagcatcttgagtctttcacagttcgatataaaatagccaggttattctatccacttcacttactttgccactctctaaaatttttaattgtccccagctgtctacagaattacatacaaattactcagtttgaaattcaatgaccttgaaaatctggtcccaagtgtctttttcatcacctttctccatcatacaattaagaaacattgctcatacaactggaaacccatatggcttgatcagaggtgatataatatcaaccaatagctgaatttggttcttggcataaaatgcaaaagctctgcaatatagctgacattttaaaataggcattccattcctgacaacatcattcacatccattctgaaatccaaacggggttagctattaatcattactatgtagcttattattcacacaaaaatattatacttactgaaaacaaagaagcaattggttttgaaactcagtgtaaataaaaggataatttattaattaccattctctcttttggagaacagccattaggtctttaatactgacatagataaataacttcattcttgtcttataaaaaactttcagttcctgactagcataaaaagagaacaaataaattagatatgttagaaatgggaaactgaattccagtattttctttattctcacaaaagagacatttgaaaatatcaccacctgatctctgatttttatgaaaatgcagggacttttttatccaccatgatagaaaataccaaagttatttagaaaaagagtattaatacttttgcttttagtgaaaaaaagaattaaaaaatattgagtttctactaaatataatgtactcattgaaaccgtattcttatcagtgaaatcaaatgcttgcatatttagaaaaaaaggcaatatttgatttttaaaacctgccatagacaaaataattgaaaaggataaagctgagacttttatgatgggagtaaaagttaactagtgaaaaaattattattcttttaactatatgtgaaccataaacattttattaggaatacagttattttacttcttgtattatcatcaaatcttacatcgagtctagtgatcttcttaataaaaacagtctacaaagagaaactttagtgctcaaggaaaaagattctactaaaacttttcttcttaaagcttattaccaaagcaagcaataatatggttgatttctggaaaagttcacaatattttaaatatccttttcaagtatgtttaaattccttctttcttatatattgaattacctttgtccagtggtctatcaaatgatttctattttaatgttatgaaattataacttatgcctacattatgttttgttggttattaaaactatttctcatgttaaagaatgctattctctttccaaacttcaaatatgataaatatttatcatagacttgaaactgaatttgtattttccacaccaaaagaagattgtgcttacctttcttggcacttctctttttcaattacttctttttcaaccactcctcactaactatttgcaaaatgtaaatactactctgaaaacaatattcttcttactgcagagaaccacagaatactcagaattagaagggaccttacagacatatagtaaattcagtctgataagtacccattaaaaaaacagcatattttctatactaaggaatccccaaactctctagagaagaaatggtttgaattccctatctactacttataagctgtgtgactgtgggcaagttgcttaatctttctgttcttcagtttctaaacctataaagtgaagagagtatcttctaactctctaggtttactggaagtatttagtgaaatgtttcttataagtgatgccactctgtcaaactacagatagaaacacagaaagttttaaaaatatttttcccttaattccttaaggatatttgctaaattatggaatctttatatacagttttggggagaaaaatgttttggtcatttaaaagtctttggtcattacagttttggggagaaaaagtttttggtcatataaaatttttggtcattttacataaataaaatataaattttatattttatatggttacaaatatcaatacgcatactgggctaaatacaacagaatgatgttctctgaaaccaaaaagttaggaaacttgatattttaatatatattttctggaacatactttacattatatattttacttgtaaaccaactagataacctataattgtgtgtatttgtgtttttagcaattattttatcttggctctacaccgtcacaacttcttgctgtttcttatcagcatctgccttattaattgccttggtcctttccattccattttcctcctactctactgcaaaaaaaacccaaaaaacacataaagaaactcttagattaaatacattctgggtactgagcatgatttttacagtatttatgctgatgtttattacttaatgccatattattagttgaattagaagtgcaaagtcagtgaaaattttactgataaacatcattttcaaagttctatcctgaagatgttttcttaagccttttctagttgacacatttatttaatagactttctctttccatttaattaaaaaatttgaagtcagccgggtgcggtggctcacacctgtaatcccagcatttgggaggctgaggcgggtggatcacctgaggtcaggagttctagaccagcctggccaacatggtgaaaccctgcctctactaaaaatacaaaaactagccaggcgtggtggcaggcacctgtaatcccagctacttgggggaccgaggcaggagaattacttgaacctgtgagttggaggttccagtgagctgagattgtgccatcgcactccagcctggggaacaacggtgagacttcgtctcaaaaaaaaaaaaaaaaaaaaattaagtcaattttattctagtgcttcaaatataaataccttttgaatttcagattatatatatacttagagtttcataacaacttactagagaagtctctaaggacagttaatatatgcttgggaaactaacaatgtgatttataaattcacccagagatgtgagaacgactagaattgaaattatcagcataaataatctgttccctaacacaatgtagtaaaataacacccctaataaaacatctaacacaatgtagtaaaataacacccctaataaaacaactaacacaatgtagtaaaataacaccccaataaaacatcgcaatggatgtgaagagttcatatcagaatctaaagggataaaaatacatattttacaaaataattgtatgttcttcaaatgtagaaaaatatataatactgagatctgataaataaataaaagttgctaattatatttttataaaaaataggataaattcaagctaggttaaaattttgtaagttaaaaagctatacagaaatgtttttatttaaaacctggaaaatggcctatatatacaataaaataatataagcaaactctttagaagacggcctcacacatagtagatgtttactaactgttattttcttcttttctgcagaaacttaacactaatcaagagtaatagcagcaatggggaaagaagatgcagagttatggataaagaaaagacattcaaagatcttgggaaaggaactggaaagaggaagttttaaacaatctcttagttcagatacagaggagaaaagaaaaactgataaatgagaatagaatacttggaaaacatctgccaaattaaaaagcacaaaaagtaagaacaaagaaagagggagaaagagaacctgatgcatgctaatcaagatgggagactgaacagttactcttcacagatatgtttattcttcattactttttataattcaagattataaataatctcaaaaataatccagagaatagattcacatatgaaagcatagttcaacagactgaatggcttactagttgttgagtagattcacatagaaaaaaacctaatatgattttcaaatggaaggttagataattatattctatgcataaaacaaattatattctacacatatttaatagagtagtgaaagcagccacatagccatcagaaatcatgacaatttttgaacttcatttaaaattgggtattatcaaaagcataatatagactcagtcacacaatttcaagatggcgcaaatctctgcctatctctattaagacatgcaattcaatctggagagtgggagttttataaaaagtttgcatctctctggtaaatctaaaacacttggaacctaagcatttatgagaaattttagcccgaactaaaacgttcagcacagattaaaaatccaagcatggtacaggatacaagtagctagaacttagcttaagtcaggggataggagtctagcagaccagcagagaaaaaaaggaagaacctttagggagaaaagcctgatgcaagaaaagaaacacaaattgaaaggtgagaagatgctattttatatctatgctaagaaaaccaagtaacatgagacaatacttgtaatttactggaagtgaaaaacaatttatactctgaaattctgtgacactgaagtaaagactgcttttcaaaatgaattggttagtaggatatactacagcaggaaaaaaatatgttaagagtgggagaaaggactgggaattccttcccagttgatcctctgtgtcatgcctttagcaaactatccatggcaattggtggggagaatgtagcataagaggcattctacacagaatatgcccattttaaaaactaagtatcagtcaatagttacttattatttttttaaaaagacaattgtatttattgatgcatgaggtagtaatatatgagagaaaataagactaatttaagtagaagatattaggagtgatcaattacaaacaagtggtgctatacagaaataatcaggaaattttccataatacttattccataatacttcatttttacttaagaagtaaaaatgaagaaaagtaatcagattttaccaacacaaaatattctattttgaacaactctgtacgcatatgtgaccatacgtgtgtgttttccccaaagcaggtgtgtttttagtctgtttattctaaacatatgcttaatttactccacagtagcagacagaaaggccgagaattttttcccagatggtatttgtggactacctcatattccattcatgtaaacacagagtgtgttctggtttgctgaactacatatacatgctctggcttagtacaaagtatgaacgtttagttagcaagaagactgtttccatcctatgattcattaggtccccatggtacctctgcttcctttattttatgcaatcacaaattatattagtttgtcctattttgataacccttataattgaaattctacataggaaactttattactattttaaaacacacccataaaacattactgaggtggcataagtgacagcctcacagaactggtgatgaggacagaacagagctttgcatgaactgcttctaccagggaaattaaaaagcattacaggagggaggggtgaattcagtgcattttaatccagatcggagattaagccataactcttcacacttataaatttgttctttattacttttcataattaaggagaattagctaaacatgataaattggttctgatgtgaaaactagtgtaaccaactacacagcttactactgactggtagattcatacagtgaaaatctaatatgatttttaaatggaatggtaattacattctatgcataaaatgtagtgaatcttttgatatttaactttgaatgaacagagaaatgaaagcagctatatagccatctgaaatcattactttttgaacttgaaagagatattgacaacatcataacaacaactcaaacataatttgcagttggcacaaatctctacttacttcaaatgtgatttaactcaacctggaaagtgaggagtaaggaagcttaggatatgaaaaagtttgcatctctctggtaaatgtgaaattcttggaaattttctaatccatttctcatctcaatcatgccattaaatagccccattattaacgacaatagcaactattactactgttactagtaacctagagaagggacgctatgttccaggaatttcattaactccttcatatatatataatctttatgatgctttataactacagtaaaaagtaaatattagcattgcaacataacaaaataaagaaactaagagtttgaaacctttctctagtgacaatttctaatttgtattgcattgaatcatataaaatcaccaatattcaatcatttatagcctgtaaatatgtcaatttcatttggttcaaacttatgtaagagttggtttaaataatttctcaagtgtaattcaactttgaaattctatgactttattgttctaatctgttcttgaaatagtaaaatcgaaagctttatatagattttagatgatgtattttcattatttaacatagtatataatctacatgtacataaacttcagggaaaaacagtcaactcaggcctaagctatccacaacctaacaagtggaaaagagtggaagaaggtgaaattacttaaaatgaagcacaggcctaagtgaagcactggataagaattatgcattagatgagaggatatagattccacatgggaacaacaggtcaaagaaagacgagacaaaaaaaaatgatttaagtaaaaacttctaaatgtagtttattgccagtcttatggtagtattccccaaatgaaacaatatgtacctactgccaaaataatctaaaaaatgtccatcatccttggtagttgatattcaacaaaatatcaacagtagatattcaataaaaatctgtattgactaagggaggtttttttttaaagaatcaaagtatatcataataagtcttgtcaaaaacacagcttcacctacttcgaggtgctatattcaatcttgatatatatctatcaggagataatagctagaaatagtccatagtcccaaaataaaattttgaggagctgaaaggactgacataactgatactgaaaaaatgctgtaggacaaagagagtgtagtataatatatatcaggcatcagtcttgtggaacttgttatcctatacatagtgaaatgatgaaaagataacactgatcaaagatggacttcaaaaatttttgactgacagaaatctacaatacacaaataatcaaaaaggaactgttctggttgaatttggggtagggatctcagagccccatcttcttctcttcctcaaatatgaggtgtccctgaacattcttttgaatactggtgtttcatggaccatgctaatttgaaagccactgctttagtcaggaagtttgctacaggacacaagtgtcaagcccagctgtgagttttctggcttcccagaaactctagagagagaagtccgtgccctgaaggagaattgatgacggctcacaatttcttgagctgccacagaagcaaaggcagaggaaagaggtgtgataaggaaagggggaagcccacctagcttaagatgggccagcacaaggcagccctatgcaggctgtgagaggcttccagccacttgctgatttgtgagaaattcaactgtggccacacaaagtcattccactgacatctcaaagagatccactgttacaattacaggtgactgtagctacaatgggtccccaaaggttcctgctatgcaaatacaaatattgatgaagataatactgctgtccttctacaaaacagtaacaacactcatgtttcttctatctctaatgataaaaatatatatactgtgcaaaaagacatacaggtttttataaactgaaagtctgcccttgtatcttcttctctccaaactcactcccttcttagacctatcattaacagggaaattaatttcatactggacaaagacacttatgaaaaaactggactgcaaggtcatccatttcagtattcttgcagaaaaatcatgaaatttggggctgggtctgataggattgtggcggtcctctctcccacctcaacagctaccactgcctccagatgctctaaagatggcgagctctctgggttcccaagcttacaacacccagaactgggagggggtggactttcctgttctgtgccaggaatgtcttgcagaaatctatatatattaaatagccaaagaaaaaagcaggaaggaacgcaaaatttgtgccaggccattcagtgttttgcttgtgccctggggtccacatgcatttcaagaagacagaagtgtgccaaccctgcagtaaattgaagcatgtctgttaggcctaaatcttaagacctaaagcatggtctgcccatccaggttaataatgcagaactgtcttctgaaggtgacctgccaaagtctgatgtcaaaaaaagagtactgcatgtagaatatgagagacagggatttctagctctgatggaacgtggccagtttgcctgctggggaaaaagccacactgaccagagacatgctactcagtccagcttggaccacaccctcctaccaaaggagtaagccccacatttgctcctcctgggtgaaaggagagtataagagaggagaggaacatccatgcagacatgagaagcctatagatccagatgatccccttgccaatcagaatattatggaatcaatgatccagaaacagataagcatctaaagtgggcttcaatcatgccccatctggacccatcagaggacaaggttatcctccccatatgttggtagtctggataataccctttctgagacagatctaagacatcatcactaccagtttggagagatgcagattgattactgttgttcagagagagcagtgtgctttcatccaggtttccacagggcaggctgcagaagtggctgctgagaagtcctttgataagttgattgtcaatggctgtagactcaacataaaatggggaagatcccaagcatccagaggaaaagaaaaagagaagaacagatcacagactctgggatccagctacagcctattccagcactgccatgagctcttcctcctcctacagcagcagaagatgcatgtgccagctacttcaacctgccccaacatggtcctccagctgtggtgaacattgcccagccaccagcccctagtcttccacacccccaaccccaggatttaggccacacatattcacctcaatgggaccaccctttcctttcatgacaactccaggattaatccactatctttctcatgaccctcagaggatgggagctcatgccagaaaacataggaaaccctagcacactatcaacactctggggctctatggaagaaagaacacttaaaaatccgaatcaatgaatcttggaataaatgtgtttttcttaaaaaaaaaaaaaaatcatactgtaaatggaataaaacacgtttctgtgtcacattttgggccaagtttataacctctattccaatgcttactttcctcaattcaactcaataaatacatgttgaatcctatgaaagatttatcatttattagagacatgaatatagaaatacatgaagaattccagcccagaataattatctcttcttaaaaccctcatctcactctggatatcagtattatcacttaccataatgttttaaaattagcttctatgtgttaatgtacctgacaaaactgtaaactcttattcatctttgtatcgctataaccagagctataccagtgtcaataaataagtgtactaaataaatgaataaaacatgaaaaagtaaaaaatacctaataatttattaaagcagaaaaccattcaaaacagtaaatggcaatctaaaaatgaaatgatgacctcatttacacttttgttttcaggataattaaaaaaatttaacttcgatgtgcaaagaacacctcagggccatttacatatcattttagattgtgtggctaaaggcttagccagatagggattcccacatatcagaacaaagaaatacagacaagaatattcccgagaatggtgagtcttttcaataaacggtgctggaaaacctggatgtctatatgcagaaaaataaactagacccctatctctcaccatactcaaaaaatcaactcaaaatgaattaaagacttaaaatctaagaaccaaaactttaagctactagaagaaagcacaggggaaaacgcttcggacattgttctgggaaaatatttcatgaaatggaactcaaaagtacaggcaacaaaaccaaaaatagacaaatggaattatattaaactaaaaatcttctacacaaaatcaagagttaagagacaacctgcaagatgggagaaaatgcttgaatttcttcggacaagggattaatatccaaggaacttaaaagcaataaaatgaaaaatccaattaaaaaaataggcaaaagagctgaatcaacatctttcaaaagacacagttgggtgcagtgacacacacctgtaatcccagctactcatgaggctgaggggggaaatggcttgcacccaggagtttgagaccagtctgggcatcatagcaagaccctgtacttaaaaaaaaaaaaaaaaaaaaaaagacacacaaatagcccacagtacatgaaaaaactctaaatgtcactaatcatcagggaaatgcaaatgaaaacaacaatgaaataatcacctcaccctaattattagaatggttattatcaaaaacaaggttataattaataataccaaatgctagcaatgaggaggagaaagggaatgtcttacacacttttgattgaaatgtaaattagtataaccattatagaaaacaataaaaagctaaaaatagaattaccatatgatccagcaatcccactactgggtccacatacaaaggaaaacagtatgccaaagatatatctgtgctcacatgtttattgcagcaatactcacaatagccaagacatgaaataactgaagtgtccatcaacagacgaatggatatcaagaatgtggtatatattcacaatgaaatactatttcaccataaaaaagaagggaattctgtcatttgtggcaacataaatgagcttaaatgacattatgttaagagaaataagccatgcacagaaagataaatatcacatgttctcactgatacatgaaaggtaaaaaagttggccaggcgcggaggctcacgcctgtaatcccagcactttgggaggccaaggcagacaaatcacctgaggtcgggagtttgagaccagcctgaccaacatggagaaatcccatctttactaaaaatacaaaattagctggtcatggtggcgcatgcctgtaatcccagctacttgggaggctgaggcagcagaatcgcttgaacccgggaggcggaggttgcggtgagccgagatcgtgccattgcactccagcctgggcaacaagagcgaaactccgtctccaaaacaacaacaacaaaaagttgatctcataatagtagagaatagaatagtagttactagaggtgaggaaagggaagtggagagaaaggtatagccaaagagttgtacagagataaacagctagataggagaaataatttctcgggttccatagcattatgtagtgactataatagtaacaatttattgtatatttccaaatagctaggagtggattttgaatattcccaacacaaagaaatcataaatgtttaaggtaacgaatatgctaaataccctgatatgatcattatacattgtatacatgtgtcaaaataacacactgtgccccataaatatgtacaattattatgtgtctattaaaaatgataataaaaaacaaaaaaaaacctggcagtgagtttcattgtttttattttctactcatatcccctgtattgaactcaaagggagtatgaatccaggaactgcttaccaagtatagacaaaaagaattaaaagagaagtcttttccttctttgacaaacaatggggacctcatagtggcagagggttggggtagaaaaatttgacaatgagtagaacaagataattttttggggaatgagggaactgttctgaatcaattttagttatggttataagactacacatttgacaaaacataaagaactgaaaaaagaaaacaaaacagattctgttttatgtaatttcaacaaaaaatttaatattataaaaactaacaaatataatgtatactggttacacagtattctacagtaagggaatattaacacttaaaaaacaatttgcctactatttttccctttcttctcaagcattcaaacatacaagtttaagagagacacaaaagaggaaaacgtacaagtttaagagagacacaaaaggggaaaagccaaaaaacagcagcagaaagcaataagaattaacgagagaggtgacctcctgtctacaatatgggggagaaaacattttatgtccagccaagttacctgccagctaaaacaaaaccaacaaaaagtcttcagaagagtcacaataatttattatataaaatatccacttttaaaaaaattattagacatgcaaaaaaaaccccaaaagaatgacacctagtaagtaaaaagcagagtcaatataaatgccttccaatgtggtacagttactgaatttagactataaatacttcaacaaagctattataaagatgttgaccgggtgtggtggcttatgcttgtaatcgcagcactttgggaggctgagtcgggcagatccctcaggtcaggtgttcgaggccagcctggccaatatggtgaaaccttgtctctcctaaaaatacaaaaaattagctgggcgtggtggcacacctgtaatctcagctactcaagagactgagacaggaaatcgcttgaacccaggagttggagattgtagtgagccgagatcatgcctctgcactccaacctggacgacagagtgagactccgtctcaaaaaaaagaaaaaaaaaaaaagatgttcaaagaattacaggaaaaaactgatcttaataggcaaatggataaagaactacaaagagatttaaatgaagagtacaaaacacacacatataatttgtcatgactacatgatattccatggtaaaaaaggactgactttttgaaaataactgttctctataattcttcctttcctctaaagaactcactctgacatatgcctggatattgtagaggtaaacaaaacaaggttttcctctagttaggtatatcattcaatgtaatatttagtggaatctggacaggatgaatctcacaaataggcatcaaaactatcattcaaatattaaatgggtaaggagaggtaagcatctactgtaataagaggatttctcattataagtaaaggcacatactatttcttgtttatactagtgtagcagtcatcaaataatgttccaccttctgtatttaaaatagaatataaaagtatgtatccataattcaaaaggggtttataacccactaagatacattttcaaacagatactgcaatagaaaatactatgggctacactgaaaaaaacactagcactgactaaatagcatattagacatggcagaaaaaatagtaaacttaaaggtaaagccataggaattacaaaagtcaaatgaaacaaaacaacagaagaaaaaggggcagaaaaagtttggagaaacactaaaggccctgaaagtcttgtgaaacaatgtcaaatggtaaaacttatggctgaaaacttccacgaattgatacctagtgttcaacaagaaaataacgatttcaaaaatcactcctagagatagcaaactacccaaagccaaagataaggaaaaaatcttgagagcagccagaaaaaaactacatgttacatacaggggaacaaatgaataacagttaacttgtaacagaaactaatgtaggtcagaaaatattagaatgacatattcaaagagccgaaaggaaaagattatcaacatagaattccatgtagggaagaacatacttaaagaataaagataaagatatgttcagatgaaagaaatgtaagagacttcatcattagcacagctgtactacaaaaaaagttacaaggcttcttcaggatgaaggaaaagactgaaatggcaactaaaatctgtgagaaggaataatgagcatgggaaatggtagatatgtgggtaaatacaaaataggccatatgcttccttttttatctacattccttaaaagcatttgactttaaaggaaaagttataatgttgtcatataaaaatagtaacatacatagatttaacatgaataacaataccactaaagagtaaatatctggtgtccttataagacaggaggacatgtaaagaaggggagaaggctatagaaagatagagaaaaagaacagtcaacctaatattctacattcagtactttaaaactgttgtgccatttcattctagcctgcctgttttctgataagaattccactatctttcaaatcatccttcccctatgataataaacctgtcaggctttaagatttgtattatgttattattgttcagcagtttgaacatggatttcttttaatttgttctaaacggagttggctcatcttgaatctgtagatttatgtatttcattaaacttttgaatgttttcagctgttacataattatagaagaaatccattaacaatagcaacaaagaagatgaaatagttaaaaaaacaaattaacaagaaatgtgtgaagctaaaagaagaaaaatattaaaacacaactgaaaaacacaaaagtagtctcaaacaaatgtagatatccccattcatagaatgattcaagattttaaagatgcagctctccttaacttataaaatcatgtaatctcaataaacataccaatgaaaatttttattagctagagaagttgctactaatattcatgaggaacaataaatatacatgaatagctgggaacatactgaaaaaacaagaaaaactacaaggaagtttagccctaataatcattaaaatatactataaaacctgtaataaatgccatactaggatatacatatactaaacccttagtatagcatatacaacgagaaacagatacctatatatataaattaagtatattataaagaaggcatttcaaatcactaaggaaaagataaattttaaaatacatgatgatggtaaaactgagttcccatttgaaaaatgataaaattagatccatatctcacaaaataacaggaataaacaacaactatatgaatgagctaaatgtaaaaataaaatcttacaaggattagaaggctacatgagtgaattcctctttaaacatggtacaggcatacctcagtgataccgtaagttcagttacagaccactgcaataaagtgagtcagacaaattttttttaaattttttaacttttaatttttgtgggtacagagtaggtgtacagtcaaattatgaggttactcagtgcatataaaagctatgtttacactatactatagtctattgattgtcaaatggcatgtctaaaaaataatgtacataccttaatttaaaaatactttattgttacaaaatgctaacaaccatctcagccttcagtgagtcataatctttctgctgtgatgatgatggctgctgactgcccaggggaacaagggtttgttttagattatgcaaattttcgatatcatgattgtgttataagttaatattataatattccattgttgaggctcagcaaattatgcattaaactagtaaattttgttatatataaagtatacttcaataatgctaacaaaaaagaattccagctgtaaataaaatgtttttaaagtgttgggttaccatcctaataaaagaatgcagagaagagaaaccaaatcaaattatatatgctcttaccagattaattaactgagtgtgtaccacatcttctaccaaaactgctgtttcatgaagaggccttctagcatcacctaaagaatacctgcaaaataattttaaacacaccaatattaaggactataaaactaagaaaggcaaaaagtgaaacatttattacatgaatcagtttagtaaggagaacataaattgtttgcccaaatgtctgaatgggtgtgcaattttcttggccaggtgtggtggctcacgcctttaatctcagcactttgggaggccggagcgggaggatcacttgagcccaagagttcatgaccagcctgcataacatggtgaaactccgcctctacaataaatacaaaaattagccggaagcagtggcatgtgcctatagtcccagctacttgggaggctgaggtggggggatggcttgagcccaggaggcagaagttgcagtgagccaagatcatgccaccatactccatcatgggcaatggagtcagaccctgttttaaaaaaagacaaaagaaaataaaagaaagtctttcccacacaagttgcaacttcaaaagaaaagtgcagtgttatctatgctatttctggattcgtacagtttttattttttttattttttttgagacagagtctcaccctgttgcccaggctgtagtgcagtggcacaatctcggctcactgcaacctccgcctcccgggttcaagcaattctcctaccacgacctctagagtagctgggactacaggcgcgtgccaccacacctggctaattttttatttttagtagatacagggtttcaccatgttagccaggctggtctcgaactcctgacctcaggtgatccacccaccttggcctcccaaagtcctgggattacaggcatgagtcaccacgcccgccttgtacagtattttttaaagggaatttattgtttcaaaatgcaaaatactaacaactacttcacaatactggcaaccagcaaatcatgtaaccacatcccaattaccaatgtaagagccacatagaaaggtataaaagtgtatgatgtaatcagctttgaaagttggtaagaaaaatttatgtaaataccattgaatatgacttggaattatatagaagcagattttcaagaatggattaaaaaggctggccttagaattcctcttcttaaaacttaaaagtagactggatgtgcaaagaataccttcttggtaaagaacacttgaaaatgcacaataatatatttaaagtatgctttaaccagcagtagggaagacaaaaccaaagtcagacaagatgaaaaaaagagttctataatagagtactgaaccttcaaaatttattctgaaggcatctacctaatcacagtaacctacagtctataccgaactagtagagaattcaaggtatagaaaagaatgtggggacaagaaaggtaggaaatcagtttgagaatccaatataacattgagaaacctaacataaaatgatggtgacaccctcaatgtgtgaactaggaaaatacccattccagagaatgcactttgcctacctcacccgaagctttgagtaggagaggaaaaaaatcttccctaagaattgttaactataaattcacttccatggtgctagagtatctgctacccatatagccttaaaaaaaggccaagcattaatttaaagtgatttatattgatagtgcccacaggtaccttgtagaaacaaatgcaattcatttgttgaagaacatatttcgaacaaataactgaaagaattcccatggatgacatatcaaggaccataaattcaaaatcaaaattcactacatgtaccaggaatcaagtcatcaagaatgagagtgagcaggaccaacaaactgcagaatcagacctacagcctatacatacctgaataaataagtatctattaactatagtaatttatgtttttttaaaagagaaatgagaagtatatgtaggacaacaaaaatcttaccaaatgcttagtcatttttgaaaaagtactaaacagaaatagaaatgaaaaatataatagcatttaaaaagttaatggagaaaagttatcaatctgataaagaccatatatgaaaaactcacagctactatccaacttaatggtgaaacactaaaaacttttcccctaagataagcattaacacaatgtccaattttgtcacttctattcaacacaatactgtaaattccaggcaaagcaattaggtaagaaaaagaaataggccaggcacagtggctcatacccgtaatcctagcactactttgggaggccaaggctggcggattgcatgagctcaggagtttgagaccagcctgggcaacacagtgaaaccctgtttctactaaaatacaaaagaaattagccaggcatggcggcatgcacctgtagtcaaggactataattgtcatgattagttcctccttgttttgatatgtgtgtgtatgtgtgcatgcatgtgcatgtatcttatatgtatgtgtgtatctcctttataaaatcctattgcttgtattttttctagagaactttgactaacatagccaggaaaggaatagctcaatattgaataaatatattaatataactacattaatttagaaaatgaaaaaagaaaacctacataatcatttcaacagatgtaagaaaaccactcatcaaaatccagcaaccactcatgacataaacctttagtaagctagcaccacaaggaactttctctaatttgataaagtgaatctgctaagaccctacaggaaaccacatacacagaagcatttaaaccctttaagaaccagatcaatataaggataactattatcaccactttcagtcaatataatatttaagattatagtcagaacaataaaacaagaaaaaactaaaactataaaagtattggaaaagagaaaactacacggtccttatatgcagataatatgagtatctacatagaaaaccaaaaatcaagaaacaaattatttgaattaataagttagcaagtttctggctataagatcaatctacaaaaaatcatcattaacataaaggtagaagatgcaattaaaagtaaatataaattggttctaaacattatatgagatggtaaagagacaggaatagtcaaaacacttttgaagtataagatgggagagtattttctacaggacttaatataaagctacaatcattaagatagtatgttatttggtgcaaacaaccaatagaacaaaaagagaataaaaagtccacaataaaaagcaaactccacaaaggcaaaaatcttttgttgtattcactgatatatgcattatttaattcgttggaatacttgaataaggttttccttccattattctaagttacttcgaatgtcactgttaaaaaaaaagtgcaaagttatcaacgctaaataattggcttaaccataaaactacaaattcaattgacatctatagtaaaaaaattaaaaatacttcttgtatcaataaaagacacaaattgcctaagcttttatgagaaagttagatctttgtactaaaaacagttttcatgagcatacactgtaaagtaagtacctaaattagttacaatgactggtatcaggtgtatcatttgatgagtatattattttaattttcagggttattggtacttcagtttttctccaacagcttttataaataacttctgtcatttttcccctcatacacagaaaactagatattgttctagtcgtttttggaaaacagaaatgaaaactgctgtacctggccacagtcacttccttttttgctctgcaatgtatgtactacttgtaagccacttaaagacagacaagtaattgatacttatacaactattttgatttttttcccctttgaagacctatctcccagtgctctgatgtcttgactgacttatcctgggtcttgtcctaatcaatagattctgataccctattcatttacatactgtcttgatgcctgtgacaataccagtactgcctgactaccgtccactaaaggtctttcaggaaaccttctgaaaaggctgcccctctcctggtctcctgcagcagtctcgttgctataacacacaaccctccattttaggaaggactgtgactctgacagccatgattataactaaggccagagcaacttaataatgattggggcggagcaacttacaccctatcttctcatgcaaacagtattggctttattcaatcctgggatgaaatgtctcacttcaacctagggcaactgactctgcaatccgcttgacaggtgcacagtgaaagtatgaaacaaacaagggcattcatgagatgaagttaaactttttattctgtatacttatactgggatccaggaggatgaatgctgaacaaaaccattggatactgttttaaaaagacagcagaatttatgactaacacttttaacatttttgcgctatgtatagcccaatactatctaaaattaggggagatccttcaaatagacatctattaaaatatacaataaacgtctagtcattttgctctcaaaaaacaacagaaccccttttcagtgctttctaacatcagctttttttaaaaaaaaaaaaggagaaagatttcttaaaaatgaaggagctttactatcttatgttgaatccacatgtgacatctttggttagtaatctatgccaagatgctacccaaatatagcaatactcttttaatctctctataaattctaaagcatcatttcatttgctaaaatcttttgctaacctctggaccctatgtaaatgcatgtatttgatgatgtatcaattgacctattctcctcacatctacatatccccagctgtgaaaggcagtcaactccaaactcttttaatggcataaactgtaaggggaaaataaatactttttgagaaagtatatgtaatgtgtgtacatatgtgtgtgtgtatttcttttcaagttatacaaattaatataataacaaaacagcataaaataaacacaaaagagaaatatcaaaggaggtaagaaataaaacaaacgatactttttttttttttttttgagacagagtctcactctgtcacccaggctggagtgcagtggcgcgaccttcgctcactgcaacctccacctcccggcttcaagcaactgtcctgcctcagcctcctgagtagctgggattacaggcgcccgccaccatgcccagctagtttttgtatttttagtagagacagggtttcaccatgttggccaggctggtctcgaactcctgacctcgtgatctgcccacctcagcctcccaaagtgctatgattataggcttgatccactgcccccagccaaaatggtatttttaaaaatatattttatttattggtgttagaaaatctttttgcattcactaacatatatacattattgttatcagcatgaccaatcaccctagtttgcctgggattgaggggttttccaaagtgttccctaccaagtaaatcagtctaattagtactagaaggtcatggcatacattcccccctccctcccccccgcaaaaaaaacaagcaagaaaacagtttcatttgttaagggaatgaattaacaataaataaaacttgtatttttcctttcaaacaattacccttattatttcagttctaaagtctcaaaacagaaacaaatagcatatgggaaatttattccttcatctgaagataatgcttttctattctctgatgttgaggatgaagttcatgagagtcagtggatgagtaggtgcccagctgacatctcactgtagtcacggcccccccacccccactcagggaaagaaatagcaccaaactaaatgaccagccagagatttgagctcagaaaaatggatgaagttcacagggcttgtatccaactaaaaagattacaataatgctgctagaagtcatactatattctggccgtcagctacaaagtaggaaaagtcagtaaccatgaaaatatcctggaagttagaggatctggttctagttcccactatgctattaagaagtactgcaatgagcaggtaacttctcctggcacctcagtttctcagcagtaaaaggaggggactagattagataattttaaagaaaccttttcagaaactttattttgaatcaaatatatctgattcaactataattcgtaaatcttaaagactgtcttcaagaatggggcaacactgttatgagaaaatcaaattgcacagagtaaactgtgggaaaatcatgaaattaagaaaaagaaaaacatgttaaaaatgagtaacagaacgaaataaataaataaaaataattagaggaaggaaaagaaagctatagtttatccctggccttatatgtggaaataatttctaagaaacatgtcattgttccttaaatttaaaaaaaaaggtggggggtgttgaacatattatcacggaattttacattattctttttcaattaaaagaatttaacaggcctaactttgagtctaaaatacttgtttttaaatttccaagccctgattaagaatagaggggaaggactgattaagtttctaacagaggggaaggactgattaagtttctaacagaggagaagggctgatttagaggggaagtgctgattaagtttctaacagaggggaagggctgattaagttttaattaaagagattctgaaaaagaagcaaaggggataagtttggtgatgatctgtggacagcctgctgggccagtcaccaagcatacaaggcctacaagcagatctactcataaagcatctagaaaccaaacataaagaaaggataaagagatgtttctttactgccatgtgtacatcttcttggatgctgagttgctttcaatacttcccactggctacagactctaatgtggttaaatcattctggatactctggttaagtaattgctgtggtcttgggagctagtcacttttttttttttttttaattagttctggtttttttggatgttttcctaccccaggtaattgacattactttagaatggacactgtgtgactattgcttggtttaagaaggctctgggtaacttgctgtccccaaaagaaaggttttttttttttccgttcaaagcattttttgattacacttttatagactaggtattactataatacccaagaatttctcctaaatggaattagagtgaataccaggctacagccctaccatacactttagtcagctaaactagtactagatgatgtatgtgaacacagacatcatactgttgtttatgtcattcttacccaatatctgttgacactgatttgtccactatccaaagtggggaataaaagtgcagaagtttggccgtgatcagtcatttaatgcaattggaaagttataaacactacaaattagccttgctcttcaaattttaacagctctttcacaaatctatgattttacccacctgttttcaaaggaagaaatgaattttattaacaatagctctaagaaaccccaagtgataggtaaatcaaaatatcaaataaggctgggcgtggtggctcaaccccagcactttgggaggccaaggtgggtagatcacctgaggtcaggagttccagaccagactggccaacatggtgaaaccccatctctactaaaaatacaaaattagctaggcatggcatggtggcgcatgcctgtaaccccagctacttgggaggttgaggcaggagagtcgcctgagcctgggaggcagaggttgcggtgagccgagattgagccattgcactccagcctgggcgacagagcaagactccatcaaaaaaaaaaaaaaaaaaaatcaaataaacatctaagacaacagatttcctagcagtgatgatttttctcattgcttgcttgatttctcaacaaccatttccccattccccttctgatagtaaacattcatataatttaactgaactttgagaaaacttttagaattttacaaaacaccatgaaataaatataaatatgtgaagatatataaaaagcaaaattaaattatttatgatataaaataaataatgctgacgtaaaaaaatacaaatatactaatatacatatatgtttaaaataaaagataaaacagtataaaattttgaaaaggtaaacacataatacctacaagtattaatcactcaatcaacaaatattgactgattgcctggtatgtgccaggcactgttctggttccttggaacatatcagtgaacaaaacagacaaaaaaatgagtcaagtttacattccgatgaggaaaggacaataaacaatataactaatgaattactaaataaataatttgtatgttagaaagatgagagaaaaaaacttagaacagaatcacgaaatgtatgcaatgggcagtgtgaaatattaaaacatgtatttattaagatctgatgtgtgaaagaaatagctttaaatagaaaaaatatataaatcagaaaatttttttaaaaatcaagatttacataagaaagctcatccataaatatttataagaaagctcataaaataaaactcatctacagtgcatgaaaatgtgcatctgagaaagtttacaaaactagcagaatatctttatgaatttcttctaacaatttacagggcatttttcctcatatatcctacatttctaagaagcaaatattcccatcttcaaactcttaatagatagcagcataaagcaaattattataaaccgtccctatttgaggaacaggaaagatctatatagcaatcattgaatgttaggtcaaaaaataatctaaaagattacgtagtcctttcattcagttttaaacagatgaaaaatgaaagcccaagaggttaaatagccatctcaaggtcataagtccagttagaagtaaaactaggacttttacctcatccagaactcattgtacaacaacacgctaaatgaacatctattaagcctccaaaacatttaatggactttactatcttagattgactgaaatttagtcaaaaaactaacttcctataacattgaaaacagatacactgtaatcacaataacacctcatagtcatagaggacttttctcacctatcatttaaagcaaactgtaaagcatgcaaacaggaaagtttctcccatgttacataaacatggaatcagagagagtcaagaaagttaagacatttacccggggagtcagcaacagtaagcgtcaagattacttggtatgagatagtcacagagataagagaattttgtaccatcagatctttagaaaattatcaatataaaatggatataaatatggcatactgcaacaacatttttcagattgacagtgtccagaagaaaaagtattttgtagttaaatgagcttggaaaatgacatattttattcttttctagatttgcaatacatgttaccatactaaacactctgagaggttctgaagaaaagaaactcttgattttaaacgtatttactgtgtatataatccttttctaagcccatggagttacatagcattgaaaaaaaattaggaaacactgatttaaacaaacaaacaaaacaacttccaaaataacttaaggactttagtgagaggattccaaataaaatgcaacctaagattttagaactccaaagccaagttcttcagtttctaacaatgacatgatgatggtggtgataatggcaaacattgtgagctttttaaaaatgcacttacattcaacgaatatttattgaatactgggtctacatcatgtcaggcactgaatattatactagctgagaattttcaaagttcccacaaacttaaagacatgactgattttctgtagccatggcaataaacagccaccagaaccaggaacagactcattccagtaaacacacccttgagtgccaaccaatcaacaacattctcatctctcttattatagattatgtcaactccagaacacgaccaatccctgaactcaatgcttcctgaaaacccaaaagatcagcagccttccttgctaacaaactgtgcttgaccggcatgtatctctcctttatgataagaagaaataaatcaagttttctgtttttatttcagatactgaatgacaggctcgttatttttcacagcatttaaggaagtttgccctcacaaactagtcagcctagcctcccttcctctccttcttctcacattttattttgaaagattcctaaccaacagaaaagctgaaataacagtggaatgaacacctgtaaatccttcacctagaatcaccaattattaacattttagcacaactgcgcacgtttctctctctctcttaaaaattatacacacatacacttgtatctttatctgtattaatttttctttaaacagtaagcatgtattaagtgccaggtatatttatatatgtcatttaaacctcttaaagaccctgcaacacactatcactatgcctgtccctctgcatcttggagagatatttgttccagtaagtgaaattctgggtttttaaaaattaatttccatatgctgggattagctttgtcccctggaactgatgaaatgacaaatccttttacatgacaggtcttcaaaagtatgaagaaagcttactttaaaggtctggttttgttttgtttttgctaaacagcatctgttttaaacagctttattgagatatcatttacataccataaaatccagttgtttaaaagtgtacaattcaataacttttagtaaatttacagggttttaccatcatcaccacaatctagtttcagaacatttccatcattccaaaacaatgtctcatgcccatttacagtcagtcctatttcccatcctcagccaaagacaaccactaatctacttgaagaaaccatacatcctctctaggcttcttcaaggttaaagacttcctatttcttatcattttggtctcaatgtaaatagcatatctttgaaaagactttccaaaactactaccactttcaattctcacttgaatcagagtagtttggcatttatttgatttatatatttaggtcctacccaagttttcattaaaaaaaaagttataaaacttttagtaaacaaaccaaaggaatgcaaacctctaagtgttgaacaagtcataggccaattataaagccctgtagcaaagagatatccttgaaacaacagatccaataatcaacactttgtgggctgggaagagttgatccaggtttcaagctgtctttgtctgaaatataactctccatctcatccagcagaacatcagcacagatgacatcaaacatctcatttaaatttttactctaaaactgtgacattaccttaatgaaagtaaaattattttatactgatatcaattgtgagctcatgcaagttcctaataattatagattccaaaatttttcttgagattgatgtcaagttcatcagggtataatgactagaatctccttcacccaacattttaaaaaatgaagcaaactcatgccaaaattacaactttattacacttccttacaaagcattctagaaaaaccacctggcaataattaataccactattgtacataatctaatttgtcaccaaaaacaatggctttgctctcagaatatgaataaaactataaattaaaaaatatggaaataatgcaacttgaaaattaattgtgtaaatatctgtgactgccagtaggagaacacataatatattccagttgtactacataatatattccattagtttcttcacaaagggctttcgcttgaatcaggaagtatataagacaattgtcttatagtgatcagtcacttttaagaacattaagaaaaagttcatctctagtctcaacaatactgtattcctcaaataaaaatgaaatttagtatgcccagaagaaatgtgttttcagtttgttctctagaacatggataaaaaagtgatgacatgagaaagacattaagacacaactctactgagaataaacacatagcatacattaaatgatcttttactttagtataaagtctataacttaaaaatttggcatgcataaataataaccctttatagatatttatatacactattaacactgaaactcatattaacctttaaattttactatgaaaagatcagtatgtacttgtagaagcttacaatgaacatataaagtctttaagtatactgaaaatattagtgaaaacatacatctctgtatctacctactaccaccctgtacacgattaagatcttcataggtacaagctctgtggtagcaaataaaaatattaataggcaataccaggcaattaattatttataatagttaatatcaataaaacagtaattaagaccctagcttagagccttcacagaatcctacaactttcaaactcctctgtttattatataaaagtctttgacatctggcttctctctggttccacccttatttctagccatgcaccatttgttcctaaaatatcaaactccctatggacagctgaccacacaataggtttcaggtcttctcacttttgtacatgatattttctctgtcaaataagtctttgtttcttcttccattcagccaatgccttccaaacttagttcgaggggtacgacccttgggaaattttccataatactcatttgctgctctaaggcatattgcactgattgccctaactcacctttcacctcatattatattcattcccattgccaagtaactttaagtagccctgcactataaccctgagctcaaccctgttatgttctttggccaatgggatattattagcagcagaggctaagaagtgcttaagcatttcaacttgcactcttgcactctgccactgccatgaaagtatgacaaggctaatctgctggaaaattagagatacatgaagcagagctcagtcaccccagttatcgtagttgagttatcatagatcagctggcagtcagctgaccctcagatagataacagagcacagctgagattggtggggttgtctaatctactgtcatagacatataatcataaatgctgaggtttcacaatgttttgttatgcagcattattgtggcaataaataacaaatcccactcctagatgcttccatagcactcttcacaacctcctcatagtatagttacatagttgtatagttatgtagttacatagtcatacttttacatgaactaatttgtctctattctcccctatgcatttagaggaaaataatcacctgttatttaaatttgtattctgagcacctaagaagatgccagttgtatgtgggcactcaatgtatgtctagggaagagaaggtatgaggacggattcacctcccaactgattccactattatctcagaccacaaggagccttccctatgttgtgaaagttcagtgggcacacaaactagatactgttagagcagattaaaaccttaagcatataggctttaatatatgcttattatatgtatatagctgcctgttggatgagcacagatggccacaaattcatgtgatttgtgggcataatgttaacaggaaagagtcaataattgcagcactttggaccaaataaagagtggaattaggttatgcagtaaaagatgccagggcagagaatcaaagggtgtattcctagaaaacttaagattttcacatgtagaaggaaaaatgtttgaaatttcattaaacttggtatgcatttggggccaagtaaaaaatattcaaaaaggaaccagattaatgatttattttttttaaaggcagcaaatacttttaaaaaagaaaaggaaaaaaatgagtctgaaaatatatacaatttagaatctgtttaataatgatagttatgacaaaatgacaatgagtcgattatatccataatacatactgaggatttactgtttgctagacaccactgaactgattcaaatgtcaaaatgactctaaaaggtaagtactattactattgctacttcaagacttgaagaggttaactaaattacccaagtaacatagttaataagtggcagaaacgagattccaaatcccatcagtctgactgcaaactaaaaaaaacaaaaaacaaacaaacaaaaaccctctaactgctctataatattgtctttcatagaaactgaagagacttcggaagtaatttatttcagtttccaccacaataaagaaaattttaaaagtgaaaagactatataggctaggcatggtggcttctgtttataatcccaggattttgggaggtcgaggagggagggtcacttgagcacaagagtttaaatccagtctgggtaacagtgtgagaccttgtctaaaaaaaaaaaaaaaaaaaaaaaagactatataagcatatatccaagttagggtgactggagtaggatgatgatgatactttgataaaattggaaataactttttgacaaccagtgtggtacatgcagaaatgcaaaccaatatataaatgccacaatagttgaattcagaagattaagaggaaaactaaagaagttgaacaacaaatgatgtctatatcaataaccaaaaaaaggaatctattaaaaggctgaacaaattcttccaagtcaaaagcaaataactggcttcctctattcatgcaaatagctgtttgccacatgaaatttatcttgcttttaggtttcaagaattaagggtaaatattaaagctacaaacctggggaactccatagtgtctttatgcataaatcacatagaaatttctcaggttctgagataaagttcaggaataattgtactaaacaatgcaaaaatttcccaaggctaaaatttgaacaatattagaacaataatattagaacaataataagtataggttaacttcatcatactattaatagattataatacaaatattacacagagattaaaattgatactttggaacaggttgattatctaggtatgtaattattattatattcagagggaaatattccttgcagcataaagacaccaataccattcatatactgtttccagagagtttgataaacagaaaaattccacaaaaatcttggcccagaaactctccacaaccaggatctctgatttccataacctctagatcctataggagtaaaaattagagcttctcttatggtgaacaaatttcctatctcaaagcccttggagaacgtcccatttttttctagagagagaatgcttgggcaactctgagaggaaagaaggaaattgtgatgctctgtatgtcctggggaccagaggtttccaggattcaaacaaatgtaaacaatttgacttcctgagtattgacaaggaattagaatattagattactaaatctgggttttctcagttgcaggagtttccctttcccccacattccaaagatttcaaaaccctatgaaattatgtgggggggggggtggattatctaagtatatctttcacagttgaatgactcaaaacaatatttaacattttaaattaacctgttcataatgcagtattcaattcttcactaaactcacataactcatttctacttatagattttttttgggtttttttgtttttgtttttgtttttgagacgaagattcgctcttgttgcctaggctggagtgcggtggcgtgatcttggctcactgcaatctccgcctcccagcttcaaacaattctcctgcctcagtctcctgagtagctgggattacaggcacccgccaccacgcccagctaatttttgtgtttttttagtagagacggggtttcaccatgttggccaggctggtctcaaactcctgacctcatgatccacccgcctcagcctcccaaagtgctgggattacaggcgtgagccaccgcacctagccagatgtgttctttaaaactctgagtaaagaaagttaagtgaaagatatctttcatttaaaaacaaaaaaaaaagaaaaattaaaaatgaacaaattgtattttctacatatattaactttaaaaaagaaaatgcaaaattaatctatttaccataactatattttcacacaggtgtcacctttattacgctgtaaaatgctagagcctacaataatctattccagatatggggttggggttgggagcaagggtttggcaagggagtggaaaagtaacaaggctgtctgtagcacttttagtacatgttataagaataatccataacaaaaaaatattgattcaattcagtataactacttaaattttcttaaaatcacacatactttatatagttaaaaccctaataaaaccctaatacactttctcaaaaacttaggaataatttcacagtacctaaggattaagaaaaaaggtttttaaataaaatattgatgtttaaaatgtctctttaagctatttgctagcaaaacaaaacaacagactttgaaagaatactaaacccaccatcattaattttattttggtaactaactttattccaatgacttcataacaaagttaacctttaaggataaatcaccatatacaccattaaaacaccaaaaatagaagacagaattgctcctacttccatgacattttgtttctaattaaaaaaaaattttgggagtattgttgaagagaattcatattagaagatatatcaaattaaacgagaggcacttcatgtctattttctaagtttatatcatactgaaaactgtgcttgcagaccccatgaacaagaataatcatccacaaattgctagactctttcattttggattgtacactgaaaatgaaaggtggacatttagagtctacatgttctattttcagcttcatcattaacatgtttgagaacctggggtaaatttctttacaacaggtaaatattctaataccctattacttaatggaagctaggtccaaaagctgacacttaagtggaatactaaataaatatagtcctattttctttattgggttttctgatttaaaattctaccacatatatacataaccatcttaatttacatataaacttaattcactttaacaatattcactgaacatcaaccaagatgaaagtcctctcctgaaggctgaggaatgcaaatgtaaacaccaagtccttgtgaactccaaaattagtacataccacactggtaaatgagatacaaataagcacacatgaaactctctttcagtcagtctaatttaattaaaattctactatgacaatacaaaaatcatcaatttttttaagtgtgaattttaaattgtatcatttatttcttttttttttttttccccagatagggtctcgctttgtcacccagactggagtgcagtggtgtgatcatggctcactgaagcctccaccctctggtctcaagtgatcctcccacctaggcctcccatagtgctgggattatagctgtgagccactgcactcagccactaaattgtacaatttttttaaagtacaattaaaaatttgtactattacaaaaaataaaacaaagattatatatatataatctattttaacctgtgtggtgaagtgtaacaggttggggaaaaaactataggtgtaatccaagggtcagcaaatattttctggaaaaggtcagacagtaaatatcttcaactttgtgggctataaggtctcttttgcacaatggccatcacaataccaaagtcaccaatgacagtccatagatgaatgaatgtgtatagctatgctgcactaaaacttatgaatggtcactgcaatctgaattctgcatctcacataatttcatctcatgtaagtgctacatctcatgaaatactactcatcttttgtttttttccccaaccatttaaaaatgtaaaaaatattcgtggttacacaggctgctgaacaaaaacagggagctatgttgatttcgccttcaagccacagtttgccaatccctggtataatcaaacaccagtatcaaataatatgaattaagagtgactagtagctgaccataattgccactgttcagagaggagagaaaggaaaatatattcaaataatcaagaacttcttttaaagaagtatttgagtaagagcttgagttaatgtaaggatgatgataactcatttactgtagctattatattatttagtaactgcaagaaaactgttccactgttaaaaaaaaacactaatttgtcaaaatatatggaaaacaagcaatcaacttcatgttcttatttaaattgtaaaagtacagttgaaaaattgtactggctgagcacagtgggctcaggcctgtaatcccagcactttgggaggccgaggcaggtgaattacttgaggtcaggcgttcaagaccagcctggccaatatggtgaaacccccccctctactaaaaatacaaaaattagctgggcatggtggtgcatgcctgtaatcccagctgcttggaaggctgaggcaggagaatcccttgaacccgggacgcggaggttgcagcaagctgagattgcagcactgcactccaggctaacagagactccatctcaaaaaaaaaaaaagaaagaaaaattatactatttttaaactgtacagcttaccaatttttaaaatattgaatattcatgtttaaaataataataaaaaaactgttataggttgaattgtgtccttccaaaaacaatgtataaaaatcctaacccctagtacctcagaatatgaccttatttagaaatagggtctttacagagataatgaagttaaaacaaggtcattagggtaggctctagacgaataggactggtatccttacaaaaagtggaaatttgcacagagacagacacacacagagggaaggcaatatgaagacggaggaagaagacagtaatgtgactggagtgatgaatctaaaagccacgaaacaccaaggattgctggcaaacacgtaaagctaggagagacaaggaaggattctcctctagagccttcagagaacaagacacttgattgtggatgtctaacaacctcaactatgggcagtaagtttctgttgctttaagtcacccagtttttggtactttgttatagaagccctaggaaacaaatacacaaacttatcaacgtattaggcgtgtttttcactttgtaattctatcactatagtaatcaaataacatgtcatcatttaatgaacaaaattttaagtccaaaataaaccatgaattataattgtcatgttaaaattaaattgactttctatgcatgatatgactaccaaacattttttttctacaatactttgaaccaaattttgtttggtttttgggttgtattactattgatggcaaatgcacactactgtggaatggggaaaattaagtggtagaaatgcatggggtcttaaatcttcctctcatagagtatggatgcaaaagattcttgcattctaaagtaccattttcaatagtgcaacgtatccactttcttgcatctcttcctgttttgatttgtgatttcagggatagttatgatgataatatggtacatgggtctccacttacactcttgctctgtgtcctacaaattttgaggtgggcttcagcaaaacctggatcagattatggcttcagtaaactctcatttctagcagtgatttatttttcaggtaactgaacacaatagtatgtgtttgaaatactgcattaaaaatataaagaactattgaccttaaactattaccaaaaaaaaaaaaatctttctggttttaaaagacttccaataaaagaaagtccaaaattgtattactctttacactaaaagtttccattttcagttattcgtatcccatccattttttttcagaagttttgaaaaaggagattcacatagaatgttgcccaaattttctgagacccaaacatgatctcttaaaatatgaaccaacaagcttctgcatgtctctgaactcagatttgtgcatttcaatgtcacctggatgcccaaatttaaatttcagggctgcctatcaagcacagtaactgaaaacttgcactaaactcagaagtgtgcaaagaagtaaatacccattggaaaaaaacctctgatttacagggtggcccatttaaaacagttcccatttaataatgtggctgtgtacagggcctcttttaaatgggccaccctgtatgaagcttaagtccaagataaaaaatgtcctcccttgagaatttttaaaacccaaaaacattgtaggtttagtggttatttttaaggttttagatggtttctttggactcctttagaactgaaaaaagatggatacacatttaaaaaatgaaatgttacaaccacacatctgtaatgagaaccagtgccagtggatatttttaaaacaaattaaaacggtcaatttttttttaacttaggcaaacagctgctatacacacagtgcacagtaactacttttcagcaaaagttcagaaggaatttcctaatgaagatttacagaatgttctgggattgataattaagggttcccccaaaagatatgaagaacagtgttagcgatgtaaggattaaggacactgactatgcctatcctctaagggagaagcctggaatttagaataaaagatacacactaaaaaccactgagggaaatcaggataaaataggtactgtatatcttttctgtactgacttcaaagtgttttgaaggattccataataatttctaaagtttaaatatctctgcaatttagttcattttttaaaaagggggaagagacgatgcgaggagaaaaaatggaaaaagcttgcctaaaaaaaattatattgatacaagagatcatgagttctgaaaattctgacttccactgtgtacctgacttgaataatgctgttttccctccaaaaccaatattattaataataaaaaataactatgggctgggcacagtggctgacgcctgtaatcccagcactttgtgaggccaagacgggcagatcatgaggtcaggagttcgagaccagcctgaccaacatggtgaaaccccgtctccactaaaaacacaaaaattagctgggtgcagtggcgtgtgtctgtaatcctagctactcaggaggctgaggcaggagggttgcttgaacctgggaggtggaggttgcagtgagctgagatcgtgccaccaaactccagcctaggagactgagtgagaatccgtctcaaaataaataaataataataaaaataacaactatgaacactgtcctcatacactgtcatcatacagtgacatcatacacttcccaggcacctgacatcattaaatcatttaaactccacaacaatactatgaggtaggtattattacctcttcttcacagataagaaaaatgatgcactaagagattaaataatttgtctaaggtcacaaatatggtaaaattacctttcatgattcaaacaaagactctaaatccagagttagcattctcaaacacacactcataatttatgtttttttcttcatgtagctaggagtttatctgttttttgatgttctcagagacttctattttcaaagacttttctctattgtctgttttctatctcgctgatttctactcttatgtttactatttccttttatatttactttggattcaattttcactttttttatcttcttaaggtagaggaaatactgattttcaacatttttctttctgttctaacataagcatttagagctataaatttctctgtaggcacagctttagattcatctaataaattctgataggttgtgtttactatcatagggtgaatttttaaaatttctcctattttgtcagctttgcttcctgtattttgaagctctcttattaggtgcacaaatatttaggactactgtttcttcttgacagacttttatcattatacccctctttattaccgataatgcttgttattctgacgcttactttgtctgatattaatatagccctatcagcttgcccaatccttatgactgggctttgcaatgtacaagagaatcaaggcagttttcttaatgaaaaagtcacaaaaatagctcacaagctaaagtaaactgtcttagaaaatataattatcagccaggttcagtggctcacgcctgtaatcccagcactttgggaggcagaggcaggcagatcacgaggtcaggagattgagaccatcctggccaacatggtgaaaccccgtctctactaaaatacaaaaaactagccaggcatggtggcatgtgcctgtagtctcagctactcaggaggctgaggcaggggaatcgcttgaacccaggaggtgcaggttgcagtgagccgagattgcaccactgcgctccagcctggcaacagagcaagactctgtctcaaaaaaaaaaaaaaaaaaaaaaaaaaaaaaatatatatatatatatatatatatacacacacacacacacacacacacacatacacatatatatatatacacacatacacacacatatatatacacacacaattatccacaagagtccagtctatagaatgaaaagtatttttttctattaaaagattctttttttttttgagacagagtctccttctgtcacccagactggagtgcagtggcacaatcttggctcactgcaacctctacctcctgggttcaaacgattctcctgtctcagcctcctgaatggctgggattacacgcatgtgccaccacacctgactaatttttgtattttgagtagagacagcgtttcaccatgttggccaggctggtctcaaactcctgacctcaagtgatccgcctgcctcggcctcccaaagtgctgggattacaggcatgggccaccacgcctggcctctattaaaagattctttgtcacattaactatgtattcatgacaaatttattattaacttgtccaataagcaaaagcttttaaaaaagaaaaagatgaatatttcccatacataaataacttgaatgtggtttactgtagttgctgtatcaagttttatagagcagaaaaccattaatagggctcatctgaattgccctctactcagactctgacctgctattacactgtacaaagcctttcaaattcattctctttgcattgttatgaaaagtgctatgtaaaagacaactatttactcactactgatgtatgttctacacaggatctttggtggataaagaagttttcatttggcagtctggacaatggtgcccattaatgaaaaaggcttagtataggatattgaagatctggaatcaagtcctcgcacaacaaatttctagttatgtggtctcacacttcaaattcttggtttccttgtgtagatatttaagcaataatttcatgtttatgataaggagaattagactgctaaagatcatttattgaaagttcaccgtcctagatacccgtatgaactaaatgtcagtcatttgattactaccttcacaacttgtgctgtttttttgtactagttaggcagctactgatttttgtacgtcaatatttattactattttaataaatttaaaaataaactttttatcatgaaaatctaccacagaaatcaatatcgtatgccagaaagcgaagacgtatactacttatggatttttttaaaaaaatccatcaatcaatcaattggatattctcttttgggggaattttgggggaattctgaatgaagaacttaggaaaggatggagaggaagactgcaggagaaaaataaggagaaataaatagaaatgagtcaaaacacacacaaaaaaggcagtgttaagactggcgtaatgattggtaaaagccacttgcgaactggcacaagacagctaagtgatcaaaatattctaaagattatttttaacactttcactgagatataaacataccataaaattcacccatttaaagtgtacagtttagtaggtttctggacattcacagagttgtgaaaccatcacattaatctaattttgaaatatttcatcaacccaaaaagaaactctctacccattagcagttattccccattctcaccccctctctcagcatcttccctgcctcaggcaactttctgtctctatgaatttgcatattctggatatttaataatcgaattatacaatatgtggcctttgtatcttttctcttttacttaacataatgtttttacgggtcatccatgttgtaacatgttatcactacatcatccctttttatgtctaaatgatattccactgtatgaatataccacattttacttataataaaattcagctgatggacctttggattgttttcctcttttcagttactatgagcaatgctgctatgaacatttgtatacgagtttattccatcctttttgaggcctagctctgtagctgctgggatggtaggtccatgtgtctgtacttcctactgcatttttactgtaaattctcatcgtatgaagtaatttacgggtatcctttatcttttgaactttaaagagtcacactggtgaaagcataccttacaggaaaaagacaaaggtaaaaaaaaaaaacaaaaaaaaaaaccacttttttttttttttttttttttcagatggagttttactcttgttgcccaggctggagggcaatggcatgatctcggctcaccgcaacctccgccttccaggttcaagcaattctcctgcctcagcctcccaagtagctgggattacaggcatgtgccaccacgcccagctaattttgtatttttagtagagacggggtttctgcatgttggtcaggctggtctcgaactcccgacctcaggtgatttgccagcctcggtctcccaaagtgctgggactacaggtgtgagccaccacgcccagccaagaacacttttaagtagcaagcaggagcagaggactaggactcaaggatctgaggtatcttctctcagtgctgttgctatcctctccatgatcctgattagatcactcgccctgcaaggagctcagtttcctcagatgtaaatatggaatactgggctaaattataggttgctttatgttctaaagtattataatttaaacctgtagtctcatccttccagatacggcaaaataaggcagcagaaagaaaaatctcatgagattttttcctcagtgttctgcctaattcattcatgcatgattcacaatcacagtctacaacaaattaaaaatctattcactctcaatttacacatcttatccaggatacggcataacttaatatttatttccaagcctatatgtaaccactgtacctcaagtatagatgggtttctaacatacatattaacagcttatgtttatttccaagcctatatgtaaccactgtacctcaagtatagatgggtttctaacatacatattaacagcttatgtgccagttttgataaaggaagccattaaagtcaaactgttaccatataagccaaagccctctaccttgcatcacatataaaaagatattcagattgacggaatatgtataaatatgaaaaaagaagaaaatctaacatgttaactctttacttttaactactgtaatatagctaagcatcaaaaataaatattattcccaaaaagcaacatgaatagagaaaaacaggtgaattatagcttaagtattatttcattgtaactacagtccccaaatattcaggctggttggaacaatggtgggtttacaatagccccccttcattcatgggaaatacgttttgagatcccccacactccatggatgcctgaaactgggtagtacggaatcctaaacatacattgtttttcctataaatacccataataaagttcaatttataaattgagcacagtaagatattaacaactaataatataatagaacaatgataacaatattcagaacagtacattatttaagaattatttctggaattttctatttaatatttttggaccatagttgacagcaggtaactgaaactgcagaaagctaaactgcaaataagaggaggactactatattttcctgctcctggcactggcaattccagaattcctataaaattaaatctctgcattctctggaagctgtccaaactgagagagaggaagtgttgctttgtcagactgtttgtaaacttcccatcaaccctggtacataaaataagctaacttctaagaccttttacagttccctattccctttaaaatttgctacaaaagattactttaaacctacttttaaacattttccctactgcttgataacctatttcaacagccgtccaacaaaataaatgacaggatagaagagcaaatctctttctgctatcttacatttatctttgaccactagacctttcctgaaaccaacacattttaaatattaaattctcttacagtgtgttatattttgattgcaattttagtgatatttctacaaaagacttggcagattatcatgtcactattttttattgatgattcttccaatatgccagtgcactatgctttagaagaacccaatggaaaataacccatctgaatttattaaatttaggaagtgattctattcttaaaaaaatttccttactttgcaaaatgattcaacacttgttgtccagattagtgttggtctagaaatagaacactaacaataacagaaatgatctaattcaatcctcatacaagtacataaaatggtattattatcaccccctttacaaaaaaggaaactaagacagaagtcacatgatttatccaacaggacaaaagtagtaagtgtttgaatctaggtctgtctgagtacacatcctgaactcttaccagtacaaatattgcctcccatgaatagacactacttgaataataaagggataaagaaggagagtaatcttttaagagtaaacatacacacagacaaaattaacagttatgaccttgacatgcttatttcttgcccaattctacttaattgcttagactgcttagcacacaaattgagaaggcagtatcaaagttctaaacttgtgggaaaaaactgactccacacaaagttcttttcttcttgctaatactccatattacacgttcagatctccaaccaacatacttagtttcctgcagtcttatcttcaaaaagtgttttgaaatatgaattaatgaagctctttccttccccagcagaactgttctttcaaatacagaatattctgatgtgggagagaatagccaagcaaaactgaacttctgattatcttttacattataatcattgtagaactgaaaataaaccataccagatacttagttaaaatgctaagattgatccagtcctgcttgatgggaggacaacaaatcttctgccatttccccaaaaatataaagcttgacaaaactgaaaaacaacaacaactatttcagcactcagaaaaccaaccataggcttacaaaaatctgagatgtgattattcatggaactactgaattttgggtaaaacagcatgactctgtggatattttttccggaacatctgacaaccctccagatctatttatatggtagttcaatcaggagaaagcaggaggtgataactaaaaattctgctcatgttgctaaagaggagaaaacttgatttagtattgtcagttaaagtggcaatattagtggcacatgaacagggagtgccagcacctccactcgcctgaagtagtgagccttcttttggcaaggaacagattagcagtgcattaaactgaagatttggatccctgcaaaattcttttgttgaattacaaacccccaatgtgatgttattaagaggtggggcctttgggaggtaatctcattaataaagtttgttcctgtctttgttgacttcatgttactataaaagaatatctgagaatgagtaatttataaagaacagagatttatttcttatggttttggaggttgggaagcccaaggtcaagtgattggcatctggtaagggttttcttgctgcatcatcctatggcaaaaggtgaaagggcaagagagtgcaaggaaacaagcgagggccgaactcactattataacactctcatggtaactaatccactccaataacaacattaatccattcagggagacaaagccctcatgaactgatcacctcttattaggctcaacctcgcaatactgttgcattgggaaagaagtctctaacacatgaacttttagggatacattcaaatcacagcattctgccactagccttcaaaattcaagtccttctcacaatgcaaaacacattcattccatcccaatagccccaaagtcttaactcattccagcagcaactcaaaagtccaaagcctcatctcagtcagatatgggtgagactcaaggcatgatacatactgaggcaaattcctctccagctgtgagcctatgaaaacaacaagtactgcaaaaataaaatgagggtgaaggcataggacagacattctcatttccaaagagagagacaggaaagaagaaagcagtaagtagtctcacataggtctaaaacccaacaaggaaaacaacattaagtcttagttctgccaggatggatttgcatgctggtagctcgacagctctggattctcaaaggcagccccactaagaagccttcactaggaattaccctatggggactatcatcagtggccttgttcccatggctccactacgcactgccttggtggagactctctgtggcagctctacccctacagcaggttttttctgggacctccagggtgtccacaacatccactgcaatcgggttaaggatcaccttggccccaaatgtcttgcattctgtgcacctgcagaattagcaaagtttacaggttgtaccttcaggagtagtggcataatcagcacttgagcctgcttgagccatggctgaggtggacaagaaacaataaaccacaaacagatgagtagagtgccaaggcagcacagggcagtgaaggctgaagtctccctggcaccttgctagaaactttgccctcagagtcttagcttgcctcaaaggtctctaaaaggcctttggggtcatcttcccattgttttaacgaatagtaactggctcccttctatatacagtaatctctttagcaaacagttgcttggacacacccttggtttactctcctaaagatgcctttttcactctttacatggcctggctgcaaattttccagatttttaggttctatttctctttcaattataaattaaattatttatctcttctcacatcttactatatgtggttaaaaggccatgtagcaccttcaatattttgcatagaaatttattccaccacatacctagttcatcactcttaaattccgcctcttatgaagccctagggcatggacacaacttagctaagtcctttgctaatttataacaaggatagtctttacacatactaaaaccatagcagtgcccttataaaagaaaccacagtttttgcccattccaccatgtgaggttataccaaactttggcagtctgtaatccaagagggccttcaccagaaacaacaatgctggcaccctgatctcatacttctaacttccggaactatgagaaattgcattctgttattaaaaagccatccagtccatgatactttgatataatggcctgaactcagacaggcagacaagccagggatttagcaggtaattctgggaggtgattcatccatatggggatcaatgtgatcgctaattatcctgcattgactgaggttgataatatacacagcagagatcaaagtgagttatcagccacccatacttccttagccaacagaagtgagctcactcacagaagacacaccagtgaatccaatggaaaataagagccatgaaaaacttaacagcctgaacaatgaatgtaccctccatgatcaaacacagatccataagcagaaagaagaagcattgattcaaactatttgagcacaatctctgaactgactaaacacaaggctgtaagaaacagaagaaaaacccagaaagtcaagcctaaaataaaacaatttaaaaaataaaacagagacatcagtggctacatgtttgggtgacagacttagtctagacaattaccaaacacacaaacaaaaatcaacaataacaataaccccaaaggaagaaaaaagtaaaaaactgtaattgcttgctacaaaatactatcttagtccagtgttcaaacaaaaaattataagatataacaaacaagaaagcaacttattgacctgggaaaaagggagtcaatcgaaatacaagtcaagcagtcattataaatatttcaaagagctaaagaaattcaagtttaaaaaaactaaaggaaagtataacaacaataatccactaaatggaatatcaacagagacattatttaaaaaaaaaaacagaaattctggagttgaaaagtacagtaactgaaatgaataattcactagaggggctcaatagcagaactgagctgtcaaaataatcagtgaacttgaacacagatgtatagaaagtatcaattctgaagaggacaaaatgagtaaaaaagaaatgacataccctcacagaacataagtgttctggacacacaagtgtaccaatgtgcatataacagagtctcagaaggagaagaaaaaaagaggacaaaaatatttacagaaatatggccaaaaaattccaaatgtaatgaaaaacattaatctacacatccagtctcagcaaactccagataagataaattcaaagagactcatgccaaaagagagattattgacagaagcataagataagtgactcattccatacaagggaattacaactggattaacagctgatttctcattttttaaaaagtgaagacaagaagcaatggaatatgttagaagggctaaaagaaatgtcaactaagaatcctaaatccagcaaaactattttttaaaaataaaggagaaacaaagacattcacagattaaaagaaaagaaaaagcctgagagaatgtgttgctagaggacctaccttgtaagaaatactaagacaagtccttcattttgaaaggaaatgacattatgtgataactcaaatcaatcaagcaaaaagaaaaaaagaagaacactcaaaaagttaaatatgggggtaaacataaaagactctctaaagacactttttcacatttcttcccttagtttcttttaaagacatattataaaaagcaacaattacaacaacgtacaccaggtttaaatataccatatgtctatgtataccaacatataccaatgtaatctatatgaccataacagaacaaaaaagagaaggagaatatatattagaataatatttcaatattttaccacaattaaggtattattctgcagcagattataacaaagttgcaaattttaattcctagaaccacaaagaaataataataatgaatgaacagagaaatataaattgtaaactaaaaaatatttatttaacagaaaggcaataaagtagaaaccaagaaataaagatataagattgagaataaacagcaaaaaaggcagttataaattcaaccatgacaataatcatattacatgcaaatatactaaacacccaacttataaagcacctgcaataagtgacaaaattgacaaattgaacttaattaaaatgaaaaactttttcatttcaaaaaaacaatattaagctaatgaaaggacatgccaaaaagagggagaaattacttgaatatcatatatctgaaggacttgtactcagaatataaaaagaacacataaagctcaataagaagataacccaatttttaaattgtaagatttgaatacatgtttctccaaagaagatatacaaatggacaataaaataataaaaagatgctcaacagtattagtcattaagaacatgcaaatcaaacacacaatgagatatatttcataccaactaggatgacaataatcaaaaagataataagaagtgctagggaggatgtggaaaaatcaaaatcctcatatattgctactgagaatgtaaaatgatatagctattttggagaacagttggacattttcttaatatgttaaacacgaacttctcatataacccactcctagcaattccactcccagcaatccatccaagagaacagagaacatatgtccaaagatttgaatgcagattttcacagctacattactcataaggcagaaaagcaaacaatactcaaatgtccatcaactggtgaatgcgataaaaaaaatatggcacgtccatacaatggaatattttttagcagcaaaactcaaggaaatactgatacaacatgaatgtccctcaaaaacattatgcaatataaaagaggccagatggaaaatactctgtgtgtgtgtgtgtctgtgtgtgtgtgatttcatttatatgaaatgcccagaagaggcaaatatatgaagacagaaagccaatcaagaggagtagttataagaatagagactgggtacaaataggatcaaaagaattttagggggaggtgagtaatgttttacaactgaatcacagttatggttacacaactctataaatttactaaaaatcattcaacacttatgacagtgaattttacactatttaaattatacctcaataaatctgaaaaaagctaagtaaatgataatgacaataatgcacttgtattattactgcaacactgacttcaagtctagtgtcagagaatagcatcaaatcccctagtgactgacatgtttggtggcactgctgtcatcttaaattgtagaagaaaaaaattcctagctacctcaagcatataaatgcagtgcctattaaaagtctaccccccttttaagtcacactgtcattaaatctgcagcctatccttcctatgaaggtcactatttttatattattttcataaattaaaatcaaagctaaagttttatgacttaaaaagatactcaggtaaatgatacttaaaaatataattggcaataaaaacaaaatgaaaatttttctaatttcataaaacaacctctattatattttacaaacaattattgtgtgctaaaaattctggtgacgcatcaggtcacattctgtttaaaaaatatattttcttgacagaggtaggggaagatggcagagaggagacagggctaacaagcagctcccacttggatagacagaacagcacatggagactcacaccatgagcttttgctccaagaagcactgcagcaacataccagaaaaactgaaagaattcacagatcctttgaaacaaatggcacactgctgcagattccacgagacaggagaaaaactgtgagttcccaaagtgtgagagggggaaaacctgcctctgaacacatatccccactgaagaatgtgaaactccaggtaacaggagaaggatttaccttacgtaaagctgaaatgtattagggagccacacgaaatataaaagcagaagaagcagcaggaagagtcttgcaggcactcccagtctataacatgagcacagggaagcccaccttcatatatctcacaggggcccttagggaaagcagacagcgtacttagggaggcggtcacagggtgaacgaagcttcccactgaaatttgtaataattttgactgggcacaaatttacctcagcagaattcagggggcaaacgggaactgctacagacacaagcacaggagctgctgccaacaatgtgggcagacagggagggttgaggcctgaaagccatgcttgctttatcagactggggcaaggtctgagcggggtactatgggaacaagaccagcctccggaacttcatgggagctgggtgaggcctttcactactgattatcccccacttcactggtgaactatatgatacagcagaagcagccctaatcccctatggaaaataaccccactggcctgcaaaccaccccctccccatcctccacagcggccatggcaagctccaaccaacaagagtccgaggccagacccacctaagcacgcccctacctgatggtatttctttacccacaccagtagccaaacacaagagatgtaacttttgggagctttatggccccatcacctgagaagccagaatacttagcatatttaccttggccaacttagagcaagcttagatccccctactactgctacagctggcactttcttcaaagcaccacccaactcaggcaattacatcaactcatgacagaataaccctgctcccaagaatgagaaaacaacagctaatttcaccgtctgcaataccctgcctaaccaaaggtcctgagtctgtccacagaacaacttcattgctagcataatcagcattcaaaaaagccagtgcactaaacatatctataaccaaggactctcacatagtgtaaatcactcccctgccacctccagcacagcaggttgctggtacccatggctgggagacctgaagacggataacatcacagaactctctgcagacattccccagcaccagcccagagcctggtagccccactgggtggctagacccagaagagcagtaacagtcgctacagtctgactctcaggaagccccattcctaggaaaaaggggagagcacaacatcaaggggtcaccaagtgggacaaaagaatgtgaacagcacgccttgagttccaagcttttccactgaaagagtccagaaaagtaattctggtaatatgacaaaacagcattctataagatcataatgttcaccagcaatggatctaaaccaagaagaaatctctgcattgccacataaagaattcagaagaggccgggtacagtggctcatgcctgtaatcccagcactttaggaggccaaggcgggtggatcacctgaggtcaggagattgagaccagcctggccaacatggtagaactccatctctactaaaattataaaaattagccaggtgttgtggcacatgcctgtaatcccagctactcaggaggctgagacaggagaatcacttgaacccgggaggcgaaggttgcagtgagctgggttgtgccactgcactccagcctgggagacagagcaagactccatctcaaaaaaaaaaaaaaaaaaaaaaaaagaaaagaattcagaaggttgattattaagctactcaaggagacaccaaagaaaggtgaaaagcaacttaaataagttttttttaaaagtacagcatatagatgaaaaatgatccagagaaataggtacagaaaagaaaaaaaatcattaaaatgaagacttctggaaatgaaagacacacttagagaaacacaaaatctactagaaagtttcaaaaatagactagaacaagtagaagaaagaacttcagagcatgaagacaaggctttaaattaacccaaaagacaaagacaaaaaaaattttaagtgcagacagcctccaagaaatttgagattatgtaataacaagtcgtgagattaaaacagtaataaaaaattgccaacaaaaacaagtccaggagcagatggattcacagatgaattggtgttcctgaggaagaagagaaatctaaagtgtggaaaacttatttgaggaaaacttcgctagtctagctagagatctagacattcaaatacaataaactcaaagaacacatgggaaattcatcacaaaaagatcattgcctaagcacatagtcatcaggttatctaaagtcaagacaaaggaaagaatcttaagatctgtgagacaaaagcatcaggtaacctataagggaaatttcccctgtaagattaacagcagatttctcaccagaaaccttacaagccagaaaagactgaggtcctatctttagcctcttgaaacaaagtaattatcagccaagcattttgtatccaggaaaactaagcttcataaacgagagaaagataaagtctttttcaggcaaacaaatgctgagagaatacattactaccaagccagcactacaagaaatgctaaaagaagttctaaatcttgaaacaaaaccttgcaatacaccaaaaaagaacctccttaaagcatgaatctcacagagcctataaaataacacaatgaaaagaaaaacaaggtatttaggtaacaactaccatgataactacaacagtacatcacatctcaatactaacattgaatataaagggcctaaatgctccacttaaaatatgcagaattgccaggagcggtggctcacgtctgtaattccagcactttgggaggctgaggtgggcagatcacctgaggtcaggagtttgagaccaacctaaccaacatggagaaaccccgtctctactaaaaatacaaaattagtcgggtgtggtggtgcatgcctgtaatctgagctactcaggaggctgaagcaggagaatcgcttgatcctgggaggcggaagttgcagtgagcagagattgtgccattgcactccagcctgggcaagaagagctaaactccgtctcaaaaaaaaaaaaaaaaaaaaaaaaaaaagcagaatggcagaatgcataaaaatccactaaccaagtatctactgtcttcaagagactcactaacacataaggactcacataaggtaaaggagtggaaagatatttcacgcaaatggaaactaaaagcgagcaggaatagctattcttgtatcagacaaaacagattttaaagcaacgacaattaaaaaaaaagacaaagagggacattacataataaaagagtaagtccaacaagaaaataacacaattctaaatatatatggacctaacactggagctcccaagtttataaaacaattactactagacctaagaaatgagatagacagcaacacaataatagtgggggacttcaatactccactgacagcactagacaggtcatcaagacagcaaatcgacatagaaacaacgaacttaaactacaccttagaatggaaccaacatatttacagaaaattctacccaacaactgcagaatatacattcttttcatcagcacatggaacgttctgcaagagagaccatatgataggccacaaaacaagtctcaataaatacaacaaaatcaaaagtatatcaagtatcctctcagactacagtggaataaaactagaaattaactccaaaaggaacctttgaaacaatacaaatatatagaaattaaataatctgcttttgaatgatctttgggtcaaaaatgaaatcaagataaaaaaattaaaaattctttgaactgaataacagtgacaaaactcatcaaaatctgggatacagcaaaagtagtgctaagaggaaagttcatagtattaaatgcctacatcaaatagtctgaaagagcacaaatagacaatctaaggtcacacctcaaggaactggagaaacaagaacaaaccaaacccaaagccagcagaagaaaataaataacaaagatcagagcagaactaaatgaaattgaaacaaaaaaatgcaaaataaagtgaaacataaagctggttctttgaaaagataaacaaaatagatacaccagtaaaagattaaccaagaaaagaagagagaagatccaaataagctcaattagaaacaaaatgggtgatattacaactgataccacagaaatacaaaagatcattcaaggttactatgaacacctttatatacacgaactagaaaatctagagagacggaaaaatttctagaaatttacaactgtcccagattgaatcaggaagaaacagaaactctgaacagacaaataacaagcagtgagattaaaacagtaataaaaaaattgccaacaaaaaataagtccaggagcagatggattcacagctgaattctatcagccattcaaagaagaactgacgccacttagtgaaactattccaaaagatagaaaaagaagaaatcctccttaaataattatctgaagcctgtatcaccctaataccaaaaccagaaaaggacataacaagaaaagtgaactaaagaacatgttcctgatggacgtagatgcaaagatccttaacaaaatactagctaactgaatccaacagcatataaaaaagataatatatcacgatcaagtgggtttcaataaatgtgatatatcacataaacagaatttaaaacaacagtcatatgatcatctcaacaaatgcagtaaacacatttgacaagtccagcatccctttatgatgaaaaccctcagcaaaactgacatagaggtgacacacttcaaggaaataaaacccatctatgacaaatgtacagccaatattatactgaacagggaaaattggaaagaattatcccgagaaatggaacaagacaaggatgcccactttgaccactcctagtcaacatagtgctggaagtcctagccagagcaatcagacaaaaacgaaagaaataaggggcatctgaattggtaaagaggaagtcaaactctcaccattcactgataatatgatcatatacctagaaaaccctaaagactcatccaaaaagctcctagatttgataaatgaattcatttgataaatgaattcagtagtttcaggatacaaaacgaatgtacacaaagcagtagcactgctatacactaacaacgacgaagctgagaatcaaatcaagaactcaaatactttgacaacagctgcaaaataaataaaatacttaggaatatacctaaccaaggaggtgaaagatctctagaaggaaaactacaaaacactgctgaaataaatcaccaatgacacaaatagaaacacatcccatgctcatggatggggagaattcatattgtgaacatgagcatactgccaaaagcaatctacaaattcaatgcaattctcatcaaaataccaacatcatttttcacagatctagaaaaaacaatcctaaaattcataggggaccaataaagatcctacatagccaaaaaaagactaagcaaaaagaacaaatctagaggcatcatattacctgacttcaaattatactacaaagctatagttaccgaaacaacatggtactgctataaaaataggcacatagagcaatagaacagaacagagaactcagaaataaagccaaatatttagagccaactgatcttcgacaatacaaacaaaaacataaagtgaggaaaggacaccctattcaacaaatggtgctgggataactggcaagctacatgtagaagactgaagctggatcttcatctttcaccttatacaaaaatcaactcaagatggatcaaagacttaaatctaagacctgaaaacataaggattccagaaaataacattagacaaagtcttctagacattggcttagggaaagagttaatgaccaaaaacccaaaagcaaatgcaacaaaaataaagataaatagatgggacttaattaaaccaaaaagtttctgtacagcaaaagaaataatcagcagagtaaacaacccacagagtagaagaaaatagtcacaaactatgtatccaacaaaggactaatatcgagaatctacaatgaactcacaaaaatcagcaacaaaaaaagcaaacaatcccatcaaaaagtgggcaaaagacatgaatagacaattcccaaacgaagatgtacaaatggccaacgaacatatgaaaaaatgctcaacatcactaatgatcagggaaatgcaaatcaaaaccataatgagataccaccttactcctgtaagaatggccataatttaaaaaatcaaaaaataatagatgttggagtggatgtggtataaagggaacacttttacactgctggtgggaacataaactagtacaaccactatggaaaacagtgtggagattccttaaagaactacaagtagcaccatcatttgatccagcatcccactcctgggtatctacccagaggaaaataagtaattaaatgaaaaagatgcttgcacacgcatgtttatagcagcacgattcgcaactgcaaaaatatggaaccggcctaaatgcccatcaatcaatgagtggataaagaaaatatatgtatatactaaatggaatatataaatggaaacccaaatatcatatgttctcacttataagtgggagctatactatgaggacacaaaggcacaagaatgatataatggactttggggactcaggaagaagggatggaggcgggtaagggataaaagagtatacactgggtacagcatatgctgcatgggtgacggtgcaccagaatctcagaaatcaccactaaagaacttatccatgtaaccaaaaaccacctgttccccacaaactattgaaataaaaataaaatagatattttgtttcttactcatctttaatagctaaacatattaagtgcataatacatgtagcaacaatataaatacaatcaatgcctaataatcactacaaaaggtggttggccttataaagcatcaaaattgggtgaagtagattagccttgatttcctttcatcactaactcacacctgaatctggtaagtggtaagattttctttattcaattgagaagaagcagcacatcataagtaagtaggagagaatggtataagcaaagatgctccagagcaatggtaggaaaaaagtccttgaaacttaacagcaagttataggaaaaaagtccttgcaacttaatagcagggcattagttcataataattgagaacaacaagaataggtaacatctattatttaccatatgccacctaaaattctagacactttaccagtaacagtttatttactcattataataagttgatgaaacaaatactattattattctcatttaccaggtaaagaaactgaggcactgagaggtttagtaaattgccgaatttcatcaaatgaataagtaggtgagcgagaaatctaaccaaggagtcttcagtctagcttcacagactgttctcctgactactacattatattgtcgagatatttaaaatacgttgtcctcgttttagaaaaaaagaaaaagaaatatgaaattaaacactgaatgataaaagctgaactaattcattaacttgaacctaggtgttcaatttttaaacattttgacctaccttttcttcattgttccttccttccttcattcatttccctaatactaactggacaactagtatatgctagacccaagagacaataatacaaaatctctgaacacaaagaacttagacttcagcgaggccataaatgtgaaaaatattattatacagtgtaattgttgttgtaggagagatatatataaaggaagggtataagggacctgaccagacaaatatgatccagacatttccaacagcacagacaagaattagatcatctaggatggcttcagtgcctggtgtcataggaagaggtggctgggaggtgaggagaaaattctagcaaggaaacagcctgatccctgtcactttggcagtggtatggaggatgaatgaactgggggaagataaaggcaaatcttagtgctagaaacaggaaaggggcagaggacagaggaatttgattatattatggtaataatgaagatgaaagattaagacaatgaatgtaagagaaagaagaaagatgatgaaataagtaatgtcagttagctagcagttaaataactgtactattttaataaataaattgatgattacagaaaaaattaagcaataagaacatgctaactttctatcatgtatttttatcacgtacccacaggtaaagcaaagcatcactgctggtagcaactaactgaattatagacatagatttaaattatctacaatacactaaatctatatatgtaacatctatgtctaactgaagaaataaaaatcacaaaaacatacatttttaatttctccagatgggatgatttctaaataggagttatagaaaattccttcctttttaacaaacatataccatattctattttaaacttgtatgtatacattcatttagtcctcctcaaactcctatgaggtcaatactactatccctatgttacacaagagaaaatcaaggctctgagagttaagtaatgtgcaaagctaactagatggtacaatcagttctgctataatacttattctgaaatgcaaatgtgtcccaatccaactgatacattagggaacaatttgagcataactcagatttcattttgcttatgagtgacttcatccataagaaacatgaggtgactacagaaaactgaaccaagtcatacaggaggacaccaaaagcacacgctcagacattaaccagctatctcagttcaccatgtgagttgtgactgatacctattcagatctagtactacaacttttcttctgacttcagataatcctctttccatcacttcacaactcacaagctacaacctcttctgcttccacgagggaattcaggtctttttcaatataaagtgccaaatatattgcagtatttatttattaaccatttaacacttatgatattttttaaatgtgttactgagtttttgagtattgtgccataaccccattttcccgtaagtcctgtggttttcattgtgtaattctgaaatgcatgctgacttgtaggagcaaatatgttgcattttagcaggactgactctaagtagtggagttatattcaagtttgctgatttcagtgcccaggcttgtaagttacagtgttttcccatctttatttatgtatcatcccaaacttttagtacacaatatgtttttggacatcttaaatttccaattctcttttgtgtgaactgttgggattactaaacatattaatatacagtagttgtaacttgaaaaatattataacacatacctgtgacaaatatgcattggtatgaacaaacattgcctatacataagaataaccccatcataagttacaaattataaatactgtccaaagtggaaatgaactgtcactgtcaattttcactccaattatttctcataaatgccaacttgtagctatctatgacctactacagttgaaaggaaaatcataaccaaaaaaatgacagaataaggtttaataatttaggttaaaaactctgcataacacttttaaattcaggttccactatgtacagtctacagtagcaagttaataatggaaatggaatcccctactggaactactcaagactttacaacttttccattagttgatttactttacgaaatatcatcactgccaaatcattggagagaaaataaatttgtcagttgcaaaaaccatttaaaaattatctctccaatgcttaagtagaagaaaagctgaaatcacataaaatccatatttaggtagacacacttgaactcacatcaatgtctttaaatgtagtataaaccaggaatcaaagtaagaatatactaaggtagatgttatctggtcagtgctaagcaaagtctaaaaaatgttaacaatctggacaaaaaaactttaaaaaaaattccaaatatctctatgtttagtattaaatagctaaaatattagcatatctaagtaaaatttcccatccttattcagcgatactgagtgatggcttcagcatcacttcttggccttttggctaagatcaagtgagtgacagcttcagcacagtggttctaacactggctgaatgttaaaatcacctgaacaatttttttaaaaaaggtccaggctacatatcaggtaaattgaatctgaatatttgaaattggggccccagcatcaatgttttttttaagagctcctcagaatggttacaaatatgtacaactaaggttgagaactgttattctaaaataatcatgatttctttaatgaagcttattttttttactcatgattccaggagctactcataaatcaaaagaaccaattaggatataagaaaattatacattttaaattctaaaagttcaaagttttatttgttcctttttttactaaaaatagtagcattcagatatagcttaacatatgggtccctaaaaatattacttgggaaatttttgtcaagtcttaactgacatcagtcaaacatacatggaaatgtctgatgaaaaaatgaccattgttggaaatttctgttcttctagagctatcatacgaaatacacaaatatataaatacttaaagagtctactaaaacacagctgagtagagagacaacacaaaatgagatatttttctctaaacattcaatattgaatataaactaaattcagaatcaatattgaatataaagtaaactcagcatgggacaccatgccttatagttttcttctatctcagtggcagcattttctccatttctttggttggttctctttctgttcttgaaacattaccttgtgcctgaaggctcgattctcagaccaacttctacttctacttataatctttattctgcgttttttttttttttttttttaagatggagtctcactctgtcgcccaggctggagtgcagtggcacaatctcggctcactgcaacctccgcctgccatgttcaagcaattttcctgcctcagcttcccaagtagctgggactacaggcgtgcgccaccatgcccggctagttttttgtatttttagtagagacaggtttcaccaccctgggcaggctggtctcgaactcctgacctcgtgatccacctgcctcggcctcccaaagtgctgggattacaggcgtgagccaccgcacccagccatctttatactgctttcaaagcattcaatgagagaaataaccagaaaacaaaaaagttaacttcttgaaatccaaagaaaaagatgtttcatacatatttctccaactatagcctttatggctatttacaggacaaaatttttgaaaaattttgaaaagagaaaagtgggtatgcagatagtaaactaaatgagttcaaactaaactcttaataaattttagtacttataaaaagctttattttttcatctagtatttttaattcagtgttgggaaaaaactattctaattggctaatttctacaaacactattctaaatctattttcaaatatcctctgttaagcaagtttcaaaaagattgaaagcccatataccaccatatatagcactcatattgacaaaagtatttcagattatctgtaattaagattgctcatatcaaactgatattcttagaaatatgtagccatttaagactatcacacaaagactagattataatggagtgaagctgggcaaagaaatgcttaaatcaggcccttagaaacagaaagttaactgtactcactttaaaacaagttaaaagtgtttaaccttcctccaacactgggcattaaatcttacaggtaattaattatgacgtaaaaatgtaattctaattcataattgtaactgttttctaaatcaaagtatttttaaaattaacatcaatttatatcaagtttctcttttctaggcaagtattgtctaccaataggctagctaagttagcccagtgataaaggcccttagcattaaaacagttcagtctttcctttctgaaatccttcttcatttggttgctgggacaccatgctctactggttttcttctatctcaacagcagcatcttctcagtttctttggttggttctctttctgttcttgtaacattaacttgttcctgagggctcaattctcagatcaacttctcttctatatctacatatactttctaggtgacctcatctagtcccaaatctttaaataccatctataagccgattcccaaacttctatgctaacttttccccagaattctggactctctgatcccactgctaacttggtatcataaacagaacacacccaaaattaagaagaaaatcttaattttcttctccaaaagtagttcctcactatctcattggcaccaccattcccaattcttaagcccaaaggccttaaaatcatctccaacattttgctttttcttgtgcaccacatcagatctattagcaaatcttgcgagctacctttagaatatttatttccacaatgcaatcaattttcacatctccaactgctaatgccttaagcgaagctgctatcatctctagcctgggcagttctagtagacgtctatctggttgtctgctttcacctctgtcccacctgatgtgtttcctccacaaagcagctagaggaatccttttatttttatttttgagacacagtctcattctcttgcccaggctagagtgcagtagtcctatctcagctcactgcaacctgtgcctcccgggttcaagtgattctcgtgcctcagcctcccgagtaactagactacaggtgtgcaacaccacgcccggctaatttttgttatttttcggagagacgggttttcaccatgttggccaggctggtctcaaactcctgacctcaagtgatccactcgtctcagcctcccaaagtgctgggattacaggcatgagccaccacacccagctcctagagtaatccttttaaatttaatcatatgctctcctaatcaaaatcctttaagtaaaaaaatatatatacatttaaataaaatcacaactcctgatcatgccctacaaggtctggcttctttgccctcatctatatataccttctacccttaccaaatagcctttgtgatgttcctcaaacacaccaaatacattcctccctaaacatctttacatttgctattctctcacacaggaagagcaatatagcagtatctagggcattctggcataatggcattcagatcttagctcaaatatcacctttcagattggcctttcttggtcatcatattgaaaatatcagcttctatcatattccatccccttatcctgctttatttttcttcctaggacttaccactatcagacataatatcatgtatctgtttgttgtctacttctgccattagaatgtaagctttatgaagacagaaccttcatcttcttcactagtgtagccctagtggccagaacaatgccttaggcatgataggcacacaataatgttagttgaataaattagtcccttaatagggacaacaataattaatcacttaataggaacaacaagtagatatcagaatatatgtctcatgtttgtgaaacaactctcaataataaagtaaaattaataaggcaacaaggaaaagaaactgatgactcaacctgcataggaactataatacattattaaaaattaaatgaaaaatgtgcatatttgtgttaacaaagataggtcaaaagataatgttggctgggcacagtggcccacacctgtaatcccaacacttagggagcccgaggctgatggatcacttgaggtcaggagttcgagaccagcctggccaacatggtgaaaccctgcctctaccaaaaatacaaaagtagccagtagtggtggcacatgcctgtaggttggaatttgggcaagataaaaaatcagagcttaggccgggcacggtggctcacgcctgtaatcccagcactttgggaggctgaggcgggtggatcagttaaggtcaggagttcgaaaccagcctaaccaacatggtgaaaccctgtctctactaaaaatgcaaaaaaattagccaggcgtgctagtgcatgcctgtagacccagctactcgggaggctgaggcaggagaatcgcttgaacccgggaggcggaggttccagtgagctgagatcacgccactgcactacagcctgggcaacagagcaagactctgtctcaagaaaaaaaaaaaaaaaagcgcttagtcctcctatgttagaactaatttcaaataaagaaaatcccaaaggtcaatcaatacttttggttttgcctacttagcttaaaacacaagtagcttgaaatccatatagtcaattaattcacatattatttacttcacacctactatataggaaggattctaggaagtgtttgaaacgaaacaattggaggatgatgcttagtcaatgtctgttcaatgaagaaatgactgaacaattaaaaaaaagaagaagaagaaaacttccaagaatggcatcaaggctaagaaaggtatcttatgccagtgttgtggctcagaaaataacagacctcctcccaagaatctcatcaaataatcaagaccaattaaccactagagaagagagaaaacttcagtgagtagtcaccatgctcacatagacttttcatctattgtgagagcagcttctagagattacctgagggaatttatgtgcataataggacaacttttgttcacagtgaagttgtgcttctcaccttcctgctccttgactccagttcagaggaacttagtcccaggccattgttcttcaggctcattcatatcccctaaaaatcatttactcctacatcctgccctgcacccatcaaccctatccccaatgaggaagaatatgtagcatctaaacctcattgggttattgggtaatcattctcttgcaattcccctgtgttatacctgttaaataaacgtgtatgccctttcccctattaatctgccttttgtcagttcattttcagagaaccttcagagggcaaaggggaagctctcccttggcctctgtacctacgtgcctgataatatggacagtcagtacatgacttccgtggagaaggtagtgtttgatctgcaatttggagtgaaactctgttcatcttagaaggaaaaaagttaggtttgaaaaaaatggcacaacaaaattagtgtgaaacaaaaaatgcatcttactgggctcattagaatgtgtgattaagatagctctaacttcctatttcaaatatatatgttgaaccataaatattctcataaaatattaagtagactttgcttcataaccaattaattgagaatgttgttttacaatgaattgtaacgaagttcaaagctcttaccacttgccacatgacagccaagatgtcaagaggcaaggaaagtgacttctatttggagagccagcataccaagaagatggtgaactagtgtcctaaagaaccatcttaagttaatatgaattttaggctccttttatgtgggggaaagggagatgagggaaggggctgatgtgggcagcagtgacggtcaaagaagactgaaacttctttgtccttggtcaggtcacaatgcttcaacaaatcttttaacactacattgttacttctgtgtaaaccctccttatctcctcaggagttagtttcaaggaagggactattatcatccttgctttaaactataagctaaattcctcccatagttagcttggcctatgtacaaagataagcaaaagcagctaacctaaaagagagcatgaaggatggggagttaggaacaaaaatggagttagtcatgctacgcctccttttcactgttacataattatagataaataaggggaaaaggactaaggggcaagactgagattccagggtcactgtactcaggaaaacccccacatattagggcaatggagctaacttgaagctactatgaagcattctgttgaagaaaccagtaaaagttcacttatatataaatgataggccaatctacccaaaaatgggcaaatttatatttttgaactataccttacagcaaataattcatctaacgttcaaattcaaggacaataaagccaaactcattacctcttagagtaaataatatgtttataatttctcaacatgacccatctatgttctaggggatttaaaaaagaagaagaaaaaagaaaatagcttgtcacaaaaaaacagccaatggaagattctatggccaataattatgctaccaagctacacgatgcttaaaaacattttaagcatgagcataagctcattttgcatatgtaacttgtttctctcagtgtctgagactatcagaaacaaagaaacccacatcctaagccacagaatacagccacctggttttactcttatcacaggatgacaaaaatgctttcagtctcctaaggtcatgcagatatcctcaacatttgtatagtgttttttaactaacaaaactgttgcatccttcctgagttctagagtggtcaaaagatacaatgcaaacacttcttacgataacctttgctgtcacatttaaaggcataggctcaatgactaacataaatttcaaaatgctagctcccttttctttcccttttctgttctgatactaatataataatatatattttctgttctaatactaatataattaatataatttcaataaatttctggaatctttgtttataaaaatgttaaatcagtgtcagctttgcagaattcatctgttaacccaaagaaacataaataagtttatgagtataacaagaaatgagttttttaaaatgtccccattctatatttttaaaacccttggttttctcttaatatatatatatattttagaatgatgaagtttttgatttttttatcagaacactttttacaataacttccaaagctagtgtgaaatatttgttgacacatagacatttaatgaagtaattccatgatttagtaccataatttttatggttttagtgaaaaaaaagtgagacttggataatctagttgaaatcaagacacatgtgtaaagaacttaacagaaactaccacctatacttgatctgttgatttgatcagagaacattaataagttaaaggaatgcaacttccaataattttccatgaaaatgcaatcatctggcaaaaatattatttatttctgttaaaacactggtgaaatcttcccatcctttttttaacttcacaaatgtattcaacttcatggactatgtttatatacaacatcgtagaaaagagtttcaataatctcataataattggagaggcttaacaagcaacatatgattaagaaaaatggttatcaatttttatattttgaaacattctttttaaaaacagtatttaagaaccaacctccaaaaatcaatatattatttaacatttcatttataatgtatcatcagatcatacatttataatgtatgacaagaccagtcattctcaacttggctgcacattagactcacctacagatttgaaagacgtaccaatgccaagaactccaaccccaagagattctgatttaattggtctgggtagaaaccacatacatatatgtatatatatgatgcctatgttttatatatataaatatatatatacatatgtatttctttttgagatggagtctcactgtgtcacccaggctggagtgcagtggcactatctcagctcactgcaacctccagctcccgggttgaagctattctcctgcctcagcctcctgagcagctgggattacaggcgcgcaccaccatgcccggctaatttttgtatttttagtagagacagggtttcaccatgttggtaaggctggtctcaaactcctgacctcgtgatccgcctgcctcggcctcccaagtgctgggattacaggagtgagccaccgcacccggccagcattatatttttaaaaagctttttaggtaattttaatgtgtagccaaggatgagaatcgttatagatcatgatcagcattctaaaaactatatatctaaacttataatttctgtaattatagtaattattaataatacgtaattataactcctcaacatgacccatccatgctctaggggatttaaaaaagaatcacatttataatttatttataaattattataatttataattaatatatttatatactaatatatattatataattattttataaattcaacccctaacagagtcacttcttccctgactctgatctacaatcatttaattggtctgggtagaaaccatagagatagatagatagatagatagatagatagatagatagatagataatgcctatattttatatatataaatatacatatatatatatatatatatatatttttttttttttttttttgagatggagtctcactatgtcacccaagctggaatgtagtggcactatctcggctcactgcaactgaaatagggtaatgttcaacttgataaactgtagtgtccagaaggaagcatacctacgactggcaataaaagtaaatcttgggccctagaagaaggaacactagttcacagccacgttctaagttctgggttgactccaccaacctcaaaacatctgaactctacacaggataacactcttctagatcagacatttttggaatcctgctaaggaagggatgacttggggatacctttgatttggggtgagacatacccagccacttccttgtatggttatcgctagctgtcagagtataggaatggcttccagaaatattcctattgcccaccctactcactcacctattttatactatgatggtgcagaaccagaggtcatatcctgatatgaacacattctatagcatctgttaccaagaatatgtaggtaatgggaaaacaagacactccactactactagtcaccctgaggtaggtggtccttgctggtcagtggggctatctcatcagaaagtgtggttacaagatcaaaaaaatcagagcaaaaggactcaaatccaatggcaaggaagacacatttcaatttgactgagtgttcatcactgctgcattctaaaatccataatgtagtatgtcaggatgacctatgcagttgtgttagaatccagtccctacattcccattctctcctccccactgaaggggatgaccaagatgttcagttctccagtcacctttcttcgtaggttgtcaagcctctgctcttcaagcacaatatcctattgaactgaccagatttgatcaagctgtacttaacttactgtcaatgcagcagacccattttccaatgatgcaatatgggattcaatgacattgattccacctctacagaggtgaaagattgttactgggcacacctgaacgtaactggctcaaattacttatcatgaagtcactattcgaaattacttaattggctgcctaattaggcctctaggcttcaaaatcaattagcatgatcagttatctcaggcacagatcaaaatagtcatcccagagaaagggtttacggagagacaggttgtcatccttggatctagagccatcaatagcctcacccaatatctaaacatcaagctttcttcagtcatggaggccagcaagaaccatgtagattcacccataactcacaattcatctacatagtttctgaacagtcagagatcctgttttaaataaattataaatgtgtacttgctacacaactctatcataaatttctcatgtttaaagtgttcaaattcctttctttgtttagctactacaacaagatccacgtttagttagcttctccttattacttttttggtttgttggttgttcttgctctttattttgtttccaaaatgtaaaagtaaaatattaataaattacagttcagttatgtcaggaatttttcaaaaacaattattggtctgagcttttttcttgaagaccagaagtcacagttaaaacacacccacacctacatatacccaaataacacaacatagtccacaatcccaaaaattaatgcgagttataaactaacaaaaatctgggttcaaataattaatttatggtacagtcatcagagaaataaaatagaactttaaaatagtattgcaaagtaggtaccagaagaactaatataaagcatagcatgtacctctcaaatggttaaagccaaggtcattaacaaggataccgaaatgtttctcttaaatagccatttggcaggctaagactcacattcaagttcttgtcaaagaaatacaaactcactaaaatgttgtttattttgaaaaattgttaatatgaggcaggtcttcaaacaaggcagttaaagtttctggaatattaaaagggacttacaaaaagatctacagcaagtattcacagtagtcgtataacagtagtgcttcaatgtagaggacaaaataaatgcatgaccaaatgttttcttgaaaatcagtctaaaattagatgaccaaagacgtaagtactacatccacagtcaagatataaagagattttccatagaaatgaatgagcacgacacacacagattctgcaagcatagcaaaacctgaaactaaaaatattgttttagctgggaaaaacattttttatatataagtgaattacggtgagtttccaaaaggcctgaaatgcatactgaattgaaacaaaaaaaaaatccataaaatttgtaaatttaagtgaggaaggtagagtaaaaaagtaaagtacaaaggaaaaaaattaatgaacacagtaaaactactcatagacacaaaagaaatacaatatgtaggcaatacaaaaatttgttatacaagaaaaaatatggatacccaaagtttccattctaggtcttgatatgaatctccccctataaaatcctttaactacaccacaaaattttcctgcctctgaaacaggtaattgataagtttgaatgttccctccaaatttcatgttgagataaaatctgcagtgttggagtgtgggcctagtgggaggtgtttgggtcatgggggcggatccctcatggcttagtgctgtccttgaaatagtgagttcattctcaggagctctggttgtttaagtgtgttcccccaacactctctcttgcttctgctcattccatgagacacctgctccccctttaccttctgccatgatttgtaagctttctgaggtttccccagaagcagatgccagcaccatgcttcctgtacagcctgtagaactgtgagtccattaaacctcttttcttataaattacccagtctcaggtatttctttatagcaacacaagaacagactaacacagtaatgtttatctgatgaactcttgtgtccagaaggaagcattacctgggcctgactataaaggtgactcctgagccccaaaagaatagttcacagccacattataaactttcaattgactgcacctacctcaggagatctgatctctacgtagggcaatacttttctataacagaagtctcttgagagtatggacactagaaaaatatctctactctctgaactcttattgcattttctcttctctacaacaaattgtgtgagactctcataaactgcatttttttcaaaagcacttttggaagtaccattactgctaaaggccactgtacatgaagtcagagctccttgaaggcatgaatagtgtcttatttgactttgaccctccctccataccgtaaagctgctgaccactcaacacacacacaaagcctgtcttggtgctttaatcacaactgacacccaataaacatttgattaataaagacctactatattattcttctctcgaattttttcagcatcacacaagtagacattttattttatatggcttaatttaaacactattttacacactatttctgtactatttaattcaaatgtctttatcactcaacaaaacagtaaaaccaggagatgaaggatgatgcctgttgttttgtatcttaggcagtgtcttaaatgtaacacgtactaaataaagacaatgacaaccacagcattccaacaaatacataggaatgtgtataactcttcagaacatgtttaaaaaaaaacaaaaacaaaaacatggaactgacaaaggtaatgccacagtttgctttcaagggtatggatatttttcacattccccaacctgacaggcaggtctttgccccatagatttaccaatgatcatataattgccagattaattcagtgttatatgacttgctacaaattaatgagactcattaaaaaaagaagaagaagaagaagaaagagccaggtgtagtgcttgtaatcccagtgactcagtaggacaaggcagggaggattgcttgagggcaggagtttgaggcaggcctgggcaacatagcaagatcccttctctacaaaaataaaaactcttagccagctggggtggtgtgcacctatagtcccagctactcaggagactgaggcaggaggaatacttaagcccagaggtttgaggctccagtgagccaagatcatgccactgcattccagcctgggcaacagtgcaaaacctcaactctaaaacaaaaaccaaaacattatatacaaattaaagataattagactcaacaaatgggtataaaactccctatttaaggccatgtgctaacagctgaggatataaaggtaagaggcggtacctaaccttaaagtgtttacaacgctatgagatgtcttctccaggtagttcaagggagacagccaagaagagacttcaagtcccttaaaatgctcattcttttctaagagtaacgatgcttgttcatagtgatagataatatataaattattttcatgataagaataatgaactgtctataatcaatgaagatcaaatgggggaaaatgacttcaaatataaggagaaacttcacttaaatataagattatttgatcactcaagaagttaaagactagagtatattccaaagactgtctgcatccctggagatctgtagggtgtgaagtgacaattattttcttgttttgatagagcacaagaacaactgatgttcaaagatcttttgctggcctatgaaattacagaacaacatatatattgcaagagaagtggggagattacatatctaaaacattagtgagcaatatggaattcttgagcactagtttctgtatttccagactttctaggtgaactgcagataactggaaacaacttaaaaagctttgcattgcattactaatgactcaaagtaataatgtcatgaaagacaaagctcaagttggtacaattcatttcactgctaattgcattgttaattgtgattatcaaaagaaatgcactacaataccgcacttaacttagcatttaggtaatttactgttacctaaatctggccaagaatacagccagttaaaataatcttctatctaatatagtacataagtattacatatgtaaagtagtgagcataatcaactgccagtaaatacattaactttctatttttaaaaaaacttacgtaaaagctggattattggctatgtcaattggaaatcattcttttccaaataacagtaagcttaaccaacagcagcttaaatatgtaggtagttatttttctcaattaaaatgactgtcagtaggtggttgctaggatgggtttagctgctcattgctataaccaaggaccactatctttttaccttacagccctgcttttcatgtttatacttgttaccttgttgtcagaggatcactgccatacttttcaactcaaatcaacattaaatcagaaagaaaagggtgatgcaccaccacttgtcacttttataaaaaaaaaaaaaaagcaagaggtcctcagcatgcatttaattacttacctttaaccagaagaactctgtcacatacctacccctaattattagggagatttaaaaagtaaatagttgatccttattatttgcaatcccgtatttgtgaatcagcctactcaccaaaatttacttgtaaccccaaaatcagtacttgctgtgttttcatgatcattaacaaacatgtagagcagtgaaaaatctgagtagctgatacacatattcccagctaaggtctaacagggagacactctgccttcttgtttcagctctcacacagagatgcccaccagaggacagagctgtggggggcagtgcagtgtagttcaagtagctccagctctagaaccagctgaacgagtttgaatcccaaatctgggacctattcatggggcatcaaaaagtcagttaacactctgaacctcagtttctcttttgttaaataaagagagactctaccaggatgagtagttttcaggattaagattatatagcctacatgaaatgtgtgggtgtatgtgtgtttgttcatattttccttaggagcaatagttgagaatttgctaattcagtcatcatggtgactttacagaatctaactaccaagaattacaaaaattgactgtatttagcttttccagtctcctttatacaggtagacaggagaggtgttagggaatgagtgcttcgttagtcaacctacaagtgtctgcctcactgatgactcaccagtgttttaaggtgggtttttccgcctttgttttttgcttggcctaagcctcagtacttctcaaagtttccacaaaagttcccctaaggtcagagaagacaaccatgtataccagaaagtctgaggagtgtttcacaaagcagcttgctataaataggtatttctttgtgaacttatattttgtcataaaaattcatcccacttttttcatattttaaaaagtatagtaaaatttttcggaagttctgcttctacttcaggatgtagagatccacaataactgttctctcataccaaacaaaagtttaagccaccagagaagaagcatgaaactttgggtcaagactttagcagaagtcatctaaagcccaagaccccaaagatacaaggcaaagtttgattgcataggagggtaaggcacatacacagagaaggtcacacccccaaggcacatgtatgcagggcccacctaagattaaggttgagaactaagaaatttccattctgtccccactgcaaggctcacatccaataacaaggaacagcagtttactgctaggggaagagcaagagcacagagagaaattccctgtctgtggtgcaaccctacaggcactgatgaaagctatcctaaaagagctggaacactgagaaaaaccaccagtaccagagagcccatactaagcacaaggtaacattattttctactggagaagactgaagcctggtgtactaaaaatgaatgtagcaacaccaaaatccaaaatagctcaactactgattgactctaccactcagttagcagaagaaatgtgcctatttccaggagtaaacactctttagcacaatctatactgttcatttaaaagcattatccagcatttccaaataaaaaattatgaaacgcaaaaatacaaccattaccaaaagataaagttatcaacaaatctagtatcagagataatccagatgttggaaatattgtataaatgctttaaattaactagtattaatatgttaaaggtcctagtggaaaaaggcccaatatgcagagaagaaggattgcaaatgagaaacaaaacatacaaaaaatatcaaatgaaagcgctaagaataaaaaacagaatatcagagataaattcattagatgaccttattaacggtaaggacatagctaaaggaagaatccaaaaacataaagacaagtgaacaaaagtgatctaaaccgataaacaaaggggaaaaaaaagactgaaagaaagggaacagagaacacaagagctgtgagaaaatactaaatgatctaacataggtaaaactgtaatcccagaaagagaagaaataagatgcatattggaggaaaatatatgtaaaacacatacctgataaaagacgtgtatctagactaaataaataaatctagactaaataatgaaatgtaggccaggcacagtggctcacgcctgcaatcctagcactttgggaagccaaggcaggagaatcacttgagcccaggaattcaagaccagccaaggtaacacagggagatgtcatctctacaaaaaatttaaaaattagctggaggtggtggcacacgcttgtggtcccagctacttaagaagctgaggtgacaagatggcttgcatctgggagcttatggctgcagtgagcgtgattgcactgctgtacttcagcctgggtgacatagtgagactctgtctcaaaaagcagggagagggccaggtgcgatggctcacacctgtaatcctagcactttaggaggccaaggcgggaggatcacgaggtcaggagattaagaccatcctggctaacacagtgaaaccccgtctctactaaaaaatacaaaaaattaggcatagtggcaggtggctatagtcccagctactcgggaggctgaggcaggagaatggcgtgaacccaggaggcagagcttgcagtgagcagagattgggccactgcactccagcctgggcgacagagcaagactccatccaaaaaaaaaaaaaaaaaaagaggggagagaaaaggagggagaaaaagtagagaaaagagaagagtaatatcacgactcagtaaaaggataaaacaaaaagcaaaatccccaaaaataaaaactgagtttaggatttgaataaacacttcaaaaatgaagatatctgaatggctaagagggacatgaaaagatgtccaacatgattagtcattagggaatgcaaattaaaacaacacttacacaccattacatacccactagaatggctaaaagttaaaagactgacaagagcaagtgttgacgaagatatgagtaactagaactctcatgcattgcttgcagggaagtaaagttgtaccccactttggaaaacactttggcagttttttaaacagtaaacatacactacatgaccaagcaattccaattccactcttatacatatacacccaataaagtaatcaaataattttttaataaaaagccttaactttgaattgccaggagcacattaagatctctgaaaagacacaatcttgtaatataagagtgctcctgggtaggattcctcaaatgggctaagggcttaatggacagaagtgtaggtactataaaagctagccaaagtcattggtttcctctcactttaacctaatgcatggcaagaacaaagaggaaaagaagtgatagcaaccggaagaatgctttccaagtataccaaagtctgatggtctcctggaatttctcttggaactttacacctggctccactgctctgaatgggcttactaaatgataactaagcacttatctttcctgtgaagttgctagaattctaatccctatgtgagagattaagatgaagtcatattaagaaacctttttgaagtaatttttggtagtaaggccaattgaaggccaatttttctcaacctttttctgtctttgcttatgtgttatgttttctgcttcataattaatgttttgatcatctgtatcttttgatcaaactcaacattttttatcttaggaatttcactcaatgaaaacttctaggacacaagacacttgtgattttggctgtttttttttttctagctggaataaggaaaatttagaggatgaaaaacattgagagaaatatttacttaactttgatgaaacacagcaatatcttcactcaagttttgactccgatactggcaaaagaagttcacttctttattttcatttattttttttttttagacagagtttcactctagctgcccaggctggagtgtaatggctctatcttggctcactgcaacctccgcctctcaggttcaagtgattctcctgcctcaacctcccgagtagctgggattatgggaatgtgctaccatgtctggctaattttgtatttttagtagagacggggtttctctatgttggtcaggctggtctcgaacttccgacctcaggtgatccacccacctcggcctcccaaagtgctgggattacaggtgtgagccaccgcgcctggcaaagttcacttcttacatcatatgaaagtgtacctctcaccaaagaatcaattatgctcttttccttttagtttgtttggaaaactgtttacctgtgttcttcagggcactactgctttctaggaatctcacaatttatgctaggatacagtaacgggctaaatatctgttatccaaaatgcttgggatcggaagtgtttaggatttcaaattttctcgaattttggaatatttgcattacactggttcagcatccctaatccaaaaatgcaaaacccaaaatggtccaatgagcatttccttgagtgtcacattggcactcatgtctccccaaaatgtataaaagtaagctgtatcccgaccaccttgggcacatgttctcaggacctcctgaggctatgtcacaggtacatccttaaccctggcaaaatacactttctaaaatgactgagacctgtctcagatatttggggatcacacagtaaatcagtaagacctaaggtaaaatcctggctgcatctgtttttaaattacttataaaccctgagcctaaatctctaattccatgaagctcaggtaaatctgggccagagaaagttggattctggttgtttccaggtaaagtgaacactgtgagcaatgggaggtaagtatacacgcacctggcatagtatgggaaagaaaagcgttttgctaccagagctaagagcaaaagagaaagcttagcttaaactgttaagggccttcaatgccattcaatgtcataaagagacttaaattttttcaaaaaatcagccaggaagttgtcaaaaactgatcagattctgctgatctggtgctgaagaaacacaactggactcgttaattccagtggcactgttgaactttgaatgaatgactgattttaatgtagtgatgagtatgaagtctgattgtaatggatcagagaattttaaaaagggtgataaaggagcatacaattagagtccacatattcttctttataactacaaaaacattcataaaattttagagctgaaatctagcccaactcattcatttacagatgagggaaaatattaagccaaaattagtggtataatttggtctcacataaactccatggctgattttttactactcaaatgcattcttattttcagattcaacaactctgctgctgttacacataatgcaaaccaattcttctggggaaataaaaatcattctaaattattaaaattattctaaattatgaggaatattaaatttatacttaaaattgtaaaaaaggctcccagacaaaataatcatttgctatgatccaactgtatgcagcactagatgctacattattccaaatcagaattattcattaaaaaagcatttattatgtttattgtaagaactatccaaaatattgcttgaacataaaaaaaatgtttttatatgttcaggtcctattgtaaacttgcttccaatttaatatcagagtttagagtcttttaaaagcattttgtataaaaatatccaatcaaattatctggagaaatttgtggaaaagctcttcagattattctgcaatagctccttgatgagcaacgttaataaatctaagagcttttttctgtaaaatgtagttttattattttctaggcagaacagtaatatgtttaaaatctctaagattcatcctatgatttcaaggacaatagtcaaagtatatgaatataaaatcagttaagaggataaactgcttgcaatgtcatttttttaacttacaaagttaaggttcaaaccagtatataaagaagatgctaaataaaattatttacttttgagtctggcagctcaaaatagatccacagggcacagccccagggggtgggaatggtcacacattaagtcagactcctggagcttgccttcatacttcccacttctctctttcaacacagaaagttaatagttgcctcactttgatttaggacaggctatgatttaaaaaagaactcttcgtagacttctaggtaagaaaatttacctcttaaaagtgcaaactatcaatatttgtaatagttacagagatgttattatcgttcctagggctgacagaacaagaaaaaatcatttctgaataattctataggcattgttctacactggctgcaaatgagtcttgctgaattaaagacaattaaaaactttgagcagtactttgtgtttcctcaattttttctggattaaaacaaacagtaacatgaaattttcctcagtctacaaataaagagcatatccccacactcctttctacagaaaaacctctctgccctctccagccaaataaaatgtttatgttcattgactgttgaatacatccgcaaatcccctgtagctgaaatcagttcagcgaaattctgtttaagggaattaaagcccatctgtgtagtttatcataatctttaaaaggtgtgttagtttatcatcactgaaataaaaatgactaccaagggtgtttaggttcattttctttttttctttttctttttatttaaaattctgaatctggtagagttccttgaatttgtgttcagaatgtgaatatggcaattggcttttacttaacttggatcctacaattacttttacttccataggtcctaacgtttctccacagctgtcatttctaactattaacataagaatgctagcataatttctctctgttttcttttccaaaatgcaatggaatgtcatataacttaattctgtgatatcataagcccaatattcatgacaataattttaaaatcaagacacttccttgaggaatatagaaagaacatggaatctagagccaaacaaacgtcttagtgatatcaaaatgctatgatacaggcaagtcaagtaagctctctgagacagtaacattcccttatcatattggcagtggaatcaaaaggacatactggttctataaatagcaaaatgttataagcatgttagctactggtgtattttaatttctactaactgtccaaatttctgaaatgtattcattttttgtatctatattagttttgagcatgagcattaagatgatgaaaacaaatttttatttgatctcagggcactaatttatcagaagatacataaaatcaaagaaaaaagcaatctgtcatattattttctaaaatgaataccttatttaacattataaattgtgcataaatttgtacattcagttttgttgtttctgtgttttacaacataaacaaggcaaaaatactcttaagaaatatttgctagaaataaaggcaataccaacactgaataaatataaacaaatatggtaagtacacctacacagaaatcagtacatgctatttttaatcaaaacccaaaaccaccatggtattttcatgccttataactgaagaggacctttcaaaccagtgtccccaaattgaacagtgagtcacttcaagactgataaaagtaagattatgatcttatgtaatatcaacacctagctgtcataaaatgcagacgactatttgaaatcattcccttctggtaaggcattaacaaaaattccacttgcttttttttttttttttttttttttgacagactcttgctctgtcacccaggctggagtgcagtggtgtgatctcggctcactgcaacctctgccacccaggttcaagcgattctcctgcctcagcctcctaagtagctgggactaaaggcatgcaacaccacgcccagctaatttttgtattttaagtacagacagggtttcaccatggtggcctggctggtcttgaactcctgacctcgtgatcaggctgcctcggcctcccaaagtgctgggattacatgcgtgagccaccacacctggcctccactcactttttaaaaagtgatggcattccaatggaatatggtcatttatttatctttttttttttttctttttgagacagagtctcactctgtcgccaggctggagtgcagtggcgcgatctcagctcactgcaacttccatctcctgggttcaagcgattctcctccctcagcctccagagtagctgggactataggctcacgctaccacgcccagctaatttttgtacttttagtagagatggggtttcaccatgttggccagaatggtctcgatctctggacctcatgatccgcccccctcggcctcccaaagtgctgggattacaggcatgagccactgtgcccagccctattttatcttcatagtctataaaatattatccttacattatcctctatttatctctaacaatcctgaccatctcagagcgtaaactctttgaatccagggaatgcggcttgatttatgattaaataggaacacagttgatgatttatgattaaatagaaacccaatatgcctgaaaacaggaaaaaaaaagtctgaaaataaatccttaaagatagatatatttttttttttttttttgaaatggagtctgctctgttgcccaggctggagtgcagtggcttgatctcagctcgctacaacctctgcctcccaggttcaagtgattctcctgtctcagcctcccaagtagctgggactacaggtgcgcaccaccgtgcccagctaatttttgtatttttattggagatgcggtttcaccatgttggctaggctggtctcgaactcctgacctcgtgatccgcccatctcagcctcccaaagtgctgggattacaagtgtgagccaccacacccggcccagatatttttaaaaattcgtagttgaggaattatattggctatccttcaacagataaaaatctgaaaaatatcaatgagacaaaaagtcctttatcaaaaacttctcagcttccatatgtgatgaaataaagacgcaaacaaagcgtatagatttccaagtcctggagaaggtacatacaaataatcaaacactaaacatcctgatcacacacttaagaactctactggtaaattcttggtggatttcttaaaaaaaacactgttttaatatctatcaccaaaataagaatgttaattcttgtttcttcacatggtttaaatttatggttactacttgaaatattataaatcttacataaacttaaacagaacattttccccactatttgaggcacaaacttagtatcaaaggtaacgtggtaaccattacatttttgcaattacaaacacaagctcattttattaataaaagcagttaacacagtactgagtatatatcaggcactgtgctaagagcttcataaacataatctcatttaatctacaaaactagtgtttcacagagattacctgctttatccatggtcacacactacaggagcaggatttaaatcaaatcaggtttaccaaattccagagctgatctctttttcctaagaaagccaaccacttttcattaaatgattttatcactgacatctgacacctgtagtagatgcagaagtttgattatttctaatggttctaaaccaataactgtaaaccatactctgtcaactgagacttggaatcttggtgttggggagaacttatcagcatagagccagaaaaggccacatacatacttcaaaagcctaagagatagatgctgcagaggcattaacacttctttaagtcatgccaatagcaaaattgaatttaactgtcctcttctgggggaagacatcactgatgcccccaccatgtataatcaaaacaattttacagtactgctcaccttgcagtatcaatacctactttattgttctactcacaccactgccctctgcctttttacttttgtgcccctgctgcccaaagagttactggaaaatagggcatctgtttgtggccacaatggtttgcttggtgatctcacccagtaattctttcattcagggataaatagaatccacctgactctaacctttcaatctagctgacttcagcaactaggcttcaacatcaaaatgtgaagaaacctgaaaaagacttttcaatgtgcagcttttcttggctaagtactgaacagtggttacagtggttaagagtcaacagttttaatatgggttgtcccattaacgttctacgtaatcataggcaagattacccattgatgtgatcctcaggtttgtcaacaggcataaagacacattctagtgataaagcagaagtgtatcgcctttctctaaataaacaagaaattaatcttttacatctctggagtttggttcctctcttatgacacaagggtatttaagtatattattataaaagattctgacctctttctttcaaatctataatctatgctccaaatctaagatacagaccatgcggcaggttaagaatcattgagcataaagtgaggtgaataagagaaaaattgggcaacaggaacatcaacagccataatggtgcacaatgctaactgcttaaaacagctttcacttttatgagctataaaacagcacctttacaaaatactctaaaagaggaacacacagtctgtagtaacatgctctattttagagcaacatctataaaaaagttttatatctcatcttcctgatgttctgaaactaaattatattctccaaaagttttgcacatatatatacagaaattctgttagactaaattaggtatagaataaaaataaaaatagccattctttgaaatacctatctgaagtatcttcattaatttctccttacacatgattcatctaaaatgtcacttctaaaccaggcatggtaaatcacgcctggagtcccagctactcgggaggtcagggtgagaggatcacttgagcccaggagttaaaatccagcctgggcaacatagtgagccctcgtcactaaaaaaaaaaaaaaaaaaaaaaaaaaaattaaaaaaattaaatgtcacttccttgtccacatttttgctgaatactagattgttatttacttacatagaacttcctactatatcacttaacatctaataaaaattatttgtttgtatatatataccgtatatgtttgcagatgtgtgtgtgtgcacatataatcttttattactagattgaactgctgtattagtccgttctcacactgctacaaaaaactgcccgagactgagtaatttacaaaggaaagaggtttaactgattcacagttcagcatggctggggaggccgcaggaaacttacagtcacggtgaaaggcgatggggaagcaaggcactttcttcacaagacagaaggaagaagtgctgagcaaagggggatcacgagaacagcatgggggaaactgcccccatgattcaattacctccacctggtctctcccttcacacgtggggattatgaggattacaattcaagatgagacatgggtgtggacacaaagcctagccatatcagctcctaaatggaagaggtttgggtctttcaccgatcttcttatctctagcagcagtactcatgagtttattaaataaactaacagattttgaaggcatcctacatgaatacgataccatggtgctaggccctgaggcagactcaagtgatattaaaaaaaaatggtaatttttaggctacgtattatggaacccaaagttttatgaaatcctatttagaatttggataaattatactaaaaataagcttatactgagaaacagataactccatgattcaaagcttctcattatagataccagttattctcatgtgacatcaaggttattgctagactggctgatttcctttgaattactttagaatctttgggaagaaggtgaagggaatttcttcctagcagatatctccaatataactgaatttattttgtatctcccaagcaatgactcaatctgattgctcaccttggtccatgattggtatttaaaactatatcttggggggaggagccaagatggccgaataggaacagctctggtctacagctcccagcgtgagcgacgcagaagacgggtgatttctgcatttccatctgaggtactgggttcatctcactagggagtgccagacagtgggcgcaggtcagtgggtgcgcgcaccgtgcgcgagccgaagcagggcgaggcattgcctcacctgggaagcgcgaggggtcaagaacttccctttccgagtcaaagaaaggggtgacggacgcacctggaaaatcgggtcactcccacccgaatattgcgcttttcagaccggcttaaaaagcggcgaaccatgagattatatctcacacctggctcggagggtcctacgcccacggagtctccctgattgctagcacagcagtctgagatcaaactgcaaggcggcagcgaggctgggggaggggcgcctgccattgcccaggcttgcttaggtaaacaaagcagccaggaagctcgaactgggtggagcccaccacagctcaaggagacctgcctgcctctgtaggctccacctctgggggcagggcacagacaaacaaaaagacagcagtaacctctgcagacttaaatgtccctgtctgacagctttgaagagagcagtggttctcccagcacccagctggagatctgagaacaggcagactgcctcctcaagtgggtccctgacccctgacccccgagcagcctaactaggaggcacccccagcaggggcagactgacacaaggccaggtactccaacagacctgcagctgagcgtcctgtctgttagaaggaaaactaacaaacagaagggacatccacaccaaaaacccatctgtacatcagcatcatcaaagaccaaaagtacataaaaccacaaagatggggaaaaaacagagcagaaaaactggaaactctaaaaaacagagtgcctctcctcctccaaaggaacgcagttcctcaccagcaacggaacaaagctggacggagaatgactttgactagctgagagaagaaggcttcagacgatcaaattactctgagctacgggcggacattcaaaccaaaggcaaagaagttgaaaactttgaaaaaaatttagaagaatgtataactagaataaccaatacagagaagtgcttaaaggagctgatggagctgaaaaccaaggctcaagaacttcgtgaagaatgcagaagcctcaggagccaatgcgatcaactggaagaaagggtatcagtgatggaagatgaaatgaatgaaatgaagtgagaagggaagtttagagaaaaaagaataaaaagaaacgagtaaagcctccaagaaatatgggactatgtgaaaagaccaaatctacgtctgattggtgtacttgaaagtgacggggagaatggaaccaagttggaaaacactctgcaggatattatccaggagaacttccccaatctagcaaggcaggccaacattcagattcaggaaatacacagaacaccacaaagatactcctcgagaagagcaactccaagacacataattgtcagattcaccaaagttgaaatgaaggaaaaaatgttaagggcagccacagagaaaggtcgggttagcctcaaagggaagcccatcagactaacagctgatctctcagcagaaactctacaagccagaagagagtgggggccaatattcaacattcttaaagaaaagaattttcaacccagaatttcatatccagccaaagtaagcttcataagtgaaggagaaataaaatcctttacagacaagcaaatgctgagagattttgtcaccaccaggcctgccctaaaagagctcctgaaggaagcgctaaacatggaaaggaacaaccggtaccagctgctgcaaaatcatgccaaaatgtaaagaccatggggactaggaagaaactgcatcaactaacgagcaaaataaccagctaacatcataatgacaggatcaaattcacacataacaatattaactttaaatttaaatggattaaatgctccaattagaagacacagactggcaaattggataaagagtcaagacccatcagtgtgctgtatttaggaaacccatctcatgtgcagagacacacataggctcaaataaaaggatagaggaagatctaccaagcaaatggaaaacaaaaaaaggcaggggttgcaatcctagtctctgataaaacagactttaaaccaacaaagatcaaaagagacaaggccattacataatggtaaagggatcaattcaacaagaagagctaactatcctaaatatatatgcatccaatacaggaccacccagattcctaaagcaactcctgagtgacctacaaagagacttagactcccacacattaataatgggagactttaacaccccactgtcaacattagacagatcaacgagacagacagtcaacaaggatacccaggaattgaactcagctctgcaccaagcggacctaatagacatctacagaactctccaccccaaatcaacagaatatacatttttttcagcaccacaccacacctgttccaaaattgaccacatagttggaagtaaagctctcctcagcaaatgtaaaagaacagaaattataacaaactgtctctcagaccacagtgcaatcaaactagaactcaggattaagaatctcactcaaaagcgctcaagtacatggaaactgaacaacctgctcctgaatgactactgggtacataacgaaatgaaggcagaaataaagatgctctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattcctcgacacgtacactctcccaagactaaaccaggaagaagttgaatctctgaacagaccaataacaggagctgaaattgtgtaataatcaatagcttaccaaccaaaaagagtccaggaccagatggattcacagccgaattctatcagaggtacaaggaggaactggtaccattccttctgaaactattccaatcaatagaaaaagagggaatcctccctaactcattttatgaggccagcatcatcctgataccaaagccgggcagagacacaaccaaataggagaattttagaccaatatccttgatgaccattgatgcaaaaatcctcaataaaatactggcaaaccaaatccagcagcacatcaaaaaacttatccaccatgatcaagtgggcttcatccctgggatgcaaggctggttcaatatacgcaaatcaataaatgtaatccagcatatcaacggaaccaaagacaaaaaccacatgattatctcaatagatgcagaaaaggcctttgacaaaattcaacaacgcttcatgctaaaaactctcaataaattagggacgtatttcaaaatagtaagagctatctatgacaaacccacagccaatatcattctgaatgggcaaaaactggaagcattccctttgaaaactggcacaagacagggatgccctctctcaccactcctattcaacatagtgatggaagttctgtccagggcaattaggcaggaggaaataaagggtattcaattaggaaaagaggaagtcaaattgtccctgtttgcagatgacatgattgtatatctagaaaaccccactgtctcagcccagaatctccttaagctgataagcaacttcagcaaagtctcaggatacaaaattaatgtacaaaaatcacaagcattcttatacaccaataacagacaaacagagagccaaatcatgagtgaactcccattcgcaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatgactctcttcacagaattggaaaaaactactttaaagttcatatggaaccaaaaaagagcccacatcgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataacaccgcatatctacaactatctgatctttgacaaacctgagaaaaacaagcaatggggaaaggattccctatttaataaacggtgctgggaaaattggctagccatatgtagaaagctgaaactggatcccttccttacaccttatacaaaaattaattcaagatggattaaagacttaaatgttagacctaaaaccataaaaaccctggaagaaaacctaggcaataccattcaggacataggcatgggcaaggacttcatgtctaaaacaccaaaagcaatggcaaccaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaaacaaccccatcaaaaagtgggtgaaggatatgaacagacacttctcaaaagaagacatttatgcagccaagaaacacatgaaaaaatgctcaccatcgctggccatcagagaaatgcaaatcaaaaccacaatgagataccatctcacaccagttagaatggcaatcattaaaaagtcaggaaacaacacgtgctggagaggatgtggagaaataggaacacttttacactgttggtgggactgtaaactagttcaaccattgtggaagtcagtgtggcgattcctcagggatctagaactaggaataccatttgacccagccatcccattactgggtatatacccaaaggactataaatcatgctgctataaagacacatgcacacatatgtttattgcggcattattcacaatagcatagatttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaaccatcgcaaggacaaaaaaccaaacaccgcatattctccctcataagtgggaattgaacaatgagaacacatggacacaggaaggggaacatcacactctggggactgttgtggggtggggggaggggagagggatagcactgggagatatacctaatgctagatgacgagttagtgggtgcagcgcaccagcatggtacatgtatacatatgtaactaacctgcacattgtgcacatgtaccctaaaacttaaagtataataataataaataaataaataaataaataaataaataataaaactataccttgtctaataaaactgcttttgaaagtgctaagtaaatttatgctttgaaaataaatacaagttgtattctcaaaggcacagtggttgagagtaagcccatcctttttctctgaacataatcataatacgtttccttttttgttgtactttaccttaataaatttttatgcaccaaaggtgctggagctgatgtcttcaaaagctattcataatagaaggagctgatgcctgtaacaaaattccaacgtttagtgttgagtattctgaagaagccacaactgctgttactgtcccatagagcttatagagaaatagctcatttgtttgccttttttatttttattttttagttatttattttaagagacagagtctcactgtaacccccaggctggagtgtagtggcgcaatctcgactcactgcaacctccgcctcccaggttcaagtgattctcatgcctcaagccctccaggtagctgggattacaggcacctgcccccacgcctggctaatttttgcatttttagtagagatggggtttcaccacgctggccaggctgatcacaatcttctgacctcaggtgatctgcccgcctcagcctcccaaaaggctgggattacaggcgtgagccaccgcacctggcctgcctttcttttttaaatacacttttttagagcagttttaggttcactgcaaaaggtttcaatttttaagttgtaattcctatatggtatttgacctacgaaagcttaatatgaagtctcttatctacacaggacaggaatggaaggctgtatttcttttttggatgacttatcgttactttgaacataaaaagccatacacacagaaacacaatgagatacaactacatacctaccaggatgtctatttaaacaaaaaggaaaataacaagtgttggcctgttgtggaggaacttgaatcctattacattgctggtggaaatacaaaatggtccagtcactgtcaaaacagctgggtggatcctcaaaaggttaaacatgtaattaccataaaatccatcaattccactcctagttatatatgcaaagaactgcagacatacatgggtatttgtatatcaatgttcactgcagcattattcacaataaatagccaaaaggtggcaacaacctaagtgtcaaaaggtgaatggataaacgaaatgtggtatatgcatacaatattattcagccacaaaaagaatgaagtagtgataatgctacaacataaatgaaccttgaggacactgtactaagtaaaataagccagacacaaaaagacaaatattgtatgacttcacttatataaagtatctagaataggcaaactgatagagacaaagtaagttagtggttaccaaaagctggggggagagaggaatggaaagtaactgcggaatgtatacagagtttctgttagctattgtgttagtccgtcttcacgatgcataagtaatgtacataagtaactgagactagataatttataatgaaaatataaacaaatttactcatagcagaaggtaaagtgggagcaggtacatcacaaggcaagagagggagcaaaagagagaagaaaaaggtcccacaagcttttaaacaaccagctcttgcgtgaactcagagtaagaactcgcttatcaccaagtggatggtaccaagccattcaggagggatcccatcccatgatcaacaactcccactaggccccgcctccaacactggggatcacatttcagcgagatttggaggggacacacatccaaatcatatcaagtataatgagagtgctttggaaaatattcagtaacaaaaagcttattaagccacaaagacacagaagaaccttaaacgtaccttgctaagagtcaaagaagccaatctgaaaaggatacctactgtatgattctgatacaacattctgaaaaaagcaaaacgatggagatggcaaaaagatcattggttattaggggttggtgggggatgaggaagtgaaagatgaagggatgaacaggtagacacaaagaatttttagcacagtgaaactattttgtatgatactgtaatggtgcatacatgtcatacatttgtcagaacatacaggatgtatttggctcatcagttttaacaaacacatcacactaatgcaagacgttaataagtgggggaaggagagagtacatggaaacactctatacttcctttacatttttctgtaaacttaaaacttcttaaaaaaaagtccataaatctttttaagttttagaaacagtgtgatgattgcacaacatcgtgaatgtaattaacgcctctgaagtgtatgcttaaaaatggctaaattataaattttatgttatatatattttaccacattaaaagacaaagcactcctttttttataggaaaataatcctgttattctaacaggggaaatggtaataatgaatcacagcccgatgtccaaattgatgaaaatcttcatggaaaaaattctcaccaaatattactccactataataatgagatttaattttatttttgagtgcttctatgtgaacaaaaacaatattttgaaggctctctggttgcatcaacgtggaaagccccagagctcccaggtcattcctcttacaactaaaaaacccaaaacacaacacaacaagaaaagcacaggacatcgctgaaaggtagaaaaaaagaaggctggctgcctagggacgtcactatttgataaataacatggcaatgagtcccctgcatctccttattgcctcccatatatcccaaacagggtgatagagaagactccgatgtagaaccaccaacaggcagaggaaaaaaaaaaaaaaaaaaaaaaaaaaaactccaaggaaagcctgttcctaactagcaaagcaatgatcataaaaagggtgggcaaacaacaaaaagcatttttggcagtatcagccaatcatcaatggaaaaacagctttaccacccactttcagcaggccaaatggtacattaaatttccactccaaaaatctctaacctattccgtccttgcaggtagcctaacttacccaacagtagtcaatcaggaagtttggcaggctaattttccatcatctaccagataggctaagggtactttcactggggcagaagcaggaggaactgattttacattcccctctgtggatcgcattcctccaactgattagtgtctacagggtgcagcagcaagctaagcctccatcctgacccagcagcaaggagactttattaagaaggaaatccaaagcacagctaatcgccactatgtctgttgttagtgggacgcaggaaagagttgagcctgaactaccagacaggaacaaagagactgtacaagtgggggctaattggtattctacttttctcctacccttggtgttactgatgcccaatggaagctgggtctccatacctacccagaagcaaagagacttgtgaaaactgattatgcaaaggagatttttttgtcatacccaacaaaaataaagtgggaggagtcttagggaaaaacattctaggaactatctcacaagcccagtccaaaaccgcaacagcctgccataactttaagcttacaagttttacctagaaactgtcactcaccaatcagaattcaccagcccctgtaagacactgccaacaccaatgaacttgcaaaacaaattacataagcttcctctgttcccccagtaaagccccagacttttcctttgttcttcagacacacctaggggctaccccagtttttgtgttctgaactgcaattcctgtatattatttccaaataaaacctttgcttggagacttgtctctatatatttatttcatgctgacagactgaagaggcagtgtcaagcagggctactcagcactcctgttctccactccacccatcaggatcagcaaagcccagagggaagcagagtcccaacccactttgtaccaatgaagccaaaaaggtgaaggaatgcagagctggtgggcactccactttcccctcctactcctgtagcagtgggttcagcaggggaccaatgttaaactcaaaccagaggcaaacaggaagggaggtagaccactttcgcaagaaggcatcagtgggctgaggaggtgaacatccacatcctatctgtaaaggcaatgtaagtcagtgtcccactttgctgtagtggtactgggggaaagggcaggcagtgggaaggtgagaatatactcacctagccctcatgttacacttcaacaacaacaaaaaacattcaaagcctcataatatccaaaaatcactgtcatcccaagaaccaggaaatcataatatgaatgaaaaaaacaaccaacagatgtcaaaactaagatgaatcaaatgtttaaattatctgacaggattttaaagtaaccatcaaagacgtatttcaaaaaaccttcaaaaatctctctcaaaaaatggaaaatctcagcaaagaaacacaattaaaaaaataaccaaatagaaattatagaactgaaaatataatagcccaaatgaactcgctggatgcactcaatgttagagtggagatgacagacaaaatctccaggctcagatagtttcacaggaaaattctaccacacttctaccagatttaaagtagaattaacatctaataaggttcagtacacactcctccaaaatattttaagctggaaaaatttgagaaaatctcagaagcaggtacaccactcttaccttcctccagctcttctcccctgacccaggtcataaaatctaaaaaggattttctgacattcccatgaagcaagtcataagatcctcatttgagaggtgtccttcctatactcagaggaaaggaacatcctgatttctgatgatttagggtcacagagaagaacctgaataacaccttgctatgttccctccggtttattaccattaggtcatactttttaatccagtcatacacacactatccacttcttcatcaaacctagcactaaaagtacacaggtttaggccaagcgcagagtatgcacccctgtagccccaactacttgggaggctgcggccagtagataccttgagccctggagtccagcctgggcaacatggtgatactttttcgcctttaaaaaaaaaaaaaaaaaaaaaaaaaaaagatggccagatgcagtggctcatgcctgtaatcccaacactctgggaggcggaggcaggtggatcaccagaggtcaggagctcgggaccagcctggccaacgtggcgaaacaccgtctctactaaaaatagaaaaattagctggaccaggtggcgggtgcttgtaatttcagctactcaggaggctaaggcaggagaatcgcttgaacccaggaggtggaagttgcaatgagccaagattgtgccattgcactccaacctgggcgacaagggcaaaactccgtttcaaaaaaaaaaaagacaacccacacacagatttacctctttcttcaggttcctttcccttacgagggctgtgtgccatgtaaaactcctattatataaatgtatcttttctcttgttaatctgtcttttcttatactggcctcagccatgaacctaagatgtgaggacctaagagagaggaaaagacacttttcttcccaaacacatcaattttatataatctgttccaggaaataaaggatgaggggaaacacctgattttataactattattattactgttataccaagacaatacagtacaaaaagaccaaggcacaacaaaaccaaagggaagtacaaaacagaaaataacagaccaatatttctcatgaacttagatgcaaaatcatcaacaaaatgttagcaaatcaagtctggcaatatagaaaaataattacagcagttccccctcaccatagtttcactttctgaggtttcagttatctactgtcaactgtggtcagaaaatattacatggaaaattcaagaaataaacaattcataagttttaaattgcataccattctgggtagcatgatgaaatctcactctggcccacccaggacatgaatcacccctttgttaagcctgtacacacttctataggctacctgcccattagtcactttgctgccttctaaattctatcagatcaactgtcacagcatcacagcggttgtgtttaagtcatccttatattatttaataatgacgccaaagggcaacagcagtgatgctggcaattccaatttgccaaagagatgccataaagtggtttcttaaattggaaaggtaagacttcttgatttaacaaggaaaggaaagaaatcttatgctgagattgctaagacgtatagtaagaacgaatcttctattcatgaaatcgggaaaaaggaaaaagattttcttgctagttttgctgtcccacctcaaactgcaagttatggccacaatgcatgataagtgcttagtgaaggtggaaaaggcattaaatttgtggaagacatgaacagaaatgtgttctaatttatagcaatcaggtttggtactatttgtggtttaatgcatccactgggggtcttggaatgtatcctgcacagataaggggagactactgtgtctaacaataatcagtggaatttattccaggcatgcaagcctgttacaacatttgtaaatcaatcaatgtaatccaccatgtctacaaactaaagatatttatatgatcatataaactgatgctgaaaaatcattcaacataattcaacatcatttcatgatttaaaaaaaaaaactctcagcaaatgctggttctcacctctactgtactcattgtgtacctcagcacttaaccacccttaaatgatggtactcatttttataggtagtttgagttcacgtcattgcagactttttgttctttaaaataggtaaaaaagtattcattgtataataaacctttaaggtggcaatatcattggcacttttctttctggttttttgttgtttttgttttgttttgtttttttgctagagatgaggtctatgttgcccaaggtggtcttgaactcacgggctcaagtgaacctcctgcattggcctcccaaagtgctgggattacaggcatgagccaccagatccgacccactggccatttcttagaaagaacttaaaaaaaataaaataaaatgtgagagatcatttgtcttatttgccaaacaaataaaattatattgggcaaaagcaacttttatgagtgagaaaccctagtaagtaaaataaaatgtttcagataattagtgtatcacttagtgttatttttctccttaccatgtttataaatcacaaggttcaaagttttaaatataaaacaaaacctttaagatagtctctaaaatgaaaaatttaatttttaatgtgaatatatttcaggttcatttcagttcaactaataaaaaatgttaatgttctcatcaatccaaaatttcagagaaacatggttcccttattaaaaaaccaaccctcaaggaagttcatgagccaatcctattcatttgaccaaatctatagaggaaaccataagatggggtctgaataaggagaactgtaatcgttatttatttgaaaaggtaaagtaggatttctgtgtcaatccccaaggccaaaagaccacccaaagacattttcactggtcaaagcttagaaaaatcaaagaggaagtcctcaccaccaaagaaaacaacactctttccagtaaaatttatttgtgaaacaaactaagagccttacctttgagaccccttttttacagaggaatagcacaattgattttatttttattggaaagccattaataaccccacgttccttgatgtcccaagttatatgtaacacaattggccacttttaataagcataggattggaaacagtttctgaaaagttaccacagaaaaatccctttaaaagcacagcaaaatttaaactttttaatgtatcttccctttggaactaggccaagggaatgtcccactgcatgcagatctagggcatcatttatttcatgaatgttctgcacaacaatattctggaagctttaatatatgttccagaggaacagattccattgtcaaagacttcaactgttgcgttaaactaatgaattaggtttctttactataaaacttgttaaagctttaatatgcattgcaactctccaagtgataatatatagcatgaaatatttcccaaaaaatgggactaagaaataaaaatgttatggttaaaaaagaaatctatacatatcttgaaaaagattcaaattccatgaaatacagtttgagaaatagtattttaactgcaaactaaaatggattaggaattctcattggcccaaagaaatcagtggtttcaatgcaaagcttcccaaagcaacacacaccaagaataagataaaccaaaaacctaacatttaatttttacaaatgtttttccatatgtaaactctgtatacgggccaattctttgtgctgaaacttatgtgaaaaaaaaatgatggaagactttgttgggttattctcatttaaactattaaattgagttgtgaggagacccatcaggtagaatgaaaatagattttgaaaacgtagatagtttataagggaagattttaaaaataaatgttttaaaagaataaaaagacaagccatagaccatctttgtaaaacacttatttgatcaaggactggtaaccaaaatatacaaagaacccttaaaattcaaaagtaagaaaataagaatctcaaacatgggcccgaagatctgaacagacacctcacccaagaacatacacacatagcaaataagcacaggaaaagatgctcaacatatgtcattatgtttcaaataagacaacaatgagttacaactatggctaaaacccaaaacactaacaataccatatgctgacaaaggtgtggagcaacaggaactctcattcactgctggtgggaatgtaaaatgatttgccactttggaaaataatttgatagtgtcttataaaactaaacatattcttactatatgatccagcaatcaaataccttggtatttactcaaaggtttgagtaaaaaacttatgtccacatataaacctacacacaaatgtttatagtggctttatttataattgccaaaactagtaagcaaccaagatgtccttcaataggcaaatggataaactgtggtatatccatataatgaaaaattatgcaacaataaaaagatatgagctaccaagccatgaaaagacatggaagaaccttagatgtgcactgccaagtaatagaagtcaatctgaaaaggctacatcatatatgattccaactatatgaaattctgaaaaaggcagaactatgtagacaataaaaagatcagtgtttgccagaaattcagagggaaggagggaggaataggtggagcacgcgggatttttaaggcaatggaactattctgtgtagtaatataatggtggataaatgtcattatacatttgtccaaacccacagaatgtgaaacaccaagagtgaatcctaaactatgaactttagttaataataacatatcaatattggctcaacaaatataattgaaactgtagggagggtggcaggtaggaactctgtactttcagctcaattcttctgtaaacattaactgctctaaaaaatacagtctacaaaaataagataaatgtgggcactttaagagagaaaaagttagctacattcaaattttacaaaaacgtttatcaaatcaccaattccacattaagaccaacaacaacgtatttatgtcatctccctagcaaaagcagagaagatattatttactatcccagcacttccagtgtctgtggcttaaataattcaggtcatgagactaaaaaatattaatatacctcatttcttaaatttatataatcaaactttatacccaatacaagtcttcaacattttatttcagtctcctcatattcacttactttactgagtaaactgatgtcagagaaactgctatgtcgaaaagggcaacattagttcactgaaagctctgccacagaaataagtttttcgtatctgttagtccagtactcccattctctaaatcccttcaatttagatttctaggagttggtattcccagtatacttctaatatcttttacaggcagttaactgaattctcttagtcatctgatgaaaggagaagtcaagtttcccatgctggcattatggaactggctgtaatatagattttgcaaggggaaaaaatcagtttatagggaaatacaatgtcttctgtttatataacattttgacttattaaaacgaaactgtttgaaaaagcaaaaatctgattaagcacaagaattatattctttgaaatgagaatggttaacttgggatcagatgaaaatgaaacttgattacttcaaaaaaatacattttaatttatttcagctttaattttatgtttttaaagagtatgtttataacccaaataagtcagcctaacaaggatgaataattaggtaatttttggtgtttctctttaaattgtattaataagctatttaaataaagtgttcttaatcttagatctaatgaaagaacaactttgcacactttataagcctttatcatataacaaagcaaagattccttacttaatatttcgaatcaaagcaaagtggttaactctgagaataaaaggcacagagaacttaataactcattgattatgactcatcacaccacactaaagcagatccctactgcagagaatttagctacaacaaataaagaaaatcagaaatataaaattccataagatttaagacacaaaaataataactctgacttctagtattatagatatgagaaatgcaaaattgtaagaaaatgtatccgactcttttgctctttgaaccattttctaaaaaggttttgttatgaccagcccgcccaaattttctacatttgatgaagctacttactgtagaaaccaggacaaaaacagaaacagcacccatagagttccaaagaattctctttgacaatgtttttcaaactaagtaagattcgttaagggaccatgaccaccacgctttaagaaataaatattagagtgtatgtatgtaaagtaggaataaatgttctttgaaactctcgattcagaataacacatgtacaccaaaaaaaccccacttatatccatttatatataagtttgtgtacactggttcctaatgtaaaatctactatttataaataggccatgatcagaaaagtttaatgtcctaaataagctttaaaatttagttccaaattttaaaagggattgtttttcattaagaatctttgactttttaaaatcaaagctattttaatatttcaagattatgtcaagaaaaagcttctgtaatgtcaaattaaatattaagatgctgtatcaaattcacttttaaatctccagggccaagcagagtcagtgttcaataaatactccttcattgaacaaagttgagtaaaataatgtattcctcaaaaaattagctgggcatggtgacgggcacctgtaatcccagctacttgggaggctgaggcaggagaatcgcttgaacccgggaggcagggtctgcagtgagctgagatcgtgtcattgcactccagcctgagcaacaagagcaaaactccatctcaaataataaaaataaaaataatgtattcttgttagctttcttagaaaagttcaatcagtagagtcacaccaggttgtaacgtacattagggattaaatcccaaagattgcaatacagaattcttagagtgagccctcatacagataattaacattagttctgtaaactaacatacagcttttgaaattttaagtattttatctatttaaaatgtgtcttagtttaaacacacattgaacagagtatatatctgttccacattagaaatttaaactgtccagttatacacttgggtcttcagcttccttttccagtgggttcattcattagaaattaaagacaactttttgttgatcattattagcaggcctttacacggtctatgtggttatttcacaactgacatacttttacaaccaacaggattctgtcaaactttacattttatggtatgcatttaaaaaataaaatttacattttttccatcatccaaataagaaaatcatcttatctttattaactatatttcaaacacaacacatgtatccctggtttcacaagaatcatgctatatagaatctggttgagaagaaaaaaaaatcaactcaaaatgatactttaaagtgttgtttgtggtgtggaggaagaagaaaaaccacctctattatatatctacaaatataaattttgttttactaaacctattgtttacaacaaaatacagaaatcataagtttaaagaatactattcaagtgcttgttgtattggtgataactgttttctaccaaaaaagagcagagtaaaattatcattcaatcttctatgactaaattggttgaagtaaaaatgatttattttctaatgccttcataagcacatgctgcaaaacattttagtgaaatacacacacatatgtatacaatcaaaagaagttctctaaagtggcatcaaggttaataaaaatacattaattctaataaaaaatacactacggttataatgcaacaaaaagaatgtcattgcaatagaaaaaaaattaaactgaacctgctgtgatatttttcttacagtcatttaaatcaatacaatttaaacccaatctcatcctaagtagtattcatctaatctcagaatgcttagcaattttattccaaaagaagctgactactatactttagacaaatttatctgtttctaggataccaaatcataaaaggcaaaactaaaatgctttaactactgtgaaaagacctataaattgcagtgtaatgtttttcagttgaaatctgtgaatctaattcttgagagtttgcaaattttctgtaatatttcttgtataattaaatttttatgtcaataaaaaacaatgaattggcacaaaaaattggctttttgtggcaggataatggaaaagaaagaagggacgtgaaatgaggctagcttaatacaaaataatggccaagtgatgctatgatatattatacaatggtttcataataactggaacagagaaaagtcacaggaaattgtgtttgttatcttacagaaaaagagagcaatgatcagagctttccaacccatgcccttaggaacaaaagccaccaactaggtacaggtgtgtaggttttaatgctctcagcctatggaatgcctgactggtgggaccagaggcatttaggaacccctgaattgtctgctgtcaagaacaaccttgtgcttctatatccagtggccctatgaatattatcatttttcacttgtgccataatgtcaaaagaattgcaaagcactgggaagatgtaacaaacttttagaacacagtagtcatattaagaaagggaatttattttcaggagttaaaagtctgtcatatcaaattaaggttattattttgattgtgatatgatcgatttgtttttcatttctgattgtttttgacttagtagtttcaatagatttaaatgcaatgaagaattgctatctagatttttatatttgttcatatttcagtaacatcagcagaaaaatacttgaagttaaaactagggtacatattatttcttttcctcttttaatagtatctgccccaaacataaggtgaaaaacaattggattcatgagtctttagtttgaatctcactgaggtcggtagttacaaactttctgatcccgggcaagttacttacatcagttttcttatttgtaagatgggaataatgatcattcttacccaaggaaggagaagattcaacgcctatgaagtgtatatgccagtagctggcatatagtaacaaatatttacaggttagaaaagtgagctgacactagcacgctaaaaatatatttcacatctatcaaaatatacttttagtttaatttatccaatctaccatagataatacacaatagatatctgactttatatctgtgacaatattcaatcattttaaaagggggtagggggcagatatattgctttagaagtactcctaccattctaaaaatactgtcccgcagctgtttaaaatttatttttttagaccatagcaccactgtttggttgtttccaatttctaaaaccacaaatagtaaaagtgtactcagtctactgcaaacataaatagcaaatgcacgcttcagcactttttaaaggatatggaaattggcaacaaaaatgcagttcatgttgaaaatttacgacagccctgccatatttcttcagaaatacaatcaggtaaaaattaggaagatctctaccagctgggtggtatttttgtgtttttatacttatattttcactaactgaaagactttcattatgcaatttctggcacttgataaaatagagcaatagtacctttgctaaaaccacagtttctttggttatgtttagcattacacaaacatctttcaccttagatatccttttgcattagagtgtttaattttaaattgactgaagggaataacttttttcagaatattatgctttctggatatcactaagcacaagaattgtattttcatgatttctcaaagatcatgtgtatgtgtttcaattattaggcatttggttccataaaaagtgtgacaactactgataaaagatgagaatacaaaaatgattcaagaaaacatggagaagattgacttacagtgttgctatattatttttttaaaaccctgtctttataaaatacgtaaaaagccacaacatggatttaccatctcttccttggtaaagatacatctaaaataacacatcctcagcttctgaggagaagaaaaaaaaatccctggtacaaaaggttaacataaaaaatagtatgctaaattcaacagtggaggaagaagtttcgttttaagacataattcttcaatactcatttctcattttaatattaaaattgctactacatatttaaattggttttaagtatcagaaataggaataaagattattttttaatattttgatgcatccaataaaattgtgttcaattaacactgaatgaacaaataatcaagtaaatggagagaaaatgtcacttgatcatttcagattttttcatgaaatttttaaaataaatgactcaaaaactcatgaacaatagttcatactatgatctaataacttaaatgatttgaaagaaaaataaatctaccaaggaatttttaagtggctcctgttttacatggtgtttcttctttacatacattgttactaagtgcatttaaccaataaacatttttcaaagatcagttaaattatgctatttggttggatgaatacttcatatatcctctataatacatgctttttaaaactaattaaaaaataagaattcaaattgaaatatgcaatgtaacaaaattaaggtaaactatgagaaagacaaaagttttgtggtatttgcagaaaaaaattgacaatactattttttcatttacataaaataagaagataaagagtgaaaaaccattatgcattgtatttttagggcccacatgtattgggacctaaaaatacaatgcataatggttttaccccatgtcttttaataagaatttgactttgttagataattgcttttctttgaatttacaaagtgtaaagtgagtctaactgccatattaatcaccaaaaaaacccaaattacatacaacgtaagaaacttaaagctgtatttctcatctgcaattagcatctattcagactgtaaacttacaaaagcattcagatttcttcttactctgaatactgtttaataacccaaacttgataatgttccatcactgcatttctagaaataaaaaaatctctcaaagttctcaacttatcttttggtctgctgaacaagatattatctgaaatgttatatgctttgaatacccatttttactttaaaatgatacttaatcatatcttcttaagagctggtctaatcaatatgaaagccaggcaggaacaaaaaaatattttaaaaatagcttttcaaaataggaatacatattctagtgatgcagttttctgatttgaaacaggatcacttttacaaatactgagtgtcattttgtattcaacagcagcagaaaaaaaaggtataaatgtctacctcatttgctataatgtaagttcttagatggaaatactgaattaaacactggtggcttatggaacacacaagccttgcaatttaaaactagaaaccttcctcctaatactttgttatatctttaggttaaaatatttgttttcttaattaaccataagaaaacaaagaaaaagaaaagaatcagtcccaatacattaatttgctgaaattttcacttgtgaaaacaaatcaagtttcagaacttgggaatagcatataacaatgaatcaatgtctcatctgtaacaacgacacagttaaaataacttcttgatataagttaatttttaagaaaattagtttgatccagggttatttataacaggtaacatgagtggtttttgactaagctgctatatctttccttgagttactctgagttaagtcacactacctgaagttacatttggaacaccaacatcttaattattatcatgaaatagctacctattatttttaagtaaatgtactaacttctaatcatatctgttattttaagctttgaataatatgaaactaaatcatgtaattaaggatatagaaaaatgcaacagaatagctttataacagaccaattacaacactttatttcccatactgttacttaacaaatatctgtgctattttataacattttaaaatcttaagactagaaataattacatcttttactagtgcttataagggctgttgtcatctttaaagacacaacatctttaaaattagaaatgcatacaattttatatttcaaaatgtattaactcaaagacaataaaatacacctatttcttaagatctattttaaaatactgttgttgcattggattaaatgtatatatgtgattaatgaatgcttccaatataaagatttaagtctatttttccttgccagaaaaaaacaactcagcttaatttttaactattttattatacccttcagaacttaaaattatatacaaataatgtaacctgagacctgctctggtcatctgaggaattacaattagagcatgaatctccacaattctgcagcaccttaagtaattttataaaaaaaagtattttttgcatatttctttaactccattaagatcatttcctgggcttcttacagtgaaaaaaaaaagtcatttgttttagaataaagaatacagcaaaaatacttcgtcatccaaaagactatttttcctacactatggtcaggcaaccaaccccactaaatatagaagactgacatttgtaggtaattcaatagtcagatgataattcttcagtagtttcacagtagcataatttttcacattacttgaaaccactgttaaacctataacacattttctgtttctctgtgggtatttttttctgtctttaaccctaaaaggaatatgtttcatctgacagcagtacaaaagccattcataattcagaaatgttttccttttttgcaatcaatacatgactttgaactcaggtttttcaaagattagttaaacattatgtttctttaagtctagagccttatttatgtgagtctgtggcttaactgacaagaatttttctgttccaaggaaagtcagtcagtttgtatctgaaatactataatctagcttccgtccatataaacatctgcaaagactcactcagtcaaatgttatacaccccatcaaccaaatcagagactgtaagaatcattattctgtgcgacagataaaaatcttctgtgcaatagagaaaaatgaaaagcaaaatgatgaaagaaaaacatttataattttgaaaattaattagtaacaatactcagtgtaaatatttgttaacatttcttattcaattctacaaatgtttaataaaatcctaaaatgtaaacataatgagtgctgtatttatatgttctctaattgtattatcatacaaaatattgtttgtataactgccatatatattttgtctatttctagtaagttaccattaaatgaaagttaaattgttcaatgttgaatgaaagcaagtatgacttattacattaataaaaaattaacccatgatcaaaatgtctaaagtatatcccattttgatgcacattttaaaaatattaacaaacttaacaagatcctaaagcctcatattttttaggtgcagctggtaaaaaaactaacagatatcatatgctaatagtacttatgatgtgcaaagtactgtttgtaagcactttacatttttgaaccttcttaatgctcagaacacctttcactttagagacaataaaaaatgaagctcataggggttaagcagcttaccagaagtcacacagttattaagtgacagtttggttccaaagtccattctctttaggcctaccctgaaaagcatcactgtaatataagatttttttttaatttgaaagaagaaaactgtggtattcactgacataatgcctagaacaaatatgtcaaatattcttatttgaggatgctaccataaactttatataaattacatactggtaataaatgtaccttatttgtaatcattttcattcaaagtaacaaaatcaaagtttctctcttgtcaatttgaattaaacagtcatgtgtacaaatatacacataagcacctatgtattacttccttatgggaacaatacgaagatttcaatataaacgaatttactaaaatcaagcataaaaatattttctgatgattagtaacttacataataattaagtatacatgttaacttgcatttcattaaccaaaattttaatatttaagcttaagtgaatgatacgggtaacataatcattcattttatttgtaatgtgaactaaaagttaccctttcaactgtcttattttttaaagttcagtgtaatcctagagtttaacatatgaattggtaaatgcaaataatctcatactgcaacttgccaacttaaaatgcaagaattcatttctaattggttggtttattgctcactcagaaaatttttatttctttttcagtgaatactgtttcacatttggtaaaatacaggaagtcacaccaccaatggaatgcgattatctataatgagagttagttattccatattcccatttttaaaaataaattaatatatcaacacactctgtaaaatttatataaacttaaaaatactagtgagctgaaagtggaaaaaaacataatcggaataatttcataacatgcataatcattcttcacagaatttttattacccagtatggaatggattatagtaaatgtacttcacacatgctgtttcttattcaaaaggaaacacagaataggacagagagaacttccagccaaatcttcattctaatccaacagtcatggacgccactgtaattgaaagacatttccaaacagatagctgtggaccccattttcctttaaaataatatgtctttcacatctgttccaactaaaacatgtgtgttcttaaaatttaccaaactaccttatgcttagtttttaaaatattaacagttttatattgttctgcttaatttgcaactagttaagcccataaaatgtacattttcaaattatgttaacatgttaaaaagtagtagaatatgcacgactaatcaacattttacatctgtgatttccaaagttaggaaacctcaattgtttttcactgactcaagcaacttcttaaaatggtacaaatcatatattttgccattataatattaaggtgacttcattttattttcactttgaatatcttccaaaataagaaatccagctctcaaaatcaggcatcaaaagcaatactattaactcttttgacatacccaataattggaaattaaaaataaatcatgcaatatttagacattatctgtcataagaatcttttaataatgatgataccttccttggaacgtttacaaaattataaaattgcagataattatgaaacggtttaaaaaaaatttcacatccagaatataaaaataaaatagtataaaagaaagaagagcagaaaacagaaaaaggaaaacaatgaaggccttacatacttgttaaagtcaaaactactgcaacaaaaatttaggattactttttatataacagtatcttcaaaagcatttacaaagttaataaaaacttaatcagattgcttttacccaatgatcttttgtataacgtagtcaaatatcccatttagaagtttgcctaaataattgtatccataaacttttcctagtcattagcgtcaaaaaataccttgtacattattactactcgtactatcaaaatctctattttgaaatatcattgtcattccatttggagcattaacctagaacggacaaaaaatgtttatcaatattataaatctgacatttataaataatatacaattctatttaatgaactaaagagcaaattgatttaacagaggtagttagtacttacacattttacactgactttcaggtgcagatattcataatgtagaaataaatgataatataaattgaagaaatcctacaaatgtatgtgtgtgtgtgtatatatatataaatcactagagatcaattacagagcagcatcaaatacaagacagtaagatatagattatacacaaatactgataaaatataaggtaaagataacataatcaaggatgagaatattgatgaaagactccatgaaggaagtcttgcaccacagtttggaggaagatctcgaaataaaataaaatacaggttttataaagcagtcatttaagtggatagagaatacagggcatggagtaaatggcgaggaacacaggcactgaggagacagaaaacaccatgtaaagacaacatgcaaaacaaccgaaataaaggaggtgcagtccataaagtttataaacggcattaacatttacccaactgttcaggtcaaaatctaagctgtcatcaatgatactttcctctgccctacactctgtacctaaatgatcaccaattcctgttaattctacctcttaagtatatcctgagttgtctttagttccccagcagcaccacctgttattcagactatctctcatctgaactatttttgtaaactccaaggcagtcttactgcatccccttgccctcaatttcacttctccctcacttgaaaccttttctgcatatttctgcccaggatgatctgtttgaaatgcaaatcaggtcactttatgccctcactaaaaaacctttcagtggattaccaatactgtcaaaataatgtccggaatctttaacacgacatgtgttgctgtggtcctaatctatcttaccagttttactttgtacctctccagcctcatgcagagccttctgccccagccatgaaggacttctctcagtttttcatacaacctatttgtgcactttctctctcatctccaggcaagatcaattgtaacttttccaagaaagccccccttgaccatccctcttatgaaacatgacagactacactaagtctacttaaactctgaactactaatacttctctgtcacagcttttaaatggcagctttctataataaattattagttccgttaagaagggccacccaaacacagtggctcacgcctataatcccagcactttgggaggccgaagctggaggatcacttgaggttaggagttcaagaccagctggccaacattgtgaaaccccatctctactaaaaatacaaaaattcgccgggtgtggtggtgcatgcctatagtcccagctactcgggaggctgaggcaggagaatagcttgaacccaggaggtggaggttgcagtgagccgagattgagccactgcattccagtctgggtgacagagcaagattccgtctcaaaaaagaagaagaagaagaagaagaagaagaagaaccacctgtatctcttttgtattctatacatcttcagagccaggtaagagtctaaaataataaacatttgataactgctaaggtgagaagaaacaacaaaagatacagccatgcagaagatacacaggttatcacagacaagcagttcaccaaatactggatctacgaggaacacttataaagaatctactttggtgatttctgactatactcatcagagcctttgggttcaaggaggacaagagtcaggaagatgctcgttccttccacatatattctccacctctgcatcaaacagatctgcttcaatcttatgtgtttttaacatatcgagtcatcacataacatttcatttggggggaaaagtttgaaaacctctatgctgaaaaatttccaaatcttgatgcagtccttccattcaaatacaatcctttcctggaatcactcccaggctactgactgacagaaaccacccctaataactcaggctgaaacccaaaatcaccttaatttttgattccttgactcctccatatctaatcaatcaccagatcctattattattcctttcttacattaacccatttttctcattctcactattgtcagtttaaaacagattcagacccttcttattcctgaaattactataccaagtaattttacttcctaacttgcttgcttaactccaatctccccttcattaaatatgcccatgttgggctcaactttctcatgcagtactttcattttaactatagaaataatatctcgtagattccagttttatactgtactataaagcaaaaccaaattcccatctctgacttttgaaatcctctttctataacctgcccaaactagctactcaacctattagatttccttctccttctatcagattggttttttagttttctcaaaagtacattggaatcatttaagcaggatattttacacttctatctacagatgcaaagtagtatgccctaagttactgaagaccatcagacataacatagaaggactccatgttgccagttttccgagtttgcactattggaatgatctttatttattcccacattttctatagtttccacctccattaggtcatggcataccattccacaattacataatataaaattcctgaaattctgataaactttatataatgtatagcttacaaaatgcaattcatagataagaaaaggaagctcaaaaaagcaatggttgcgggtggtggctcatgctgtaatctcagcactttgggaggccgaggatggcggatcacttgaggtcaggagtttgagaccagcctagccaacatggtgaaaccccatctctactaaaaatacaaaaatgacctgggcatggtggcaagtgcctgtaatcctagctacccgggaggctgaggcaggagaattgcttgaacctgggaggcagaggctgcagtgagccaagattgcgccactctactccagcctgggtgacacagcaagactctgtctcaaaaaaaacaaaacaaaaaaaaaaaccagtaagcaatgtgttcaaagttacaccactaagttaatggcagtgctgaaaacagactaccagttgagatcagctcactgcctttttcttatgatcagctacaattattttcacagaaggccttaaaattcaacaattatgagaaataattctagagtcacagtgctggagtttgaaaataggtcacaacacttacttgaaaataaaatttgacattccattatattaatttttagctatgtatctatgcagtatgtaagactcattcatttaaccagcatttagcaagcacctaccatgtgtgagagatacaatactgaacaaaactgactaaaatacatttatgaagaacatgtgttagtaaggaagaataatatatgaataaatgaatatgtaaattagatatttacagtgtcacacagagataaggctatgaagaaaaattaggtagaaatggcaagtagagaagggaaagactgctatttcaaatatggcgatcaatgaggtcttcaatgatgaggagacctttaagcaggaacatgaggaagagagtaagaagatatttgaggaaagaatattctagcagaaggtgagggcaagagcagaagaaactgagatcagaaaagtagtgaaaagtgaggacacacagcccatcataaaatatgtgacttttactctgaataaaatgagaagccattaaagaatttcaaattataaaagtaaaaaaaaaatctaatttaaatatttaaaatttcactcaatatcacaggaagaataaaacaaggggcagggggtagaaatgaaaaacaggagcaaaagtagttgcagaaagacagacctattacaagaataaaatccaagtaaaagatagtaatgactaagagcaatgtgtagcagtggaaagaaatgtgggctgtgagagagttaaagataactccaaagattttgacctgctggaagtaaagaattgccaaatagattgctgagatgagggggagatggcagcaggagcatgtttgagggaatataaggacctggttttggctacactaaatttgagaaatctaccagacattcaagtggagagagaggtatagtactgatttcaatatgtgaacaaggagttcagaggaaagctctatgtggagtagtcagaaacagttgggtatatggtatttaatattgaaaaccacaggactggatgagatcaactataggttaagtttagatagagaagataagaaacaaaggctgaaacctagcacaatccattgttcagagatccagaagaagaaaagcaaacaacatctaggagatgagtagaaacgacttagtgaagttaaacctaaataaataaaaataaaccagaagactgaggtgttctggaagtcaagtgaatgaagtcttttaaagaggagggtgaacaactgtgtcaaatgctattgataggtcaaggaagataaggactgaaaactagccactggatttagcaatataaaggtcagtggtgaacctgagaagagcagctttggtggagtgataaaaggaaaaagtctgactgaagtaaattttagaaagaatgggaggataaaaactggagatagggagaaagcaattcctttgagaaattatgctaaaaaggaagcaaggtaatgggatggtaaatagagactaatgtatgatctagatgttgtgtttgttgtttaagatgagtaaaattcatgcaagtctgtatgtcatttgtggcaagtctacttggtgccatttttcaacagcatgggctcatttcatatctctgtgtcatgttttgataattctcacaacattttaaactcttcactagtttcgcacctgttatagtgatctgtgatcactgatttttgatgctaccactgtaattgtttgggggcaccaagaaccaggcccatataaaatagcaaatttaattgatacatattgtgtatattctgactactctaccacctggctattctcccatctcacaccctctcctggagcctacctattcctcaagatgcaacaaaattggaatttggccagtcaataaccctacaatggcctctaactgttccagtgaaagttaaagttttacttcttctactttaaataaaaagctagaaagaattaagcttagttaagaagatatgccgaaagtcaacacagtccaaaagctaagcctcttgtgccaaacagttaaccaagttgtgcatgaaaagggaaagttattggaggaaatcagaagtgctactccagtgaatacaagaataagaaagcaaaacaacttcattgctgatatggagaaagttttagtggtctgggtagatgataataccagttagaacattcccataagccaaagcctaatctagaccaaggcattaattcttctcaattctatgaaggctgagaaaggtaaggattcagaagaaaagttagaaactggcagatgttggttcatgaggcttaaggaaataagccatctccataacataaaagtgcaaggtgaaggagcaaacaatgatgtagaagctgtagcaacttaacaagaagatctaactaagatcactgatgaagatggctatacaaaaaaagagattcttgactgggcgtgatgcccatgcctgtaatcccagaactttgggaggccaaggcgggcagatcataaggtcaggagattgagaccatcctggccaacatggtgaaaccctgtccctactaaagatacaaaaattagccaggtatggtggtgtgcacctgtagtcccagctgttcaggacgctgagacaggagaatcgcttgaacacaggaggtggaggttgcagtgagtgaagatcataccactgtactccagcctgggcaacacagcaagactctgtctcaaaaaaaaaaaaaacaaacaaaaaaattctcagtggaaacaaaacaaccttctactggaagaagatgccatctaaaactcccatagctggagaggagaagtcaattcaaagcttcaaaagacaggctgaccctcttgttaggggctcatgaggctgatgacttaccctcttgttaggggctcatgaggctgatgactttaagttgaagccagtgttcatttaccattcagaaaaatgtcaggcccttaagaattatactaaatgtactcttcctttgctcagtaaatgaaataacaaagcctggatgacagcatatctacttacagcatggttcactgaataatttaagtctactgttgagacctactactcagaaaaaagattcctttcaaaatattattgctcattgacaatgtacctggtcacccaagagctctggtggagatatacgaggagatgaatgttgttttcatgcctgctagcacaacatccattctgcagcccatggatcaaggagtcagctcaactttcgaaatctatttcatgaggctacagttgccacagatagtgattcctctgacagatgtgggcaaagtaagttgaaaccctctggaaaggagtcaccattctagatgccactaagaacatttgtgattcatgggagaaggtcaaaatatcagcatcaataggagtttggaagaagctgatttcagcgctcatggataacttttagggattcaaaaattcagagcaggaagtaactgctgatgtggtagaaactgtaagagaattagaattagaagtagagcctgttgtgtgactaaagtgctgcaatctcatgatcaaacttgaagcaatgaggagttgcttcttatggatgagcaaagaaagtggtttcctaagatgaaatctgttcctggtgaagatgttgtgaacattgttgaaatgactacaaataatttagaatattccataaacatagttgctaaagcagatacaaggtttgagagaactgaatccaattttgagagaagttctgctgtgggtaaaatgctattaaagagcatcatgtgctatagagaaatcttttgtgaaagcaaaagccaactggtgcagcaaagttcattgttgtcttatttgaagaaattgcctcagccactcaaactcagcagctgtcaacatcaaggcaagatcctctgccagcaaaaagactatgacacattgaaggttcagacgataccagcaaaaagaccatgacacactgaaggctcagatgatatcagcaaaaagactatgacacattgaaggctcatatgatcaagacagcattttataaaaataaagtatttttgtaattaaggtatgtatactgcttttttttaaagacataaggctactggaaaggaaaataaatctcgggaccccaaaatcactaagccaaagggaaaagacaagttggagactgttaggcaaatctgccatccattttattcctaaataagacagctacaaagataaaaagctacatactcacctcacaatttgcccagaaggaaattgcttttagacaaaggacagacagaactcaaagtcatacttctgttcacctaggacaaatgcatatctgattgctttctctgccctattgtttcactaagcctgacaaaggcataagtgactattcctctaccctcctctcacatataaattgtgtcttcagtaaaaggctaagaggctcaaaagaatgtaaccatttttctcttatctacctataacctggaagccccctctcccacttcaataggttctgcctttctggacagaactaatgtatatcttacacatattgattgatatctcatgtctccctaaaatatgtaaaaccaagctgtgctctgaccaccttgagcacatgtcatcagaacttcctgaggctgtctcatgggtgcatccttaaccttggcaaaataaactttctaaactgattgagatctgtctcagatacttttgcattcacagacacttaataaactatagtatagggtaaatgtaacttttataagcaccaggcaatcaaaaaattcatgagactgacttcattgcggtggtctggaactaaacccacaatatctcagaagcatgtctgtgcttccagtctttctcttaaagatccaagaccaggtccaagtacaagaatggaaaagagaagaaaagggagcaaaaagtaaagtaagctcccatctgaacaagcctctttcaagcaccagtcccaaaagttttccacccagtgactttcactttaactgaccattccacaaaggagcatgggaaaaggtgttttttattagactcattttattacacttccattttttttaaacaaagaagaaaaaaattttaatgagtcaaaatttcccaacataactgtctttgaaaataacaagtataaaagttacaagcaaatacttacatggttaaaaaatctaatttttataaatgtaagtaaacttttatttcttaatgttctacagtatctcgatatccatctctgtaaggtgaagttgtaacagtaaggctcctactctctcccctgccctttcatggtcctcatactttatgtttatttttatactgtaaagtttattaagattcatattatctcccttaaatacaaacaagtcacttatgttttgaccacagaatgactctaaattctaaaaatcaataaaaatgattatttttattataattatgttctgtgctttccaagtagaggacaacgaacacatctccttcggtatttgtccaataacatggtctctaggccaattaaaagagaattctgggccaggcgtggtggctcgcacctgtaatcccagcactttgggagaccgaggcagacagatcacaaggtaaagagatcgagaccatcctggccaacatggtgaaactctgtccctactaaaaatataaaaattaggggggcgtggtggcatgtgcctgtaatcccagctacacgggaggctgaagcaggagaatcacttgaatcccggaggcggacgttgcagtaaactgagatagcaccactgcactccagcctggcgacacagcaagactccgtctcaactaaaaaaaaaaaaagagagagagaattcttcagccaggcacagtggctcacatgtgtaatcctagcactttgggaggctgaggtgggcgaatcacaggaggccaggagttcaagaccagcctgaccaagatagcaaaaccccatctctactaaaaatggaaaaagtttagccaggtgtggcagtgcatgcctgtattaccagctactctggatgctgagatgagagaattccttgaacccgggaggcagaggctgaagtgagccaagattgcaccactgcactccagccacagagcaagactctgtctcaaaaagaaaaaagaaaaagaaaaaggaaatttttctagcagcaagatcaaatatacacacttttcttatgctgaatcaattgcttaaaaatcatgcttcattttactatacttggttgttcttccccgaacttttaatataacttttagggttggaattttacttcttttcattcttcttgtttaaaatgaaaaatgtatctcaatgagtttaagcattccactcacttcatcatggctttattaaaaggagtttccttttcttcctggaaaatgctctcttcctcagccgtaggttctgaaacttccctccacctccactatgtgtgtgtgtgtgtgtgtgtgtgtgtgtgtgtgtgtgtgtgtgtgtgtgtgtgtgtgtgtgtgtgtattgactctactactcactaggtcctatgactttgtttttcttgattttcttccttatttattggagaaagtcttcaagaaacttccaaagggtatatagaatgtagtactaatcacttgaatacctaaaaataatctttttctgtcttcagggctgacaatttgcttaggtatcgaattctacatacaaataaccttccctcacagttcttaggacatcattcattgtcttttaggatctactcttgatacctgattaaataccattcttgtttaccttaaatatccttctgtttacaggtgatgtccttcccccaccatggatggatgcatttacatgatcaaaaattatacaaggttgtttccaggtaaggcaagtttattttccaaggatgacaaaacccaaataccaaaacatgccacaatcagcacaagaaaggaagccgattttgaatgtaaacgcaaaaatatactggtttagccaaacaaatgacaccaagctcccaccaatattctaaaatatgagagtcaaaaagacaaaacaactgtgtttgccacacaattcaattagcatatatcctgaagagtgacatgagtctaagttccctcatgattcatttagcttgagcttctcaccacaggaagtgcgcctggaagagtttgagtatgcattgttcaagcaacaggacccctaaaggcaagcattctggtgatgaactgaatataaagaaaactgaataaaacatataacaaacatgtattttttaataagttaatgtctttagcatataacaagccatgtaaatttaatatgaaaaaaagaatgctccaaaagaaaaatgaactgttttataattcacagaagaacaaacataaatggccaaaacttttttttaaatatttaacatcactgagggaatataaattaaataacctattattcttcattggcaaagataaaacagataaatactgtgttgtaatatgttggagaaacaaatatttatagccactgtaaataagagaatgaacaaaacattcataaatcaattaggtaatattaatcataagtgaccaattctgctgaaacagtaagcaaacttttaaggattatatcctacgataattaatcaatcaaattattaagaacaaggaagcccattaaatgttcgttatttattaaaagctagaaaaaaatctaaatttttataagtttttagtccaagtcacacaaaaattattccaaattttgaattaagacagcagtctttattaccaaatctctatcattttaaacagaagataaaaattctcgtctgggaatcaatttgaaagttggtactaaaaagggcttatttcaaatttctaaaatacattaaaatttacataatttactatttaaatgtaatcagccatgtccataatcatgttaataacactcgaaagccttttgagattttgaaatgcaaaaaaaaaaaaaaaaaaaacaagtcaatagactaaaagcaattaactccaggaagagattttaaacaataaaccaatgtataaatgagcaaacacagctcacagctacagtatcaaacgattcagtgaccacccaagtacataacagctcagaaggaaaaaatcagttttctacaacaccttatgaaaaaaatttaaataagtgaccacacacattctcaatccatgctgagaaaagtgaaaataacagagaaaaaaataatctaaaaatgaagaaaaagcaaaaattgccaaatgggaatgtaatgtgattgacagtattcagaaaactaatgatagtaaaagctggggcaagaaaatcaggattacttggagaaaggaaatcagcattaaagaaaagaattacatacaaaaaaaaatgaaaaaatacagaaaggaaagaaatacagaaacttgtatctaataattaaactcttcatgtaaaacactgaaaataaatatttaaagatggatcataaagtacagacaattttgaaataaagactgaaaagccaggtgtggtggcacacatctgtaatcccagctgctcagaaggctgatgcaggaggatcacttgaggccaagagttgaagaccagcctgagcaatacagtgagctcccatctctaaaataatttatttcatgttagctgagtgtgttggcacatgcttgtagtcccatttactcgggagggtaagggaggaagatcacttgagccaaggagtttgaggctgcagtgagctatcatcatggcagtgcactccaaaataggtaacagagacttcattaatactggagccaagacctgctgcttgtaaccccctcacgaccgagagtcggcactccatgccccttcctagtgatactacctctgcaaccagcagagccgctgtgcccagtgtattccatcccagacctgagaatcaacctaccccgtggctcctactcccaggaaagctgcacgacagcaacaacaaatacccacagcctgggccacaaagccaatcacagacaccactgatatcaaatagagctgaagaaatcactggaaattcatactaccactactgcactaactcagaaccaaaaatcaaagcctactcaaccaacatgataggacacaactagcaggaaaaatgttatccctaattaacaaaattaacataaaatctgaagagctgattgtcccactagatttacagaaaccaaggtaaagacacaagaaacatgaaaaagccagaaaatatgaaactgccaaaggaagacaataatcctcagtgacagaccctaatgaaaaagataactatgatatgcctgaaaaagaattcaaaataatgatccttacaaaactcaatgagatacaagggaatacacagacaattcaacccaatcaagaaaacagtatgtgatctacaagaaaaattatatgaagtgataaatatcggggaaaaaaatcttggagttaaagaattcaatgaatgaaatttttaaaaatgtagtacaattgagagcactaacaataaactagatgaagcagaagaaaaaaaatctacattagaaggcagatcttctgaattaatctagtcagacaaaaaagaaaggaaaaaaagaatgaagaaagcctacagaaattatgggaaattattaagcaaaccacagccacattacagaagtcccaaaaggagaagatacaggaaagggcacagaaaacatgtttaatgaaataatagctgagaagtctggggaaagatatggacatccagattcataaagcttaaaggccaaatagactgaacccaaaaatatcttctctgaagcagaatatagtcaaactgtcaaaagtcaaagccagaattctaaaaacaagcaagacaagtgtcaagtcacatataagggaatccccactagactaacaggatttctcaggagaaatcatgcagtccagagagactaagatgatacattgaaagcgatgaaaagtgtggggggatgggggtaatggtagccaagaatatcatacacagcaaggctatccttcagagatgaaagagaaatatacacattcccagactagaaaactgaggaaattcatcatgactagaccgaacttacaagaaatgcttaaggaagtaaaaggatggtaactaccatctggaagtaaaaggatggtaactaccatctggaagtaaaaggatggtaactaccatcatgaaaacacacaaagtataaaactcactgatacagcagatacctatgagaaagtgaaagaaatcaaagcttatcactgcaaaaagaaacccacgaaactgtaaaaaaaattaataaaggaacgaagtatatataaaacaaccagaaaacaattaacaaaatgataagagtaagcccttacttgtaaataataactttaaatagaaagttttaattcaccaattaaaagataggctggataaataaactgaataaattattttgaaaaagatgcaaacacactacctacaagaagctcacttcagctgtaaagacacacatagactgaaagtgaaaagatgccaaaggtatgccatgcaaatggaaattcaaaatgagcagcagtagctatatttatatcagctaagacaagctttaagtcaaaatagtaaaaagagacaatgaaggtcattacgtaatgataaatggatcaaaactgcaagaggatataacagttgtaaatatatttgtacctaacacaggaacacctgatatatattttaaaattattatacctaacgagagaaacagactccaatacatgtatgagcctggaggatattatgttaagggaaataagataggcaaagaaaaataagtaccacatgttctcactcacatgtggaagctaaaaaatttgatctcacagaagtagggcatagaatagtagttattagagactagggagggcagagagattacaaggtaggacaactttggttaaaggatataaaactattctaatttgatcattacacattgtatttaaatattgctcaatgccccatagatacaattattatgtgttaatgaaaaataaaataaaaagccaaaatgtaaagagacctaaataaaaataaagtttctacatttccttagaaaaataaaatgatggccaggcatggtggctcatgcctgtaatcccagcactttgggaggccgaggcaggtgaatcacaaggtcaggagtccaagaccaacctgaccaacatgatgaaaccccatctctactaaaactacaaaagttagccaggtgtagcggtgcgcgtctgtaatcccagctactcaggaggctgaggcaagacaatcacttgaacccaggaggcggaggctgcagtgagccgacatcacgcaactgcactccagcctgggcgacagagcaagattccgcctcaaaaataaaataaaataaaataaaatataaaatgatgacatcagtagactagaataagtcacatgtatgtataccctaagcaactactaggaaaattatacaaaatatagtcaaaaatactatatattttaatctggccgaatgtggtggctcacgctgtaattccaacactttgggaggccaaggcaggtggatcacttgaggtcaggagttcaagaccagtctgatcgacatggcaaaatccagtctctacaaaaatacaaaaattagccaggcgtggtgacgtgtgcctgtagtcctagctactagggaggctgagacaggagaactgcttatatctgggaggcagaggctgcagtaggccgagatcacactgctgcactccagcctgagtgacagagcaagactctgtctcaaaagaaaaagaaaacaaaacaaaaaaacatatatatgaagcaaggtggaatctgaaaaaatgttctagtatacacaggaaggcaaaaagaaagaatgagagaaatgagaaatagaggaaaataaacagaaaacaataaataaaatggaagaaaagctgtaacatattcataattaaatgaaaattgttgaaatataccatttaaaggggcaaagttgggcagagtacataaaaacacgtgaaggtaatcctttgaaagcaaaagagtgaaaaatatataacatggaatattaatagaaagcagaaggagctgtattaatatcagataaggtgaatttcagagcaaagaaaattactaaacatgagaaaagatattatataatgatcaaaggagcaatctactaggaagacataggaatcctgtaaatacaaacaaccaaaaacagagtctcgaatacataaagcaaaactgatagagctggaaaaaaaattgatatatccacaactatacatggggatttcaaaagccctatctcaacaattgatgaaagtactagtggccgggtacggtggctcacgcctgtaatcccaacactttgggaggccgaggcaggtggatcacctgaagtcgggagttcgagaccagcctgaccaacatggagaaaccccacctctactaaaaaaatatttaaaaattagctgggcatgatggcgcatgcctgtaatcccatctacttgggaagctgaggcaggagaatcacttgaacctgggaggcggaggttgcggtgagctgagatcacgccattgcattccagcctggacaacaggagcaaaactccgtctcaaaaaaagtactagtgagaaaatcatcaagaatatagaaaatctgaacaacacactcaacaaaatcaaattaaaacatacaaatactacaccagaaaaaagtacccattgaatattcactaagatagaccacgtcctgagccatgaaacaaatctcaacatatttcaaagagttaaatcaatatagaacatgttatctaaccataattgaatcaaactattaatcaataacagaaagataatgagaaaatctctaagcacacttctaaataatccatgggtcaaagaagttacaaagaaagtctaaaactcataaaactgaatgaaaataaaaagacaacacaccaaaatatgtttgatgcagctaaaatcaagaggaaaaagaaactcatatcactacatgcttacattagaaaaaaaagtcttaaataaatgatctaagttcttatctcaagaaagtagaaaaaaagcaaataaacctaagcaggtagatggaaggaaatcataaagataagacacagaatttaaagtaggaaaatagtagagaaaatccataaaagaactggttctttgaaaacagatgaataaaatagataaacctacaggaagaataacaaaaatagagaaaagacacaaatcacaaacgccaggaatgaaaaactaacaaaaatagagaaaagacacaaatcacaaacaccaggaatgaaaaaaacgacattaccacaaatcctgcatctactaaaagattaaaaagggaatactacaaacaactttagacttacgaatctgacaagttagaagaaacaagccaattccttgaaaaccacacagtaccaaaatacaaccagtgtgaaatggataatatgaactgtcctataacaatgttaaaaattgaattcataattttatagctccccccaattccaaaacaattatctaggcctaattggtttaagtggagaattcaaaattctctaggcctaactggttgggtggagaattcaagtaaacttttaaaaaagaattgccaggcgcagcagctcacgcctgtaatcccagcactttgggaggccgaggtgggtggatcacgaggtcaggagtttgagacaagcctggccaacatagtgaaaccctgtctccattaaaaataaaaaaattagctgggtgtggtggcacgtgcccgtagtcccagctatttgggaggctgacgcaggagaatcgcttgaacctgggaggcagaggtttcagtgagccgagaccatgccattgcactccagcctgggtgaccgagagagagactctgtctcaaaaaaaaaaaaaaaaaaaaaaaaaagaattacacccattttcacaatctattaaaaaaaagatgagaaaatgcttcccattttatcaggcaaatataaactgaaactaaaaccagacagaaaaagattattgcagaccatcttctctcacaaatacagacataaaatacctacacaaaaattagcatatcaaattcaaccatatataaaaataattacatatcctaaaaaagtgggagttattccacatgtgcaacacggttcaacattcaaaaataaagcaatgcaaacaatcacatcaacaagctaaagaagaaaaatagtatgaacatatcaattgaggcagaaaaaaaaatctgacaaaatccaacattatttcatcaagggaaactttcccaacaaccaaaaaatgacagctaaaattattcataatgatagaagactaaatgctttacctctaaaattagtaacaaggcaaagatatccactctccccactctttctcaacatactacttactggaagttctagctagtacaccaccataagaaaaagaaataaaaagcacacatattggaaacaaacaaaatataactgttcctacttgctaatgacattactgtctgcatagaaaatcacaaagaatctacaaaagcctcctggaaaaaaataacagagtgaaccctagaagaaaacctaggccataccattcaggacacaggcatgggcaagacactgttggtgggagttcaaccattgtggaagatagtgtggcgattcctcaaggatctagaactggaaataccatttgacccagcaatcccattactgggtatatacccaaaggattataaatcatgctactataaagacacatgcacacgtatgtttactgcagcactattcacaatagcaaagacttggaatcaacccaaatgtccatcaatgatagactggattaagaaaatatggcacaaatacaccatagaatactatgcagccataaaaaatgatgagttcatgtcctttgtagggacatggataaagctggaaactattattctgagcaaactatcacaaggacagaaaaccaaacactgcatgttctcactcataggtgggaactgaacaatgagaacacttggacacagggtgggaaacatcatacaccagggcctgtcatggggtgggggcatgcgggagggatagcattaggagaaatctaatgtaaatgacgagttaatgggtgcagcaaaccaacatggcacttgtatatatatgtaacacacctgcacgttgtgcacatgtaccctagaacttaaagtataatataaaatataataataagagtgaaatagttacaggatacaagattgacacacaaaaatcaagctgtttataaatgctaacaattaacatgtgaaaacagaaattaaaatactccaaagaaattataattactcctaagacaattacttaacaaaacataaacaagagttatatactcaaaagtataaaatgttgatgaaagaaatcagacaacctaaataaatggagacacagtttatgttcatagattagaagactcaacatactgaagatattaattttccctaaattgatatataagtttaatttaattcctattataatcccatcaaggttttttctttttgtagacatagggaagcttattctaatttgtagtgcttttctcacttcatggtcacaataatttaagaaaataataatttgtagaacagctacttctagaacagctaaaacaatcttataaaagaagaacaaatgaaaggactcactctacttaatattaaagtctacatataactacaacaataaatacagtgtggtactgtagatggacaaaaacatagatcaatagaacagaatacagaacgcagaaatggaccaagcaaataatggctcacagattttttagaagcttaaaagtataattcaatataggaaatataaccttttcaacaaatagtgatggagcatttggacattcataggcaaaaaaataaacttccacttaaacctcacagcatatataaaaactaaaaaatgtatcacaggtctaaatataaaacataaaacttaaaaaaaaagtagaagaaaatctttagaatctaaggctaggattgacatcaaaagcaagatccctaacattagatacattgcacctcatcaaaattaaaaacttttgctatgcaaaagagcctgttaagaggatgaacagataaactacaaaccgtaaggaaaacactcaacgcttgacagtaaaactacaaacaatccaattagaaaatgacagaaggcaggaatggacatttcatggaagatgacatacagatggcaaataagcacacaaaatggtgttcaacatattagccaacaaggaaatgcaaatgtaaaccacaggagattatcactacaggaccatcagaatggctaaaatttaaaaacagtgacaacaacaaagactgataagaatatggagaaagtgaatcattcatacatttctgatgacaatgtaaaattgtacagatactctggaaaacagtttatcagtttctttaaaaaattaaacacacaattaccataatgacacagcaattatgctcttgggcatttattccagagaaatgaaaacatgtgttcacgcaaaattctgtatataaatgttcacagaagctttatttttaatagcccaaaactggagacaactcagatgtccttcaatgggtgactattaaagaaactggtacatccacaccatggaatactcttatcaataaagagctaataactactaatgaatgcaacaacatggatgaatcttcatggaattatgtttgagtaaaaaagatcaataccaaatattacatattgtaatccatccatttaacattcttaaaatgtcaaaacaatagaaagaaagaacaaatcagtgtttgccatgggatagggaaagaggtagagaatatgagagaagagttggtggaggctataaaaggggaagcaacacaaggaatttcatggtaatagaactgttatgtgtcttgactggtgtagtagatacatgaaaccgtatgtgagaaaaaaagaactaaacactaaacaaacacacaagttcaagtgcagaaatcttcacaaaatcaatggatgttatcaatgttaatattctaattttaatagtgtactataattttacaacctcttaccattgggggtaactagataaaggatacacaggatctgtctgtattattacttgcaactacctttgaatctacaattatctcaaaataaaaagtttaattttaaataactaaaatgaagaaacagaaatgataccatatactattgtaaaagttcagtaaggtgtgccatactaaattcgtatgtacctagaaattccaatctaaaatttcagattcccagaattaaaacatcaattatagaacttttttctaactatataaatcataccctacaaagcccctaaattttatatttaataatgaaattttttcttaatctgatatatatcttctcaattaatcttaccctcttataacagataaactaaagctaagttgcaagctctatcaaatcctagcaaattctgaatgagtaaagtctaaaattaccaaatatttaaatttaacttcaaggatacatttactgtaattatcacatcatgatgtaaattattgcaaatataagtataatcaaagctagagctctacttacgaatttactatgaagcactaaattactagtttattttaaattcctcaatttaaaacattaatataatcttaatctaacaatgttaaattacaagtagaatactaaaaatgatagaaatacttaaccaacagtaaattacaccaacaagccttaataaaatatatctaatatcttaatatatattaaatatacatattaaatataaaatatatcataatgtaccaaaaacaaatcatttgaaaaaaaattccataaagaaccaaaggcaatatattttcagttagaattcactcacaggattgaaagacaaacataatatatatatatacatataaatgtaaatgtcattaaaactaatatcattcttaccactcactatacaggttttcctgttcccattgtattgtctatttaaagatgttctcattactcatatgtaagtactccctctaaaatgcataaaattctctcaatgggattgttaaaagatctacagtacttcatggtttgagcagaacaaactatgacatgctgaaagaatgtttctcactgtgtggttctgtcaccacctacatactgagtttactattttaaataaatggtagtgacacttcacagtgtacagcattttagtatcaatacatcttcaaaaaaatttaaatctctatatattaccatcatttgacaaaaggatgaataggcaagcaagagttcattcaaaactatacccaactggatcaagaggtcaggagttcgagaccagcctggccaagatggtgaaatctcgtctctactaaaaatacaaaaatcagctgggcgtggtggtgtgagcctgtaatttcagctactctggaggctgaggcaggagaattgcttgaacctgggaggcagaggttgcagtgagctgagatcgcgccactgcactctagcctgggcgaaagagtgagactttgtctccaaaaaaaaaaaagaaagaaagatagaaagaaaaaaactacacccaacagattttattaactattagtcaaggtaagataatttttcatttattataatatctatcattgccactataataaattttgacacagaaataaaagttatcattatgtgtatttctgaacacataaaaggtcccatacatttaagttattaaacttctaaaaatatacaatctgccaggcgtggtgactcacacctgtaatcccagtactttaggaggccaaggtgggtggatcacctgaggacaggagttcaagacaaacctgaccaacatggtgaaatctcatctctattaaaaatacaaaaattagccgggtgtggtggcatgcgtctgtaatctcagctactcgggaggctgaggcaggagaatcgcttgaacctcggaggtggaggttgcaatgagccaagatttagctactgcactccagcctggacaacaagagcgaaactccatctaaaaaaaaaaaaaaaaagacaataaaaatatacaatctatactgtcagacaggatttttatgttcttcactaacaaggacaaaagaacatttaggcaaatacagctacttcatttaatcgacattttgtgaactatcttatatgccttaattttcaatattaagaatcaacaccaaatctttacagatagctactgtatcataatcaatattggccccagctaaatctatacaaaatttcttataaaaattaatatttttgaccattccacatatggagagagattaactggttggattactactttcttccactatcttcttcctcatcactgaatagatggtatgctagtatgttttttggcaaccctgcaagtatcttggaggtttgtttcaagtcttttattaagtgtatataacaataatccactttttaacagagtctgctgtagaataaaacatacaatttagtatatttctgtctcatcacattattaaatacatacaaaaatctcttttatacccacagatcaagcacaatcccaaaagacctgaagaaataacagccttccacatggttgtagtaatttatcaatgaaactaaaatacaccactaaaacattccctactctacataacaagcaataaacatggagccaactgtttagtacaatgacaaagagggcataaatttgttaaggagaaaaaaaattaacctaaacactgtcatcttcacaagacatatacaccaatgcaatcctcagatatgtaagaataagtcatacattatattaagcacttacaatgtgtcaagtagtgtgccctttacatttatcagtgaatttaatcctcttgataatcctataattttacagcagatatatgaagtccaggaaatggtgatatttttcagttgggtatattaaaactctaagttttatttcagaaaagtattcctattttaaggcagctaaattgttttgctttctgccaccaggggatgtacactatacaatatgactctaagcatacaatatatatttgtatgtgtgtatgtttgagtgtgtgtgtgtgtataacgtttactcaaatacagaaaaaaattaaattttaagcctgcatgatgactgactgtggtattgtgctgtgctggtaaaataggcttattaaattgtcatgctttgggaggccgaggtgggaggactgcttgaggccaggagtttcaggccagcctaagcaacataggaagacccccatctctacaaaaaaaaattttttcttctttttgagacggagtcttgctctgtcacccagtgcagtggcgcaatcttggctcactgcaacctccgcatcccgggttcaagcaattctcctgccttgagtagctgggatttcaggcccatgccaccacacccagctaatttttatattttagtagagacggggtttcaccatgttagtaaggctggtctcgaactcctgacctcatgatccgcccgccctgccctcctaaagtgctgggattacaggcgtgagccactgcgcctggccaacaaaaatattttaaaaaaactacatgtactctgtggcaagtgcctgtagtcccaagtgactagggaggctgaggtgggggaatggcttgagccctgttcgaggttacagtgagctacgatcatgccactgcactccagcctgaatgacagagtgagaccatctagaaaaatatatatatatttaaatatatactaaatatatatatttagtagagaaaaggttttgctattctcaaactcctgagctcaagggatcatcctgcttcagcctcccaaaatgctggattacaggatgagccacaatgcccagccaaaattatcaaatttttaacctatttaatgatagttagtatatgaaataatactaaaataaattccatgattgaaggaaactagaatatgtttataagagaaaaatttctggaattaaaataattatgaaaaattatttatattagatatcttttgaaaaacatattctacttcagacattttcaacattagtaatatgttaattagtttgatgattccttaactctgtgatgtttatgtgcttatgccttcacaattatgtttaacttatttaacttaactgtagatttcagctttaaaaataatcataaaactagatactgctcataaaaaataaaattcatgcaatttcagttattagcttttcccactagttttaaactatttccaggctccctccaaaaaagactatttatacttggacttccttttccattttatgtttcagattaggaacctaacacataatattaaacaaaaggttacctggacacctgttgcattcctagatcacaactggtttcccagtgagacaggacacccaacccaccaggcagctttatgccatgaacaataagattcaaaggtagagaataataagaaaaggtccaaaacacaggtaccaatcacttcaatgattaaattattccttaatttaacattgtgtctggcctgactaaaaacacactaagcccattaaggcaatatagctaatgttttcagatgatacagtaaagcttgctgagagtgaggaatatattaaaaataaaacaaaatgaaacttttatattttaatttttatcaagataataagaatggcgaagaaaacaagcaaaaaaaaaactacactcaaagtacataatgatctgttgccaatatgaaaacatacagagcaatgctatggcaatatcacactgtgaaggtgtaacttctacaggtgaatcattttctatctgctcctcaagtgcaatcagtaagtgaagccaaaaatgtctgcttttattattttctgcttaccttttacaatgttcaattttatgtgtgacttaaatgggccaaagggcaccccaatatctcatgaaacattattctaagttattctatgagaatgttttgggatgagattaacatttaaatcagcaaactaagcaaagcagatagccctccataatggcagtggttctaatccaatcagttgaaggccttaatagagcaaaaggctgaccctcctccaagtaagagagaattttgctgctttatagccttagaaatgaaacatgagctcttcttgcctattgtcttaaacctgaaacattgccttttcctggttatataggagcttctagccttcagattcaaattggtatgttggctctgcagatgttaaacttgaatcatgtgagccaactctttataataaatctctttctatgcaaacacccgcgcgcgcgcacacacacacactattggttttctctgaagaatacaccttctaaaaataaaaataaaaaaaattttttttttgagatggagtctcactttgtggctcaggctgcagtgcagtggcacagtctcggctcactacagccgccgcccccagagttcaggtgattctcctcccaaagaagctgggactacaggcatgcaccatcacaccaggctaatttttgtatttttagtagagatgtggtttcacaatgttggtcaggctggtctcgaactcctgacctaaggcgatccacccgtcttggcctctgaaagtgctgggattacaggcatgagccaccgtgcccaacctaaaaataaattcttaataatcaatttaccaataggattatcaaacttttgctatgatgataagaagatataatcttgcatgaaagcatttaattgaatgaattaacaagcactccaaaatatgctaagattaaaccctaacattttttaaaatcatatataaaatcaaaattctggaatccttttttataaaaatcatgagtttggtaaaaactgagttatttgaaatattacttactggtttgggttttttaattttattttttaattttaattttttattattgcagtaaccatttttaccaaaatagccattatttaactaacttcttgggactcattgtatcacagcaggagttatgtctttaaactcattctttttcctaggagaactacaaatcaacttatactgagagagttttcttttgcattctgaaaggtgatactgccccactgcatgaaatacacaggatgaaataggagtatgagccatgtattctactatagcaaaatactaaaataaaaataacaatatctggcatgaactgagtacttattacattccagacatagatggtgttctatatatatataatcttctaaaacagattatcttgctgatacaattatcagccacattttacagatgagaaaactgaggcccaaagataacaactattccgagaacacattaaagactaagtagctaaacctccttcaaaccccagcctaactctaagcccacattttgtttctctcttttattaatacataataatttatatattttggggatgtatgataatgtttgttacatgcaaaaaaaagtgtaatgatcaagtcaagataaatggggtaatccaacatcttgactatttattatttttatgtacaggtatcaagtcctctagttactttgaaatatatataatattcttactagtacagtcaccctattctgctatcaaccattggaatttatctattctacctaactatacatttgtacccataaccaacctctattcatggtccctttcccccaccctcccaacttaccctgtctctggtatctattcttctattctccatgtccattagatctagtgttttagtcccagatatgagtgataacatgtggtatttgtctttctgtatctggctaattttcatttcactgaacacaatgacctccagttccatccacaaactggataaagctgttagataaaatgacttccagttgcattcacaggattctgcagttagtggataaaatgttctatcaatgtctgttaagtccatttggtctaaagtctagtttaagtctaacgtttctttatagattctctgtctagatgacctgcctaatggtgagagtgggatgttcaggcctgcacaattattttattagagtctgtctctttctttagatctagtaatatttttgctttatgaacctgcatgccccagtgtggggggggcttatgtaacaattgttatatgaattcttcactttatcattattatataatgaccatctttgtctttttttatgggttttgttttatctaagtatatctacttctgctcacttttggtttctgtttgcatggactatccttatccatccctttactttcagtctgtatgtgtctttacaagtgaagtacacttctggtagtaaacatatagtgaaatcatgttttaaattcattcagtctatatatatatatatatatatatatttttgagatggagtcttgctctatcaccaggctgcagcgcagtggcacgatctcggctcactgcaacctctgcctcctgggttcaagcgattcccctgcctcagcctcctgagcagctgggattacaagcatgtgccaccatgcctggctaattttttgtattttagtagagacagggtttcaccatgttggccaggatggtctagatctcctgacctcatgatctgcctgcctcggcctcccaaagtgctgggattacaggcgtgagccactgcgcccagccaatctatatcttttaagaatttaaatcatttacacacaggttattatggatatgaaaggtttttccccgtcaccttgttaactgttgtttagttgttttgaatattctttgttcctttcttattttctgattgattgtccttgtagtttgctgattttctgtggtgataccatttgagtctttttttcttcctcatttgttgctttaccagtgagttttatactttcaagtgttttcataatggtaactgtcacccttttgcttgcttctaggtttaggactcccttgaatatttcttgtaagataggtgtagtagtgatgaattctctcagcatttgcttgtctggaaaagactttatttatccttccttcatgaagaatcattttgctagataaggtatgcttggctggcagggtttttgtctttgagcacattaaatatatcctcccattctctgctgacctgtaaggtttctactgagaaagctgctcttagtctgatggggctcttttataggtgactaaacgcttttctcttacaatttttaggattttctatgtgtcactgactttaggcaatttcactataatgtggggtggagaaacctttttacattgcatgtgattgggggtcactaggctttctgtatctggatgtctaaatctcttgctagacttaggaagttttaatctattaatttgtttaataagtttccgaaccccttcattctctcctcaaccttcagggatactaataactcatacatttgatcactatgtggtgtccatatatcatgaacactttgttcatcctttactccttttatttttgtctaagtggattattacaaaagatgtgtcttcaagttgagagtctctcttctggttgttctagtctattgctgaagctttcgagtgtattttgtatttcataaaaggaattcatcagttccagaattgctatttgattcttatttatgattatctgtttgataaatttctcataaatatcctgaattctcattttttgtattttcagaattctcttgtatctctctgagcatttttagtttaattttacattctttttccagaattgtgtaaatttatttttgattgggatctattgctgagggattatcacattctatttcatacttcctgtgtcctaacattgatatctgcacatctggtggaacagctgcttcttcaggttttctgaatttgccttcttaggggagaactttttctgaagatgtaccaattgtgctggttgggtaggcccctttggctttgattatcggtgtgtgcagtagtgtcatcactatatgatttctccagctgtaaatggcttcagtggtatctgtgctttccctggtggcttaggttatggttatcagtagatcctatggtaatgttttgttgaagacagagatgccaggtgggctagtcttaagatcccaatgatggcagtgatgagctgactgtgcctgatcatgggctccagggcagtgtacattggtatgagggtattactgggaccaggcaggccaattcgtgggcacccaggtggcctgctcaaatactggtagtggaatcagtggattgagcagatgagagggttcttgagtcactggataacctgtgtgatgtgggtgatggtagtagtgggatgatcctctggggcccaagtgttgcacactgatgttgacactggctacagtgcacggtcaccagccagagtcccagacacacaactctcaggttcttccactctctgtgacaggagcaccacagcactgcataagggttagggggaggcacccagcccttcacacacaaactgaagatcccactgccagtgagggtgccgtcaccactcacagccctggaaagctaaccctccagttcgcctgccccagcctccaggagcagcaacagtggctgggcctacagaagcgtctggagtgagacaaagggtccctctctacatgtgagagcctgaacacagtgataactcttacggggggaagagatcatactctctgtgtgctaggccgagcacacagtttatttcagctgggggcagggtcacttctcacagcctgagacaggagtctctcaggttttagaaattacgcgctttagttttctttgtacaagaggctgtctttggtgtgctgcactgtccttactccagggattagtactccctgtgggctagagtactgaggacccttcagcacttttgggctgggtccagccagcgctgtgctgctacagccctccaaatggactctgggagacatcagtggtggctcacaggatgtggaaatatgggagctgtggtcccgaagacaggatgcagctccatgacagctatgtgctcacgatggtgctcagctgcagtcactcaagtctcaggtgtgtgagtgagccagcgtgagtaccctgtccagtctaatgccttggtgaggtctttaaatggctactcatgctagtgtcagaatttgtgaaggtagagaagctctctctggttccaaccacagtactgtgcagtggcaatgttaactgctgaggttctctcacttactctttcaccacaatatcaagcccctatgggctcccaaccaatctcagccaagtctccaatggcttccttcttctgtgccgcagatgtttcctgtgacttctctgttggattctggtgttctctcctatatattctattcaaggtatgattgtctatttgtaattttagctcttctttctggagaggatgtgtgtctgatgccttagccatttaaactgggatctctaaacccacattcctaaccactatgataaagccacctacagctactctaaaggaaaatctttccctttctattaactcttttagaacagtatgactaaaactataaattaccttaaaaatagatgtcctttattgggataataaaaacacccttgctgtcactaataaattactaaaaacaactaaaatggatacattctcaaattcttactgtctaaaaaatagtcacctagtccttgcaaggtatttgaatatgtactaaattctaaactggctcaatgttattagaagtactctctttctttttaaagctataaaatccccttttcctatgtaaatattacctatgtataattgactttcataaaatatattgctcagtaaatactaacattatattcaattattgtctggagtgagtatcagttacaaaggataaaattctttaatcctttggtaaaatacattgatgttgttgaataaaaccaaagatacactttgggaggccgaggtgggcagattgtctgaggttaggagtttgagaccagcctggccaacatggtgaaaccctgtctctactaatactacaaaaatcagctgggcatggtggtgggcgcctgcaatcccagctactcaggaggctgaggcagcaaaatatcttgaacccaggaggcagaggttgcagtgagccaagactgcaccactgcactcctgcctgggagacagaacgagacgctgtcacaaaaaaaaaaaaaaaaagaaaagaaaaaaaagaaatacatatatatatacacacatgacctgaagttctaaattattattgggctgaacaaatgcttatcttcaaataactgctgcaatttttaaaaacttattttttccttacctagtcacaacccttatagcatgccaacttaaaattattccacttaaaaactttgaaaatgtaaacaaactatagctatcaagttacccacttttatatccaactgataattttcttcatttaagtggcaacttttctggagatctctgctgatcagaaactgttccatggtacaacagatttttatgaattttaacactcccaagtccttaaaatgcctagaaatagtttaacaagatacaaaacgcttcttaataaaatttaagagctgaatgaaccagtagtttacaaaattctgccttaacctgtctaacatgaaaatacctctcatgagaattttttcggatttaggaaaaaaatgacacagaaattagatgagaaaaagagaatggaaagaaattaaaattaacactggaaagaaagccaatgatacaagtgacaaatgctttatctaaaactatggataaaacatttgaaattacaaattaaagggaaatgatatatatgtttccaatgaatttttctgcatcagtataaacattattataaggccacattttaaataaaatagccccaccttataaacacttatgaataattctaataactgaaaagtttaaattactgataaggacaatctccattctgtactgtacataaatatgtcttcatttttacacaaaagtcaccattaattctcttttgaaatctgggaggatcaagtggcattaaatttgtagattctaatataaatattattagggaaagagctccttagaaacagaaaaatgtaatatatgtatttgataactttatatttacaggatatatacatgtgtgtgtgtgtacctgagacctaaattgtacccagtacctaagaccctaaattgatttactttacaaacacacacgcgcatttatttttaagtaaatcaatttagggtctcacgtactaggatggtgagaaggtggaaaattgggtttctactggacaagagaattaaggaactggagaaaataaagttaatcttaaagaagaaggcagattaggagtgtgctgggaacagacccccaaatctggccataagctgacctcaaaaccggccataaacaaaatctctgcagcactgtgacatgttcatgatggccatgactcccatgctgaaggttgtgggtttactggaatgaaggcaaggaatacctggcccaaccagagcagaaaaccacttaaaggctttcctaaaccacaaataatggcatgagcgatctgtgccttaaggacatgtttctgctgcaggaaactagccagagcccatccctttgttttggcccatcccttttttcccgtaaggaatacttttagttaatctgtaatctatagaaacaatgtttatcactggcttgctgtcaataaatatgtgggtaaatttctgttcggggctctcagttctgaaggctgtgagtcccgatttcccactccacacgctatatttgtgcatatgtctttaattcctctagcgctgctgggttagggtctccacgactgagctggtctcggcaagtggaacccaacgttggggctcaaacccaggtcgaaaggtcgccggggcaatggttggagaacatggaactaagctggaggacacccgagtgctcttaagcaatccccgtggtgagtaaaaaggggagctcagaagcatcagggtaacaatgggacaagtgtgggctctggttagttccatcttggaaccttttcacactgatgatgaggaggaaggagagtataacaaagtaacagagcaggtttgtttgccaggtaaagctaaagtggcaaaggaggcagatgttcatccctacccttctgcaccccctccttattttgaagaaaaagagtggcctaaccctccagatctttcttttctggaggaccttgggtgaaaagtagttgccccagtgactgttcaagcagtgcctcaagcaacctctctcagttctattcaggcaggaatccagcaagctagaagagagggtgatttagaggcttggcagtttcctgttagaatacaccccccgagatcaacagggaaatattatagctacatttgagccttttccttttaaattactcaaagaatttaagcaagcgattaatcaatatggaccaggttctccttttgtaatgggactgttaaagaatgttgctgtctccagtcagatgttgccagtggggacggtaggattacttctaggtaggtctggtttaaatttaaaaggagtgcaagtacaaacaggagtcattgattcagactacaatgggcaaattcagattgttatatctacttctgttctctggaaagtagagccaggagagcgtatagcacaactcctgactgtgccatatgtggaaatgggaaaaagtgaaactaaacgaataggaggatttggaaacacaaataaacaaggcaaagcagcttattgggtgaatcaaattactgatcaatgtcctacccgtgaaataactattcagagaaagaaatttaaaggttcagtagatacaggagtggacatttcaatcatttctctacagcattggctgttcacgtagtcaattcaacccactcaatttaacatagttggagttggtaaagcccctgaagcatatcaaagtagttacattttgcattgtgaaggacccgatggacaacctgggaatattcaaccaattataacttctgtacctataaatttatggggaagagatttattacaacaatggggaacacaagttctaattccagagcaattgtacagccctcaaagtcaaagtatgttgcatgaaatggggtatgtccctggtatgggactaggacaaaatttgcaaggtttgaaggaactgcttcaagcggaaagacaaagttcccgccaaggtttaggttatcatttttgatggcagccattgttaagcctccagaacctatacctttaaaatggttaacagataagccaatttggatagaacaatggctgctaagtaaagagaaaatggaggctttagaggacttagttcctgaacaattagaaaaaggacacatagcttcaatattttccccttagaattctccagttttcataattaagaaaaaatcaggtaaatggagaatgttaactaacttaagagccattaattcagttatacaacctatgggagcattacagccaggattgccttctcctgctatgattccaaaaaactggtctttaattgtcatagatttaaaagactgtttctttactatccctttagctgagcaagactgtgaacactttgcacttacaattcctgcagtaaacaacctgcagcctgctaagcattttcattggaaagtgttgtgacaaggcatgttaaacagtccaacaatttgccagacttatgtagggcaagcaattgaacctactcgtaaaaaaatttttagtgttacattattcagtatatggatgatatactttgtgctgccccaactcgagaaatactactccaatgttatgatcacttgcaaaattcgatttcttgcactggtttaattatagctcctgacaaaattcagactactccttactcctacttggggacctcagtaactgacagtacaattgtgccacagaaagtaaccatatgtagggatcaatttaaaacactgaatgactttcaaaaattaccaggggacattaattggatatgacctgctctaggcattcctgcccatgccatgagtaatctattttctacccttagaggagatcctagtctcactagcccttggcaattaacaaaggaggctgaggcagagttacagctgattgaaaggcaagtccataaagctcaaataaatagaatagatcccaagaagactctagatttgctaatttttccgactcagcattcacctactgttgttattttgttattgtccaagaacaggacttagtagaatggctttttcttccacatgtgaattcatggactctataactccttatttggatgaaattgctactatgataggaaatgggagaacttggattgttaaattacatggatatgatcctggaaaaattattgtccctctcacgaaggcacaaatacagcaagcttttataaagagtcttacttggcaaacccatttagctgactttgtgggtattctccatagtcattttttcctaaaatgaactgtttcaatttttgaaattaactaattggattctccctaaaataactaaattcaaaccaattgaaggtgctgagaatgtttttacagatgggtccagtaatagtaaagcttcttattctggatcgaaaggtaaagtttttcagatgccctatacttcagctcaaaatgcggagcttgtagctgtaattgaggtattgactgcttttaatatgcctattaatgtgatttctgattcttcatatatggtttattctacacaattaattgaaagtgctcagttatgatttcatacagatgaacaactgatgactttatttacccaactgcaaacagcagttaggagtagaatgcaccctttttacgttactcatattacagctcatacatgtcttccaggacctttaactgaagggaatcaaatggctgattgcctagttgctactgcagtatctaatgctacacactttcacaatttaacccatgttaatgcctctggtctcaagcgcagatacagcattacctggaaagaagctaaagctattatccagtgatgcccaacttgccaaatggtgcattcctcatcttttacaggaggagttaatcctcgaggactggaatctaattctctttggcaaatggacatcacacatgttccctcgtttgggagactagcttgtgtacgtgtatgtgtggacaccttttctcactttgggctacatgccaatcaggagagtcttctgcctgtgttaaacatcaccttttgcagtgttttacagtgataggcattacagcttctattaaaacagatgatgccccaggctatactagcaaagctctagctacatttttctctatacggaatattaaacacattactggcatcccatataattctcaaggacaagccattgtagaacgaatgaatctctccctaaaacaacaattgcaaaagcacaaagggggaaacagggactatggaacaccccatatgcaacttaatctagcattattgacttcaaattttttgagcctgcctaaaggccagatgctatcagcagctgaagagcatctacagaaaccagctgcaaagacagaagcagaacaactggtttggtggagagatccgataacaaaaagttgggaaataggtaaaataataacttggggtagaggttatgcttgtctttctccaggccaaaaccagcagccaatttggataccatcaagacacctgaaaccttatcatgagccagatgccaaagaagacattctagcaggattgcgaggaccccccagttgcagccatgttgacactgatgctgaggaggaccccagctgtcacagatggtggaagaaaacctgaggaaagcggacaacctgtcacaacgagtaatttaatgatagctatgatagcggtggtcactactgccgtgagtattccttcaacaacggctgacacagagaacaattattcttattgggcatatttatcaatcttggctggcaataatgcctggatgtaatcactctatgacacatatacacatgctttctggtctcagtatttaccataataaatctgctcctataattaggcgtaccgccctcaaaaacctatctgtaaacagaattggacctggccagaaataatgaacttacttgtttgggaagattgcattacagaacaggcagaggtgctgcgcagcgattcctatggaatcattgattggtcccctaaggggatgtttaatttgaattacacctctcagtctgcgtgccatggccacactatgttcagctggtccaaacaaaacaatcagatggtagaaacagtaaaaaatacggcaagttcctattatttggaaacatggtggtatagaggcacctcaacctcagatgatatgcctgctgtaggagcttaacataaggatttgtggaaactattaatggaaagaataaaaaaacatctagaaggacactctacaaacttgtctttggatattgcaaaattaaaagaacaaatatttaaagcatcccaggcacacctgaccttaatgctaggaactggagtgcttgaaggagctgcagacagattagcagctagtaacccattaaaaaggataaaaacacttggaagctgggtgatttcaatgatgattgtgcttttaatctgtgttatttgtctttgtatagtctgcagatgcagatcccgactcctgcgagaagtagctcaccgtgacaaagctgcctttgtttttatcactttgtgaaacaaaaaagggggacatgttgggaacaggcccccccccaaatcttgccataagctggccccaaaactggccataaacaaaatctctgcaacactgtgacatgttcatgatggccatgatgcccatgctgaaggttgtgggtttaccagaatgagggcaaggaatacctggcccacccagggcagaaaaccacttaaaggcgttcttaaaccacaaataatggcatgagcaatctgtgccttaaggacatgtttctgctgcaggaaactagccagagcccatccctttgtttcggcccatcccttttttcccgtaaggaatacttttaatctataatctatagaaacaatgtttatcgctggcttgaggccaataaatatgtgggtaaatctctgttcggggctctcagttctgaaggctgtgagtcccctgatttcccactccacacgctatatttgtgtgtgtgtctttaattcctctagagctgctgggttagggtctccacgatcaagctggtctcagcaagagtgagaggtcatcagtgagaaaagaggtttgtggccaagaaagtacatgaccaatgaaagagagttaacagaaatggaagggggaaaaagaaaggtaactagaataaaaactactagtttaaagagaatggaatataattaggaaaaagcaaagtaaatttgtccagaagaataaaacaaagcataggatcctttgaggaaagaacacaaggcaagaaagcaaattgctagtcatgaaggactacacaaagtggttatgttttactctatccaataaaacatgattaataagaaaccaatcaattacattattccaacagtattctaaataacattccagacagttccacttgtggaaactacagagcaaatttacttgacttggtcttctgctgtaaacaaccagaaaactagataaaatacatgaaataactggcctcacacaacaaacaaaaaccatgcataacagcaatgactgaaagaagcaaaataaagaacaccctatgcttatccagcctttcgtgtgtaggtactttctaaacagaataaggacagggatagaacatagaagccaaagttcaagagacagagacaacaacttgagaggtagaggcaactgaagtgcctaagtgtaccgaagagatagtatttcaccaagaaagaactttagaagtctccactgatgtccccttgaggctttggctaaatactaagttgaaaatgcataaagacaaaattcacaacacaagacacaaccataggggagcttgaagatgaacattctcagagctcatatcaagctgggagacacttaagttcacaccagtcagagtgtagacatcactgaatacaatagtggcattcaatagtgactcttggaaagcagtagactataatggccctagagtaaaaagtattccatactaattctaagaaaattttaaaaactcaacaagatcaagtgtatctataactaatctataattaaattgcctggaaaaacaaaattcaccattcttgaaggaagataacaaaatctagaaagtcaaaaacatgagtcacaatgactcaccaccaaataatttattagacatgcacaaaagcaggaaaataaggcccataaacagaagaaaagtcaatagaaacagatgcagaaatggcatagataacaaaacttggcaggaaaagcttttaaaagagctattataaggctgggcgtggtggctcacgcctgtaatcccaacactttgggaggccgaggagtgtggattacttgaggtcaggatttaggaccagcctaaccaacatggtgaaaccctgtctctactaaaaatacaaaaattagctgggcatggtggtgtgcacctgtaatcccagctagtcgggaggctgcggtgggaggattgcttgagactgggaggcagaggttgcaatgagttgagatagatcgtgccactgcactccagcctgggaaacagagcgagactccttctcaaaaaaaaaaaaaaaaaaaaaaagctactatgtattatatacaagctcaagaatttaaaatgagcagacaaaaaaatctaacaatgaaaaagaatcttaagaaaacttctatagcataaaaaatatatacaaagtgaaaaaactcactgcacagcttaacaaagtcagccaatgaaaagaaataataaaaatttgaatgaaaatcaaatagaaaacagaccaaaaacacagaaaaattactcaaacctaaacctgatctttttaaaagattgataaaatcaataaatcactagttaaactaactgagaatgagaaaaagaacacaaattatgaatctcattaatacaagagattgtaaaagaagaggcataactatatattctacaaacactgaaatgataatagggtaatattttgagttactttatgccaataaattcaacaactgagatgagatggacaaactccttgaaagacactaccaaaaatggtataaaactttgaaaatctgaatagccctatatgtattaaagatactaaactactaagtaaaaattttccaataaatatcattctgaattacaaagagcagttctccttctttgcactaatactgttgcctgtatttcccctgtatcagattacaatatacccgatctgttttatatttttaatttactatttgttcatttaattttatttgagacaaggtctcactctgtcacccaggctggagtgcagtggtgtgatcatggctcactgcagcctcaacatctgggctcaagtcatcctcccacatctgccctcctgggtagctgggaagacaggcatgtgccaccacacctggctaatttttttctattttttgtagagacagggtctcactatgttgcccaggctggtctcaaactcctgggctcaagtgatccttggcctcccaaagtgctgggattacaggcatgagccatggcatctggctgttttgcttttggctgattaccatttagatcagagatggcacggcctccgtaattcacctataggagccattacaaccaatcacaaatctttttcctactaaagcctagatacgctcccacagttcttctcaaacatttcaagcaaccaaggggagctgcatataaagataaaacctattagccacaccttatttatatccttaataataatttcattattcatctcatttttaaatcattatttttcccaaatagctttaggaaaattttccaatcttatgctctccttcattatttaaatcttacacaaaacagtactcttgtataagtgaacattttaaacaaacaaccccactaccttttcctgaaaactggtgctgtccacacaatactaaattcttcctggttaataccttctacactaattttacccaattttcttgcctatcatctctacctgtttaacactgtttagagtttaattgcatgtaattttctaactcattacctgttgctattacacctcagtaaacttctatctcttccacacccaacattctctttcacattaacctaattcctacttccctatcttctaaaatacacatgttcattcccttctccattccaatatttcagcacttttcattctgagggttaaatttcttgagaataaagttttctatgtgcttataatatagatgtcttataaatctatactaaataaatgaaaaatcttattatttgagctgcaatttgacataataaatacaaccagttactaaatatctatgaatgcacctaaaattcccatttcattatttacaaactcttccacagtaaaactagctttaccttcgagcattaaaagattttgtaaaaatcattttttaagattggtaatgctttgattggtaagatcataaatattttctacaagtttttcattgcaaatgtgtagtatttcagatatttcacatgttttttcaagaatatctattttggttaatctgggaatttaagtccctaaataataccattaccaaggtaatgtgtattctgagttccaaacaattaaaatacaagtgaacttttctttgtgtggtaaaatattcataacataaaatttactattgtaaccattcttaaggttaaaattcagtgacattaagtacattcacattattgagcaaacatcaccactatccataaccagaaattttctatcataccaagctgaaactccacacctattaatcaaaagctccaaattccccctcctctagcgcctggtaatctactttctgtcactatgaatttgaccattctaggtacctcatataagtggaatcgcataacatttgtccttttaggtctgctttatttcacttagcctaatgttttctaaaattatccatgacgcaagaagttcaaaatttaattcctttgtaaaactaaataatattccatttcatgtaggtaccacatttttttatccattcatccactgatggacatgttggttgtttccaccttttggatattgtgaataatgctgctacaaacactggtgtaccaatatccatttgatactctgctttcaattcttttgggtatataaccagaaatacaatagctggatcatgtggtaattctgtttaatttttgaagaaccactataccatttttcacagcagttcaacaattttaaattcctaccagccatgcagaagtgttctaatttgtccatatccttgccaacactgtttttttaataaatagcctttctaatgggtatgaaatggtaactcattgtggttttgatttgcatttgtctaaggactggtaatatagagcatattttcatattctaattggccacctgtatattttctttggagaatgtttattcaacatttttgcccattttttaattgggttgtttgggagtttttctgttgagttttgggagttctttatgtattctggatattaaccccttatcagacatatgatttagaaatattttcccattctgtggatttccttttcactctcttgacagcgtcctttgatgcacaaaacttttaaattttaatgatgtctaattttttatttttctttcgttacctgtgtttttagtataatatccaagaaatcactgccaaattcaatgtcttgaagcttcttcactatgtttcctttaagagttttacagattgagctcttacattcaggtcttttatcaacacaggtgaacttttaaccatcatcgtaacaggaagtagagtgcaactttgcactaagttaaaattatcagtcccatggtttgttttctccaaattatgaaaagcatttgctcttaagaatcaatatttaactcctactagcatgtaaaaaatagaaagtaatgcagattcaaaataggaaaataagacgctattacttcttacaaagtatgttctctgaccataaataacctagaaatcaacaaaaggaaggtacctgtgaaatcccccaagtaatcagaaattgtaaaacacgtatctaagcaattcacgggtcaaggcagatgtcttaaggggatttacacatatttttaactaaatgaaaatgtaaatacaacatatcaaaatttgtaagatacacctaatgcagtgctaagaggaaaacttacagcattaattacacatattagaaaagaaggtcttaagtcaataaccaaaccttccctcttaagaaactaaaaagataagaagtaatcctagagtaagcagaaggaaagatataattgagacagaaatcaatgatattgaaaacagagtaaaatcaataaaagtagaaactttaaaattgataattttccagccagtccaagcacaaagtacaagaagagctatcccaatggatcccacagatgctaaaaggataataaaggaatactataagcaaatctctgataataacgttgacgaattaaaagaaattgatgatttccttgaaacatacaaactaccaaaattcactgaagtagaaagagacaactggaatagccctatatttttcaggaaagagttgagcagcccttctgctatcttttggggagcctgactgcagagctggccttcagctggcatgtaaaaacttggcctttggggtgttcccatgtaacatggttattttgcctgttttgggcacaaaaccctgacataccagcttaatctaggtcttttgtagaaacactgtgatttattataaagacctgttctctttcttggagtcaagtattttactagttatggctagtcatgcaggtaccatgtgcctacatgaccaacccttaataaaaaaactcttaagtcttaagggggctttctagatagaaacaatgcacatgcattactacaattcactgctggaagaagtgtgttctttgtgcctaccactctcaatagggagaactttggaagcttaaatctagatgcctccagactctactggattctttttccattttttttttttttgtagacatagaaacccaattctaactttcatacaaaaaaggtaagaaaacaagaactagagccaaaaatgttgaaaaagaagaacaaaaagaattcactctaagacattttctgacttattacaaagctacagtcatcaagacagtgtggtaatggagaaatgttagactcaaaaatcagtggaacagaatagaaggtgcagaaataaacccaaagaaatatagtcaattgactgttcacaaggatgcaaagtaattcattggagaaatgacagacttacttgtcaacaaatagtgctagaataacaggacacccatatgcagaaaaaatgaatattgacccatactttacaacttatacaaatgtaattcaaaatgaatcacagacttaaatataaaacagaaaaaaacctatacaaaaaaactacgaatcacttagagaaaaaactgaagaaaatctttgtgacatttgtttatgtacagagttcctagatataataccaaaaccatgatatataaaagaaaaaatgaccaattgaatttcataaaaattaaaagcttttgctctgccaaagatgctgttggaaaaatgaaaagctacatatttccatgggagaaaatatttcaaattacatatgagacaaaggacttctaaaggactggtatccagaatgtataaaaagctctccaaataaaaaaaataagaaaaattatccagtaaataaaaaaggaaaatgctgagcagatacttcaccaaggaaggtttacagatagcaaataagccatcaacatcattagtcactaggaaatgcaaaagaaaatcatagtatgacacatcttcacacctattagaatggctaaatcaaaaaaagagaaaaaactggcaatgcgaagtgccaaagaggatgtggaagaattagaactctcatacattggtcaggcgtggctcttgcctgtaatcccagcactttgggaggccaaggtggatagatcacgaggtcaggagatcgagaccaccctggtcaacatggtgaaacccagtctctactaaaatacaaaagattagctgggcatggtggagcgcacctgtagtcccagctacttgggaggctgaggcaggggaatcacttgaacccaagaggcggaggttgcagtgagctgaaatcacgccactgcactccagcctggtgacagagcaagactccatctcaaaaaaaaaaaaaaagaactctcatacattactgatggcaatgcgaaatacaaaggacactctggaaaaaaatttggcagtttctaacaaaattaagtatatacgtaccatgcaatctgggaattctactcccaggaatttaccacttagaaaccacgtgatatcgtttctaaacttttttagcaacaaaaaaaggagttgaagaatagcagttattctttcccagatataagaatatttcatttaaatagtttcctgactaatattcatatgttaatcttccctcattttctgatttactatttcattcagagatttacttagcattattcttttattttgcttatagtttctctgtattgcattttattgtctatcatgtagataaaactgtaagcaaacattacatgctctaacttaagaaggaaatagtatatctagtcaaatgacatttaactcttctctgtactaaaaaggcaaaattactagtctttttattttagtaaaaattctaaaggaatacaaacaacagacacacaaaaaaaaaaagggaaaggaagacagcacacaaaaaatgttaatagcattttggaagctagaaagcacacccgatgaaatagaaacctaagcccagggggattaactcagcaacaatcaagaagctgtatgccacagaactctgacaaagttcgggacctgaaggcagggatccacggtggcactgacaaccaaaacacattgtaaattgttaaaggaaacagaactccaaatcccttttccaacctcactcaagccatgccactattccttcaccactcctgcaaaacactgaagctttcatctttggggaagttacaccagagaaacgctgtgtttgtgaacaacacatctgtgggggggtgggggccaaggggaaagggttgatgatatatcatactgaaaagaaaaatctacataccaatttatgagaaaacaccctcaaaccttataccagatcccttctgctcagctgcaaaagtatttacaaccaggcttataaaccctagacaaaagactaaaaggttcctgtttggagaaatgttcagtctaagagaaacaaaatctacagttaattctatcactgaggaatcctgcacaaaaaaacagccagatctctacctggtcatcctacaataaaggtctacctcaaatacattttgatgcctcggtcttaagtatgaacaggcatcaaaaatcaccaaagaataaggaaaagcctctgacatgaaagatggtgagcaaaacaaaaaggataaaaaggaaatcagaagcagcagaaaaataaagggagtaaaagaaaacttcatgcaatcatgacaaatatctaaggcagacagaatcttacatctatgaaaagaccccagaggcttttctttcaatgaaaaaaaaatgtaaaagaaacattaaggcaataaaaaaataaaacaataaaaaataaaacaaagacaataaaaaaagctcttacaaattaaaattttgactagaagaataaaaaactgttaaaattttccagataaagttgagaataatctcctagaaagtaaaacaaaaaagtaacaaatggaaaacaggatagaaaagaaagctgaaggaccacttcaagaaaaccaatagctgaataacagcaattccggaaagctgaaagatggaaaaacagaggaaacaggagaaaaaaattatcaaagaaataattcaaaaaaatttccaagaactgaaagataactatatctagcaaattgatggaaaaaacacccatctcacagcacagtatcacaaaatttcagaacacaacagaaaaaaagatcctaaaagcatcaagtaaggggaaaaaagggtttatagaaaagctcatggatcagaagggcataagactgcctttttttttttcttttgagacagagtcttgctcagtcacccaggctggaatacagtagtgctatcatagttcactgcagctttgaactcctgggctcaagcaagtagctgggactacacatgagtactaccacaccagctatttttattttttcatttttagtagagacagggttctcgctaagttgctcaggctggtctcaaactcctgggcccaagcaatcctccttcctcagcctcccagagtgctgggattacaggtgttagccaccgttcccagccaggacttctcaacagcaacaatacgagctagaaaagagcagaacaaagacttcaaatttttaagggaaaatgatttgcaatataaaacctattgtcaaataatatgaagtttatatacaaatgatcagagatgtatgtgtatgtatgtgttcccaatcattattctcggctttagaatttatgttatgtatattctttcaacaatagttaacatctaaattatgtttctctaaaaccaattagtctcttctttaaacttattctaaatgactaagaagagaagctgcacacacacacacacacacacacacacacacacacacagtgttcgatgccagcagaaagccaaagtaagactgaaaatttgctgtaattcccaggcacaggtgagtataaagaaatttatagctgtcaatttccatctgaacagcaatctagtcacagaattcttaagtcctaataaagagtaaagtaaaaattggaaaatttaaatgaaaagataggtataacagaaaaaaagaaggtattttcaagtagaaaaagacatgcttaaataaaacacctctctgatatctacagaactgaataatttctcaaaaaaattccagtgctagtttcattctaccataaacaaaggccagtgctagtttcattttaccataaacgaaaaccagagtaattgagtgaattactccttgcctgatgataaatgtcagtatttcttccactaggctagatggtctccaaaggtttagatatgaactgttcatagtataaaagaacagggtcccaagataagaaaggtcatcgataagaaaaaaagaaaaaaaacattatctcaaatattcaatttcaataaatcatgtttaaataaagaaaaggtcttataaatggggtgagggagtggaaataagaaaataaccagccgaccagaagatgaagatatggtcaactttagctccatgttccaaattaaaacaagaatggatgagaaaatactgcaaatgtttattgattctcaactatgttctacatataatattatagacatctcatttagctctcatcaacaacaaacatattagtctcatttgtagaaagagaactgtgctgaaaatggttaagcagtttgtccaaggtcacagttcatgagagagaggtaaactgacttaattctccagctgaagtcactctaatccaaaaatgagtaatgcacaatttaaaaatgaaatgttatacttttgcttcaatatgtttctgatgctgtgaaaccaatattatttctattaatgaaataatatgatgaaacaacacagattcagggaaaatagatatttgccaattgtctgtatgctgccctttagctcagttccattgaataattcactcgtttcctatgatgtaacaagcactgttctggcgctgcagttctgtccaatagaatttcacatccaggaatggcacagtagacacctaaacatgtaaatttgaaagggttaagagttctaaggtaaaatacaaacaggcacctgaaaaaaaaaaaggatgctgtcagaaaacatctatcagaagaggtgattcatgtgcaggttcttgaagtttattcattcattaaaagaatattttctacaagcctgttatatgccagtcatatttagtggtagagcaacaagacaaatgttagtgagtagggtcagggctgtgatgaataaaagaaaattagaaataatgtatcagaacacaagaaaaaacccaagaaaaaagcattcctatggattattcctgggaggactggattcaaaaactaacaagcattaatggagactaaaaatacaatatgtgagcctaaccatcttcagtgagttattcatagagggctatgagaggatgacttaatactaaccttaccaaaaagtagttacctagcatgacatcgaagctagaaaaaaaacaaaaaaaagactcatgtgtgacatgacatagatttttaaactcctgaataaaaataagtactataaacatataagtttattatttcaaataataaactaaaaatttcttataaaaaacaaagaattaaagaatttctctcaatatacaaagatttcttataactcagtagggaaatacaaatatctcaacacttttacatgggtaaagaatagcagataatttacaaagaattagtctgcctgaagtaagggcagagagctaggcatcaaaaacctatttttgtagacaacaatgatctgataactatctaattatcaagcactactgggcattttgaagtgccctccgaagaaaacagtgtaactgagcacaatttttaaattgtaattgatccacttctccatttaccccattccatctctagctcagaatcaaaacaaattataagctgggcccagtggctcatggctgtaatccaagaactttgggaggctgaagtgggaggatcacttgatcccagtagctcgagaccagcctgagcaacctaagcagaaccttgtctctacataaaacttaaaaaatcaactaagcgtggtcacacgtgcctagagtcctagctacttgagaggctggagcaggagaatcacttgagtccaaaagcttcaggttacagtgagctatgactgtgctactacacccgaggcaacagaccaagaccctgtctctaaaataaataaataaaatgttaagtactggaggaaaaaatacacacgtacacatatacgcatatatatatatatatatatatatacacacacacagtacatatatagaaccaaaagttatgtggaagcaccagaacaaaaatacatacatatatacacacgtacacatgcacagacacacacacattcatatctatacctgtatcattactgatatgtgaagcaataggcaccgaacaacaaacaaattcttttgaaatgtacctcatatgtttatattttatatctttaaatgagtattactacatttataatcagcaatgggacccactctatttggcaactgggataaaagtctggggcagatagttactagcattttagagatatttctactttaatcagaattgaaataggaacccaagttgtattaaaccaacaaagggagacttcgaccatgaaacactgacaaacacaggatagaaacagcagaaattagtaaactttagaggaggcacacaatttaaaagccatttccttttctcttgtactaatacatgattaaccacctactattagcaagctcaaatctgtgctcagcaatttaatacaaaggacactaaaatttaaaacagtctatgtcctcaaagaagtgttaatcagtaatgagataaaaactaaaactaaacacacacacacattagtatacagaaaggtcaaagattggcaaagattctaagtgcagaagttcagaaaaagtgacagttttattgttctgataaggaataaataaaattacagaagagagctgtagtatcaggtaaaatgccttccattgcaagaaacagaaaacgctgaatcacatgccttatttttatcacataagtaatcccaaagcagagcggaccaaggcctttccaactctaaaaaattccttcctctgctccccattatccaagtttcacttacccatggtttaagttacctacagtcaactgcagtctcaaaacattaaacagaaaattccagaaataaacaattcataagttttcaattgtgtgccattcggagcagcataatgaaatctcatgccaacctgctgcattcccctctggaatgaattctccatttgtccagcagatctacactatataggctatctacccattaatcactcagcagctatatagtttatcagatcaatttgctgtactgcaccacttgtgggcaaataatccttatattacttaataacggccccaaagcataagagtagtgatgctggcatattgctatgattgtactattttattagttgctgctaatctcatactatgcctaattaattaaactttatcaaaggtatatctgtatgggaaaaaacactatatatatagagagagagagtttggtagtatttgagatttcaggcatgcactaagggtcttggaatatattccccggataatgggggactatgatattgtcttctttctgactagctcctctaagggctataattaatttttaccatatttatcattatttaagtgcttgctctgcaccaagtattattcaaagaactttatgttcattaatttatttcattcttaacaacaacctataataggtttttttttttttttttttcagtcaggttctcgctctctctcacccaggctggaatgcggtggcaaaatcatagctcaatgaagctttgaattcctgtactcaagcactcctgccacctcagcttcccaagtacctgggactataggcaggcatcaccatgcccagcaatgtttttttaatttttgtagaaatggggtctcactatgttgccccagttagtcttgaactcctggcctcaggtgatcctcccgcatcaccctcccaaagtggttggactaaaagcatgacccatcaaacccagactaggtagatactattattggcaccatgtttcaacagctttattgagacataattcacaaaccataaattcactcattcaatggcttttaatatattcgcagatatgtgcaactatcaccacagtcaatttgaggacatttttatcacacagaaaaaataaaactagtggccgggcatggtggctcatgcctataatcccagcactttgggaggccgaggcgggaagatcacgaggtcaggagatcgagaccatcctggctaacacggtgaaaccccgtctctactaaagatacaaaaaattaaccgggcgtggttgcgggtgcctgtagttccagctactcaggaggctgaggcaagagaatggtgtgaacccgggaggcggggcttccagtgagccgagtttgcaccactgcactccagcctgggcgacagtgcaagactctgtctcaaaaaataaataaataaaaataaaactagtatcctttagctgtcattctgtcatggtctgttcagcctgctatagcaaaatgccatagacagtaatttataaacaacagaaatttatttctcaccattctggagactgggaagtcctaaaccaagacaccagtacattcattgatctggtgagggcctattccccatgaatgatgatttctctgtttcctcacatggaggaaggggtaaaggctccctcaagcctcttttataagggtattaatctcatcgatgagggcagagccctcattacctaatcacctcctaaaagccccatctcttcataccacaacaggaatgagatttcaacatgaattctggaaggacacaaacatcctgactacagcactctccaccccccaccctccctccactagtcttcctgaacctccaccaccaccactctaaggaaccacaaatctgctttctgttggtataaatttcccaattatagacttttatagtagtaaaataatatagtgactggcttttttcatttaccatagtgttttcaagcttcattcatgttttggcatatgtcagtacttccgtcctttttgtgcctgaataataatctgttatgtggatataccacattttgcttatccactcacgcactgatgaacatttgggatgtttcaaccttttggctattatgaataatgttgctataaacattcaagtacaagtttctgtgctgacatatgtcttcagttttcttgagtgcatacccagatgtagaattgctaggtcatgtcgtaattcgacgtttaatggtttgaggaactactagtttgtttcccaaagcagctgtaccattttacattcttactagcagtgtatgagggttccaatttttccacatcctcaccaacacttgttgctatctgactttttgatcctatcctagcgagtgtgaagtggtatctcattaaggttttgatttgcacttccctaatgattaatgactataatggctttttccaaacgactaatgttccatttgaatatgagccccatttttaccataagaaaaactaaggtacagagatattaaataaattatccaaggtcacaaacctactaagggaaatgctgagattttcacccaggcaccctggctccatgcccagaattttactatactccagcagcatttctaggcatttcattcaatgcaagaaggatagacatttccagagagtctgttttatcagtgagaaaacattctcagaagccattcaaactttttaaatgtcatacatagactaggtttgggtcacatgacccttcttaaaccaattactgataagaagaatacagtcatcgttgtttcagtctgttttgtgctactataacagattaccacagactgggtaatttataataaaaatttattgtctcacagttctggaagctaggaagtccaagatctggtgagggccttcttgctgcggcatcccataggtggaaggtgaaagggcaagagagaacaagagggagccaaactcacccttttataatgtcacagtcctacccatgagtgtgaagccctgatggcctcatcacctcttaacctttttcccatgtgacctgagaatactcactggaggcgattgtggctgcagcatttaccctgagatgactttgccacaaaatacctcatttttattatttttgcattggtctaatatattgactttggaaacaaaaaacatcattctatttacagcattctgtttttaatagtgatatttccatttacgaaacataataattctcgatcacggaaaacctcaaatcccagaaaacgtagcattcctaggcatgatgttaacatcgttcttgaataattgttagccaaagattcatttattgaatccaatttttctgaaatagatgattctgacgaatcagacaattctgatattagttctgtttagacacaactccaagaagagtttttatattttattttcacattgaaaatcagattttcttcagcctcaaagaacatgtttatgtaaaattaaatgagcgttgtcagcaaactgcacttttctaaatgggaaaagggttaaaagtccattttcttcattacaatggcaattaaatttcaacatgagttttaaaggggaaaaacattcaaaccatagcaaccataattggctgagattattcaagatttccaagcaaaatcagggctcttcgagaaaggtaaatcttgatcagtcaaatcaatagtatctgcaacaggtataaacaaacaaaactttgttttcactttttacaccatctcagaaataagaaaagttaccagatttaaagagttatcattcagcttccattgcgctagtgttatttgcataagtatgagtaaatggataattacaagtcagtcagtaaaagacttcacaacaaaggaagcaaccatttcaaaaaagcaaacaaacaaaaatttgcactaggttgaaatctgtctatggaaaactaagccttcactataggagcaaagcattaagtaaaaaaatttatttgcacgtttcctaatctttgaaaacttgagttatgtggaatttaaagctgaaaaacagcaattaatcattaataaaaaacatgattttaagttacaaggcttcaaagtatcccttccaataaaatgtcacttatataacaaaaatttttgttcattttaaagttttttgaggcttagataagcttgtcttaaaaatgtaaagtttaatttaaaataatttcaagtactatgttactctaacaactgtactaccaaccagatttcatcaatcatattttaaccatagtattagttgataatagacaaattttttcggtactttttataattttatacttgtaaattagtgtgtatgctccaaaaatgatgcagtacactttagcatttgcttgttgggaagagatgagaaaataagatgcgtttatcagatcttccaattgcgcaccagaaatactttcaaagtacctatgttgtaatttcatttttaaaaaattcttttcaattgggggggagggtgaataagtaattacaaagaatggctgcctttagatagaggtttatcatgtaattataataatgatcatttaaaaggatccaaaatgtctccactagtttaaagggctaggcagagttatttttaaaatcaaacgtatgtgctttttctgtttatgtctttggaaagaacattctgtataatgaaaaacatgaccaaatttttcacagtacatcactataaaaccctgtaattgacttttggggttggtttactctatatctatttttgacctcgtagaaaacagcaatgatgtggtgaaaggcccaaaatttaagtctcattgcaggataagactccatcctgattagtatagaagtatcatatttgtgctgggaaatgtgcccattctagtagagaaaactttagtgcataggaaccacctcttttctaatcaagccatgtaaaaactagtaactctggtgtctagtctgggccttggatggaatgtggatgttgtttacaccgatcccctccattaaaggcagcataatgttggtcttcaaaactgatgttggaaatgacaggttcattgcagttaatctgatggaaagtaacaatgtatgtcacaggtaaattataaattaacctttaaacatataaattatcattagatagttctttttctcttgtgttaacacagattaaataaagaacttaatctccttctaaaagctttgaattccgttactaaggaacaaactaatatgttattcctaacaaaaagcactgttcttcatcgaagtctaaaatacctctgaatgggtactcctgctttcaccagtaaaatttacatactaccaagtaaaataaacttatgttacatggtataaaaatcagccctgtaacacctaccacagatttatctcctgtgagttgactcaatcattccttcttttcagtaaataaactacattctacgcagggaactgcaggaaagtttttcagaggccaagtcaaagaatatgtttcacatggaaacttccaaattgacagcctgcccatttttggtaggtattaaagggtcctcagcactttatgaattagttgtggtttacctaaataatcatggccaaagctgccaccgtcactgcattcaatttattcctatcaaaaaaaatcaatgtacctttaaaaaaattaacacattttctaaaattcaggctaaataacagctttctagcagcattgctgattgaatgataatcataataaatcatttttaaaacaagtatattaaaattagtccatttttattagtctctcataacatagattatcttttaatctctacattttaacaagtaaaataatgaattaacattaactacacaagattatttaacagcttccaccaacttcttgaggaacagttatacaaagatgtttgaagaatatcctctttatgaaaaataaaaagctcctgaaaatccttacacgaattgcctatataaaagatcatctctgaacaatgaaggaacttcttaccaagctaacaagataggcaaataaaataaggtaaacaagtatgtgacagcctgagctatattagaagtcaccaagacgaaaatcactgaaagacttttgacccagctgcgtcaggtgtcctggtccaattccctgcaataaattcctcatctaaacagatgaaactgcccacagtatactacttgcacaccaccagataggccagctgatgtttataactgaaaataaagccaagaattagaagtatattttaaaataatttttttaaaaccctaccaatcaaaaccaatcaaaatttgccctggaacaggcaaattcacagccaaatcctactagacatacaaagaagagctagtaccaatcctagtgaaattattccaaaaaaaccaaaaatcaagtgggaactcctccttcaatcattctgtgactccagcatcattctgataccaaaacctgccagagacacaacaaaaaaagaaaacttcagatcaatatccctgatgaacagagatgcacaaattgtcaacaaaataccagcaaactgaatccagaggcacatcaaaaagctaactgacaatgataaagtagcctttattcttgtgatgcaaggttgggtcaacatacgcaaatcgataaatgtgattcaccacacaaaaagaattaacaaaatcagaaaaaaaaaacacatgatcatctccatagatgtagaaaaggctgtcaataaaattcaacatcccttcatgttaaaaactctcaccaatggcatcaaaggaacatacctcaaatagtaagaatcatctatggcaaacccatagccatcatcatactggacaggcaaaagctggaagcattctccttgagaactggaagaagacaaagatgccaccactctcaccacatctagtcaacatagtactgaaagtcctagccagagcaatcaaggaaagagaagaaacaaaaggcattcaaataaaaacaaaggaagtcaacctatctctcttcaaaaatgatatcactctatacctagaaaatctcagattctgctaaaaggctcctagaactggtaaacagggtcagtaaagtttcagaatacaaaatcaacataaaaaatcagaagcatttctatataccaataatgcccaagctgaaagccaaataaaaaatgcaatcccacctacaatacccacaaatagcatcaaatacccaggaatacagcaaaccaaggaggtaaaagatctctacaagaattacaaaacactgctgaaagaaatcagcgatgacataaacaaatggaaatatagtccatgcttgtggatagcaagaatcaatattgttaaaatggccatactgcacaaggcaatttacagattcaatgctattcctatcaaaccaccaatctcactcttcacagaattttttaaactattctaaaattcttatggaaccaaaaaagagcctagacagccaaagcaattctaagcaaaaagaaaagcatattactggcacaaaaacagatacacagaccaacagaacagaatagagaacccagaaataaacccaagcacctacaaccacctgatcttcaacaaagtcaacaataacaagtaatggggaaaggactccccattcaatgaacagtatatgataactggcttaccatatgcagaagattgaacctggaccccttcctttcaccacatacaaaaatcaactcaagatggattaaagacttagatgtaagacctaaaactacaaaaactctagaagaaaacctagcgtacctatctggacatcaaccttagcacagtttatggccaagtcccctaaagcaattgcaacagaaacaaaaattgacaagtggaatctaattaaacttctgcacagcagaagaaattatctgtagagcaaacaatgtctcctacaaaatgggagaaaatattggcaaactatgcatccgacaaaggtctaatatacagaatctaggaggaacttaatatgtgaaatacaaccccattaaaaagtgggcaaaagacatgaacaggagcttcttaaaagacaacatacaaacagccaacaaatatatgagaaaatgctcaacatcactaattattagataaatgtaaatcaaaaccacaataagataccatctcacaacagtcagaatcgttgttattaaaaagtcaaaaaataatagatgtaggtgaggttgcagaaaaaaagaaagcttacacactgctggtgggaatgtaagttcagccactgtggaaagcagtttggagatttctcgaagaagttaaaacagaaccaccatttgacccagcaatcccactactggatatatacccaagggaaaataaatcattccaccagatagacactggcacacatatgttcagcacagcagggttcataactgcaaagacatggaatcaacctagatgcccatcaagagtggcctggataaagaaaatgtggtacatacacaccatggaataccacacagcaataaaaagaacgaattatgtcctttgcagaaatacggatgcagctgaaggccattgttctaagcaaattaacaaaggaacagtgaaccaaataccatatgttctcatctaaaagtgggagctaaacattaggcagacatggatataaagatggcaacaacagaaggtggaaacttctagagggtgggtgagggagttgggtatgggttgaaaaactacatattgagtactacgtttactacctgggtgatgagataattcgtacaccaaacctcagtaacatgcaatttacccacgtaacaaacctgaacatgcacccctgaatctaaaataaaattggaggaaaaaggctatcatttgaaaagctacagaaatgaacaaatgtaaaaaacggacttgctgcatgatgataaagggaatgccattcttgtatccctacagtctcaaatccaacaaaagaaacaaacatagtcccttctcaccccccaaaaatgtgctttttcttgccataaaatcgtaaccatcacacaaaggcaccttggtgatttcataacattgtatattatagtccattttctattaaaaataccactaaagtaaatttttaggaaaattatgttacctgatcagtaacttgtacttaaacatcgattatgtacatcatttgaataccttccagaggatcgattctccaacataaaattgaaagaaaaccagatccaattaaataagcaaattcaatttacagaaaaaaattacttgtttcattaagtcaaacattgtggtggtacaccagagaagtagaaatctattagctatgaattaattaatgaaaaagaaatgaaaacacttattttttaaaaaatttacataagcattataaaacagaaatgacaaagtgcatttaaaaaactgattggatcttgaaatctgtattttttagaaacacccagaataagatttcagaagaagtatttttatatacatttttaattgttgtggtgtaaaaattgttgtgggtaaaagttcaccagccagtcatttttctttcattttctaacttcctcaagaaaactggctgggcacggtggctcacgcctgtaatcctagcactttgagaggctgaggcaggtggatcacttgagatcaggagttcaagaccagcctggccaacatggtgaaacaatgtctctacttagagtacaaaaattagccaggcatggtggtgcacacctgtagtcattaagatttaatgaacattggttataaggttcctgttgtttaacttaataaacaaagcacaacagttcatcagctataccaaccctaaactgtctagccctgcacttcttgtgaggcaggataaaataaataaaacatcacttacttaagtcactatttgttatgttttcattacaacaagtctaatatgagcctaactcttataatatttgctaccaagaaaggaagggagggaaagaaagagaaaagaaagaagggaggaaggaaggagaggaaagagacaaatgaagacaagtagggagacgagcaaaatttagaaaacatgagaactagtttaaagaaaagagaaactatttttaagtgagagaaggcaaaacatatccgaacaaatgtaaaaaggataaacatctattaaaggaaaaaaatcactttaatgagattaatttgaactgaaatttcccctatgaagtattggagtgagaagacaacagctctagttacaatgaattttccttgatatacacacaattatttcaaatccagtgcatttcctcaagaaaatcttaattattcagattaaagcaatatttttggaaatgaatgaaatacatacaatagaaaagacctctcaataggacacctaatattatcagtgtattttaaatgatcctcaattttaataaaaccgtactaaacataattgaaaatttttcttaggtaagaccttatgtcctttccacatactttcaattctactttgttatatcacaaaagaaaccttgtatatttcattcttagtttttctaagttgttgacagatggagaatgtttaactgaactttgtcctgtcaaacagaatcaactactaattgttttggctaatgatatttagcatgagtctagtccggctaggtcttaaataactttcaaaagttttttaaccttcgtcacttcctgggatatacatcttagcaatcacaaccttgagctaagccaagaaaagactgcacattgagcaacactggtgatatatttaaatacattaaggttaaaatctagtacttttgaaaaatccttaaatatataaggcacaccaaagtagggtttttacttttacctttagaaataaatctgcagaaaaagtactaacagtattacatggccaagaaaaaatatcacgtaaaattagtgtgttccctgcagcattccaacaaaaattatgccatttggatagaggtactgaatatattatgcaagcaagaatgttatgtttgaccaattaatctccttaaagtagttaaaaagatcacactataacaataaaatagatgtttgagaagataaaatatatcaaaatgtatctaccaaaaagtgatcaaaaagaaactcattcatatcttttgcccaaatataagtcacctttcacagaattaatgttcagaaacagttgcctcacattagaatcctaacaaagattctcatattacacagtaccaccacgattttttatttttaatcaaaaagtaacatttgagaaaaatacactagcctgaattgacctcaatcagttggaagcttatagagttatagcttgaaaacttataaacgtaacctgacaattttttttttaagaaagagaaaagccacaaggaaattcaaaatggatttagccgttattcccgggagaattactttacaattccaaatgctagatgttactgtaaaaattttttttaaaaatctagaaacttcaaaagaaataaaatacttacaacatggacatcataaataatgagtgcttaggacttggtaaaaatttctaatgatttcgtcaaagtgatacttaacctcaaacaaccaagaagaaataaaaatcatataccatggaaaactcagttgatatcttaaaaaatatttctaggattgatgaatacacttaagtcaaatgcatgtaacaatatgaaaagactcaagaaatttaaatagaaaaatagtatatttaaattaacatttatatgatttgaatgtatattaaattattaaatattatgaatagacatttgatgacatctatatccctaataattttcacattcaactaagtaaacaactttttaaaatcttctcatctgataaacagaaatctgccttatattcagagacactatattcagtcatatataaaaactctgaggcataaaatgaaaaatattttttcacatatttacagaggtagccattaaggaacatcttctttacaaattatgttggcatattcaataaatgagtacagcttaagcattcctaacctgaacatccagaatgctccaaaatccaaaagtttttgagcaccagcatggtatctacaaggggaaaattccacaactgacctcatgtgacaggttacagtttacatagtcaaaactgttcagcaaacaaaattattaaaattatggtataaatttaccttcagcctataagtataaggtatatacgaaacataaatgaatttcatgtttagacttgggtcccatcctcaaggtatctcattatatatacacaagtattccaaaatatgaaaaacaaactcaaaatccaaaatacttctggtcccaagtattttggatatgagatactcaacctgtattattgaaaaggctgaccatgccacacatatctccgattttaatttatataacggatttagagaatacgcattttaagacctaaaattcatgccctaattaaggagttaacaaggacatctaaaatcccttacttcttcaatctattccttttatagagtaaaaaggaaaatatttaattctctctcccatattcatacataaaaatatgcacacatttctgcacatgcatacaagtgcaatgtttttattgcaagccttaaaatgatcccaatgttgtctgccagggcagtaaactgaaagttattgaattaaaaaatatatttgaaaatagttgagatattaagaaattattttaaaaacttggctaatattcaatttcttagtgttattcttcagtgcctaatacctatctcctttgaactctcacactacgatagattacaatatacaccatctacatccaatatattgcacttagcagagttacttctctgcctcttgactttaaattggccaatgataaataggcagtagtgacaaaatgtgccagttaagagcctaggccttacaaggacttaagaggccctctggagacaccaccatcaccaaaagaaaaagaaaaaaagcatgacctaggttgccccctaatccaaaagtaaagatgaaagtcatggggagtagcaccaacccagcctacccacacatctgcaatgcgaggcagagctgccagctcacatacaaataattgttgccactgagctacccattatttgctatgcaacaatagtaaaaagagttataggtacattattctcattgacattaaggttgaaacatcaacagtatacaacaatataaaattagttctctttccatagaatgaaaggccttgatattcaaagttaaaaaacaaatgaaatcattaaggtaaacacatcaatggaaacaattagttccttcttttatctggaatacatatatgcaatcatagtcctgctgctatgacatgacagactcagagacccaaataatttatatcttgtaattacaattcacacttttagaaattaaaaaggggtgcgtgtggaactctgaaattaatggcaaatcctccaaaacataaaaatgccatcaaacttgaatgtcaaatatttttccacagcttagcacctagatacatgatttacagatctgcctaaatagagtaaaaacaacaacaaaaaacatgattctccataaaagcacaacagaaaatccttaaaatattttttaatgaacgattcggataaattggagatcatttaaaatacaatctccaaaacataatcaggacattcttatatacatcaactgacatgaatttttattctcactgtaagcaattatacaagtgtatagtatacctacttgtaaaaagggtctaaagtaaactacagcagaggcacacagaaaacaaaaaccataactattcaacaaaactaaatgttagataactaagaagaatgtgtacacatagaaaacaaaaaccataactattcaacaaaactaaatgttagataactaagaagaatgtgtgatagtttctgaaagaaacttatttcagataacctgacaaattgaatatggatttttactctgaacttcatcctagtcaaaattattaaagatttaatgaatatattggttaaaatgttcctactgcttaacctaataaaatgaagcacaacaattcatcaggaaaatgtaacttttttcctgtcttcaaaaagatggtgtcatgcagagctttatgaaagagagacatgaacattataactgaaggtattgttctggaaagtcaatcacctagaaagccaaataagtaaagcttgggtatatcatactccaatcaccacagctagtgaaaagaaagaaatttgagcagcacatactaaaatatgtttcagagaaggataacggcaaaacatggtaacaggtatcgtcaaatcaaatggatactgaatgaactaaatttgggaaacccttagttgaacaaaattaaatagtttccttactgtaggactatttggagcctttaatatggtacctacactgttaagtacaaataataccacattcctcatttgtttaacaccattttatcaagaagcatctgaaggaaagccttatttagaacatattttagaaaacgctaaagaaacaattacttcctcagactataccattttaatcatcaaaattattagtactgttgtctcaccatgacaactacaatttgagagtctactaagctctgagtattaggcacgcactttatctctacttaaacagaatcatttgtaaatctctcaaagtattatcccctcaaccgacatttgaatggttaggaaagacaattccctctacagagatcccttccacagtctgacaggtaaacaactagtcaatcttcaagcttcacaatatctttaagctattgcacttaccacgttatcaatttaattgtttgctttatacacttgcctcccatatgagacagatgtttaaagcgcaagggttattgatcatttaacaattttattgagatataactcacataccataaaatccatccactgaaattataccattcaacagtttttagtatattcatagttgtgcaaccatcaacacaatctaatttcagaacattttcatcactccaaaaacaaaccctgtcctttaacagtcattcctctatcctgaccctactcactccctgctcccagccctaggcaaccacggatctatcctgtttctatagatttgcctattctagatattacaaataagtgaaatcatgcaatacgtggtatttatgactggcttcttcaacataatgtttttaagttcatatgaagggacttcatatgacaagttaatggaaaatgtaattgaaagataaaaataaaagaatataaaccttatgttcaacataagctccatcaaggtcaagacacttgtaaatgatgataccagccacttattactctatccctaaagaactgagagtcctgggaatttagccatgtcagtgcagtctttttttatacactattaactatattaaaaaaaaaagtggttgacagatatggtttggctgtgtccccacctaagtctcatctttaattcccaggtgttgtgggaggcacccagtgggaggtgactgaatcatggggggaggactttcctatgctgttctcgcggtagtacataagtctcacgagatctgacggtttgataaggggaaacctgttttgcttagctctcattctctcttagcctgcagccaaccatgtagcacgggacttgctcctccttgccttctgccataattgtgagggttcctcagccacgtggaactgtaagtctaattaaacctctttcttttgtaaattgcccagtctggagtatgtccttatcagcagtgtgaaaatggactaatacagtaaactggtaccaccagagtggggcactgctgaaaagatacctgaaaatgtgaaagcaactttggaactgagtaacaggcagaggctggaacaatttggagggctcagaaagacaggaaaatgtaggaaagcttggaactccctagagacttgttaaatggctttggccaaaatactgataatgatatgaacaatgaactccaggctgaagtggtctcagatggagatggggaactttatgggaactgaagcaaaggtgactcttatgtttcagcaaagagattagtggcatcttgcccctgccctagaaatttgtggaactttgaacttgagagagataatttagggtatctgacagaagatatttctaagcagcaaagcattcaagaggtgacctgggtgctgttaaaggcattccattttaaaagggaaatagagcataaaagtttggaaaatgtgcagcctgacaatgcgactgaaaagaaaatcccattttctggggagaaattcaagccagctgcagaaatttgcataagtaacaaggagctacatgttaatccccaagataatgagcaaaatgtctccagggaatgtcagaggccttcacggaatcccctgccattacagttccagaggcctaggaggaaaaaatggtttcctgggccaggcccagggtccccgcggtgtgtgcagtctagggacttggtgtcctacgtgccaggtgctccagacatgactaaaagaggccaaggtatagctcgggctgtggctttagagggtggaagccccaagtcttggcagcttccacgtggtgttgagcctgtgggtgcacagaagtcaagaactgaagcctgtgagcctccacctagatttcagaggatgcatggtaatgcctggatacccacgctgaagtttgcagtaggggcagggccctcatggagaacctttgctcaggcaatgtgaaaggaaaatgtgtggttggagcctccacacagagtacctactgcggcactccttggtggagctgtgagaagagggccaccatcctctagaccccagtatgacagatgcatggacaccttgcattgtccatctggaaaacctgcagacactcaattccaccccatgaaagcagctgggagggaggctgtaccctgcaaacagaggggcaaagctgcccaagaccatgggaacccacctcttgcatcagtgtgacctggatgtgagacatggggtcaaaggaaatcattttggagcattaagatttgatggccccactggatttcagacttgcacagggcctgtagcccctttgttttggccaatttctcccatttggaatggctgtatttacccaatgatgtactcccattgtatctaggaagtaacaaacttgcttttgatttgacaggctcataggcagaaaggacttgccttgtctcagatgagacttgggactgtggacttttgagttaatgctgaaatgagttaagactttgggagactgtcgggaaggcatgtttggttttgaaatgtgaggacatgagatttgggaggggctagggatgaaatgatatggtttggctgtgtccccacccaaacctcatcttgaattcccacaggttgtgggagggacaagtgggaggtgactgaatcatgggggcaggtttttcccatgctgttcttgtgatagtgagtaagtgtcacgagatctgatggtttgataaaggaaacccgtttaacttggctctcattgtttctttgcctgctgccataattgtgaggcttccccggccatgtggaactgttagtccaattaaacctctgtcttttgtaaattgtccagtctcggatatatctttatcaacagcgtgaaaatgggctaatacattgacctttaaagacagtttaagattagtaaagaaaaagaagtcagaagaagctgaatcaggactgtaaggtggatgcctaatgatatctcatggaaactctcacaaaattgctcttgattggaggaaagacaggagtaccgtcctggtggagaaggattctagctttaccaggcatttttttttctgctaaagctttggctgactttctcaaaacactctaataataagatgttatcattctttggccctccagaaagtcaacaagcaaaacgcctcaagcatccccaaaaaaactgttgccatgacttctgctcttgaccagtctgcttttgctttgcctggaccacttttacctcttggtagccatggtttttattgttctttgtctttaggatcatactagtaaatacacatttcaactcctgttacaattctttgaagaaatgctttgagatcttgagcccatttgtttgaaatttccactgaaagctctgttcttgtctgcagctgatctgggtgcagcaaccttggcacccatcgggtggaaagtttgctcaactttaatttttcagtcagaattgtataaggtgaaccaattgagatatctatggtattggccagtttctgctgttgtcaatcctcttcgataaggctacaaacaagatacattttttccttgaaaattgatgtggatggtccgctgctgtgggtttcacagcatcgcctcatcccttcatgaaatgagacgttcatttgtaaactgctgatctcttggggcactgtcgtcctcatatacttcttgtgaagcatcagtgatttcaccattctaccacccaagcttccccataaatttgatattagttcttgcttcaacttgggcagaattcatgttgctcttttcaaatggatgtcttatccatcttagtccctcaaactagatcctgtcatacatgttataacaagttagtaagagtttattttgttgtttaaaaaaaatgtgaaacccaggcatagtatttcataattcacattttccacaaacttttaaaagaccccttgtatatcagtaattaattcctttttattatcaaataacaatatttaattgtatgactcctccacatttgctatccattcatcaggtaacaaatatttgggtcatttttattttttgactattagaaataatgctgctacaaacatcatgtacaaattttgtgtggacttatattttcatttctcttcattctgcttcactaggagtgaatctgctcgatcacgtgggaaatctgtattcatttaacctctagaaaaactgctaaaaatgttttccaaactagccacaccatagcacattcccatcaacattgtaaggtttcaatctctccacatcatcacatttgttatctttttgatcatagctatcctagtgggtgtgaagtagtcatcattgttgttttgatttgccaatagctaatgacattgagcatcttttcatgtgtttatttggccatttgtaaatcttctttggagaaaagtctattcagatcctttgcccattttttaattgtaatgtctttttaattgttgacttgtaagaggttcttcacagatacaagtaacttacaaatttgtgattttcagaaattttctcccattgagtgaactgtgcttttatcgtcttgaaagtgtccttaaaatacaaaaacttttaattacaatgatgtccaatttaccttttttcctttgttagcttgttatatctaagaatgctttgccaaactcaaggtcattgtgttatatctaagagtgttttgccaaactcaaggtcatgaacatttactcctatatttctaaacattttatagtttgagctcttatatttagatctatgatccactttaatatctatgtacggcatgaagaagaggtccaaattatttcatgttgttccagcaccattccttgaaatagctattctttcccttttgaattatttcagaacctttatcaaaaatcagttgattagctgggaactgcagctcatgcctgtaatcgcagcactctgggaggctgaggcaggtggatggcttgagcccaggagtttgagaccagtctgggcaacacggtgaaaccctgtctgtattaaaaatatttttaaaatttgccaggtgtggtgttgtatgcctgtactcccagctactttggaggctgaggtgggagcatcacctgagcccaggaggtcgagactgcagtgagccaaacatgcactgtggcctgggtgacagagcaaaaccctgtttcaaaaaaagaaagaaaaggtgttggacattgtcaagtattaatttttgtatgtatctattgagttgatgctttgatttttttctttttttctattaatgaggcatattatattaattgatttttggatgctgaaccaactttgcattcctgagataaatttccctgaaacttggtatatatgttttatatgctgctattattttgttgagaatttttgtacctatattcataagcgatagtagtgtacagctttcttttcttgcaattactgttttttatatcacagtaatattaacatcacaaaataaactgggagatgaaaaagtagtgggcttggtgactgggaacatgagggaggattctaagatgaaggcaatcttctatttcttggtctgcttacttgtttcatgactatgttcagtttttcaatattcattcatctataatattcttataatctctgttatttttgagatgtatgttttactttaccatttttttagaaaaagaaaaaatcattatgacatatttctaaatttgttcttaaaagtgttctttttaaaattatctgttacacattgtgtaaaattattgtcagtattcatctaaagtatcacgtcttgaaagacaggaaaagaatgaagaactgtcacagatttgaagagactaagaagatagaatatttaaatgtaatgtgaaatgacagactgattcctggaacaggaaaattccactggaggaaaaactggtgaaatttaaataaggcctgtaatttagttaatagtatgataaaacatagcatttcctagttctcatatttatactttggttaggtaagttgttaatattaggggaagttgggtgaagagaatacttaaattctccactctattgttgcaactttttagaatgacataaattatttaaaaataaaaaggttttaaaaatattaccttgtgactgaataatacatttatctagctcaatattcaataggttaaaaaattaaaaaagaaacacacactgaaaagtctccctcctattattgtctactaactatctagttcccttactgaagaacaaccagtattatcttttttctattcccttccagagattattttttctaatgtaccataagaaaatacatacctgtcaggtatgtatattattttcccccagaaacagcttttcataaaacaattccagtcgcagaatttatgctaacaacgcactaaaatattctgctatttactgcattactgtttattttaccaaaaatgtcaacatacataaacataaaagcctaaaaagtttactaaaaacagtgtttgaataaacacactctgcagacatataaatagaataatatagcacaactaaatggagtttatatattagtaccatttaacatttcaaaattaatgtaaaaaactacacagcttttcaaaattataatatgaaaatagaaacctctcctataaaaacttatacaatataatcaaatactatataaagaaaaaagttatgcactaaaatagttattgttcatttgcttttgttgctttagggtctgtgagatagattacaataatggccccaattcttcacccctccccatatctgtatctttttccatgtggttttgcaatttttgcaattcttttcatttaaagagtcagcgtatatttcccactcattgaaccctagctgattttctgatttactctggccaatagattaaagtgatggcacaccagctacaagattaggctttaaaatgtattgcattttttggtctttattacatctctcccattatgaggagaacacacctgctacttgatgagagagtaaaaccaagtcaaacagttcctccaattaaggccatccaaaatcagcagagctgcctagctgaccatcatacacacatgaccaatgaggacttaactgttgcatgccacagagactttgaactgctttgtgatattgcattactgtagcaatagataactgatacaagatacttaactatatactacttaggacactggtcaccagaaactaccttttaattacaatacttccaaagataaaacacatttctattttctataagcttttcttatgattttatattacataaaactccttatccaatgtaaactcaatatattaaaccatttaatctaatgtaacattacttaataatcacttattcttgctttgtgatgcttatactaaattcttaaatgcaactgaattcattttgggactctccattttattccactaatgtcaaattattattattagttaagataaattctaatacttcatagaaatacttttctctattagaagtgtccaaattatatatagctatttttatgttactgcataaaatattacagttatttttcctttacaaagaaaaggaggtttagattagaattattatctaggattagcacttctaatatgtctggaatcctcaggctacaataaacgtacaggtttatatggaatatatcccagaagaaaagagaattttttttgtaccagtgaaaatagatgacaatcagtgggatggatacaatctttatctctactagccataaactttccaccacaaatggatctggagggccacagaccctccaaaactgtagacatatggtgaagcaacaggcaggcattcaagtaggtgggaattattacatgactctgaataaagcattaccctatagggactcagaagaatacaatttttggtgtaactccatattctctgtgtcaggatttacacacacgcaattccaaacatgacttggatctccgattagaagtgatagactggataaagaaaatgtggcacataaggaaaattacctccttatgacaactagctaattaactagcttacaaagccactaacagtagcttacaaaatcacagctgttactttttcaaacaactaaatgttgatttcattttaaatgtcatttcaaaagaattaatgatttcctcaaagcactacaatttatacagcatggaatactatgcagccataaaaaaggatgtgttcatgtcctttgcagggacatggatgaagctggaaaccctcattctcagcaaactaacacaggaacagaaaaccaaacactacatgttctcacgcataagtgggagttgaacaataacacatggacacagcgaggggaacataacacaatggggcctgtcggcagtgggtggggtcgggggagggttgggaggctatgggagggatagcattagaagaaatacctaatgtagatgacgagttgatgggtgcagcaaaccaccatggcacatgtatacctaaataacaaacctgcacattctgcacatgtatcccagaactaaaagtataatttaaaaaaaaagaaaatatactttaatgatattcaagtctacacaggtctttttccaactatggtacaaaacaaaaatcctataatgaacatgttaagtataaactgttgcctttcaaagttccatcattatcctattccacaaaagcattagcaactatgaaaataagtgggtgggaatgtgtaatccaaaaatatttgggcaaagaaaaagcccactatgactaaaacaaaatggcaaatgacttcatcttcttttggaaaatgacctcattatgacaactagcgaactagcttccaaagccactaacagtagcttacaaagtcacagctgttactttttcaaacaactaaatgttgatttcattttaaatgtcattgcaaaagaattaatgatttcctcaaagcactacaatttataagcaagaattacacagagaagagtacaataagaagtctgtgacttgttcaatacagattatagaaaatgacagaacaatcatttaaaaaacactggactgtgagcaacaagcagacatatttaggagcactgcaaattattcatgaataagacaataaacacaaaaagtgctaattgtgaccttcaagcaacacaaaaatcatttaattgatagagtagatacaatgtagaattttttaaaactagcatatttcaaaaaaaagacatttggataatatttctgaaaaaagttaaaataattcatgaaacctaaaactccagatcccaagtacaatgaaaaaactgtcacctaattaaaatttttatttaattctcgattaagatacttatgtttcttagtgttaactacaacttttattatttaaaagtttaaaaacagccttcaaatatctaaaatcttttgacccaaaatgggattaatgaaaccaaattatgacatctgcaaaataaaataccatgtgaccagtaagcattacactgtagaaaatatttagggacaatgtaaaatgtacatatttaatgaaaacaatgagagaaaccatttaagtagaggttatgtgtatgtttgtgtgcatgtatgatatggtttggatatgtgtcccctacaagactcatgttgatatgctatccctaatgttggaggtggggcctggcaggaaatgtttgggtcatggaggcagatctctcatgagtggcttggtgctgtcctcctgagagtaagttctgccaagatctgattttttaaaaatgtgtagcacctcccccctttctgaattgctcctgctcctgctatgtgagatgccagctcaccctttgccttccaccacgactgtaaactttctgaggcatcataagaagtcaagcagatgctgccaccacacttcctgtgcagcctgcagaaccataagccaattaaacctcttttcttcataaattaccgagttcacatatttcattatagtgatataaaaatggcctaatacaatgtatttatacaaagacatctataaaagctatcatattgatagagctgttatatccggtccagaaatctctccagactcacatccaatagcctagttgatatttcaacttggttatctaacagatacctcaaatttaacataaccaaaacttaatttctaatatacctgctctacttgcactccatgatagctgatgaccattcctatctatttagttgacaagaacaacaacttttgagtcattttaactccagctttattttcaatccccacatccaatctcttagcaaattatcttgactcttttaaatatatcgagaatctaatcatgtctcaccatctcttctactgcaaaaatatgtatgtctaacacgggaagccaaatttttccacaatcaaaaacaggttccaagaactaaatgagggtacaccaagaatgtgagcacaaacttttaggtataggccaggtgtcgtggctcacacctgtaatcccatcattttggaaggctgaggtgggtgtatcacttgaggttaggattttgagaccagcctggccaacatggtgaaaccctgtctctactaaaaatacaaaaaaaagttagccaggaaacatagcacatgcctgtaatcccagctactcggggggctgacacaggagaactacttgaatccaggaagtggaggttatggtgagccaagatcatgccactgcaaaatctcaaaaataaaacaaaaccaaaaaacaacaaaaaaaacctcttaggtatagatacagaaccacattttccaatcagcttatcattaaaaaacagaaaaagaaaaaaaggtttatactttgattatcatttgtctatcttctgtctcttttcaatatattcagaacacgtgaggattattattaattactccccttgtaacatgaactggtaataaaaggtctattgtggataagaggaaaccaactacagaactcctagtggcttcacctagagtggtaaccatgggataaaatatatgggcaaattattaagaatagtttatgccttatcaactttatttctcctatttaaaaatataacatgttctataacaacagagtggttaaacattcctaaatatttaaaacttcctaaaatggttgagtaattgccattaacatctgtaatgtccataaaaaacatacaattaaaaatagctaacaaaaataaagggggaaaactgcacttcgatgtaaccagatgtagattatttgtttttcaaagtaatagtaattaactgagatagctcatttcaaattaagcaacttataaaagactgttttagtttttaatatctttaaaaatttatgaggggtggagacaagatggccgaataggaacagctccagtctacagctcccagcatgagcaatgcagaagacgggtgatttctgcatttccaactgaggtaccggttcatctcactgtggactgtcagacagtggggacaggacagtgggtgcagcgcaccaagcataaatcgaagtagggcaaggcatcgcatcacccgcgaagcgcaaggggtcagggaattccatttcctagtcaaagaaaggggtgacagacagcacctggaaaatcgggtcattcccaccctaatactgcgcttttccaatggtcttagcaaatggcacaccaggagattatatcccgtgcctggctcagagggtcctgtgcccacaaagcctcgctcattgctagcacagcagtctgagatcaaactgcaaggtggcagcgaggttgggggaggggcgcccaccattgccgacgcttgagtagctaaacaaagcagccgggaagctcaaactggatggagcccagcacagctcaaggaggcctgcctgcctctgtagactccacctctgggggcagggcatagccaaacaataggcagcagaaacctctgcacacttaaatgtccctgtctgacagctttgaagagagtggttctcccagcacccagctggagatctgagaacagacagactgcctcctcaagtgggtccctgatacccgaatagcctaactgggaggcaccccccagtaggggcagactgacacctcacatggccgggtacccctctgagacaaaacttccagaggaacgatcaggcaacaacatttgctgctcaccaatatctgctgttctgcagcatccactgctgatacccaggcaaacagggtctagagtggacatccagcaaactccaacagacctgcagctgagggtcctgactgttagaaggaaaactaacaaacagaaaggacatccacaacaaaagcccatctgtacgtcactatcatcaaagaccaaaggtagataaaaccacaaaaatggggaaaaaacagagcagaaaaactggaaattctaaaaatcagagcacctctcctcctctaaaggaacgcagctcctcaccagcaacagagcaaagctggatggagaatgactttgacaagttgagagaagaaggtttcagacaatcaaactaatccgagctaaaggaggttcgaacgcttcgcaaagaagttaaaaaccttgaaaaaaaaattagacgaatggctaactagaataaccaatgcagagaagtccttaaaggacctgatggagctgaaaaccatggcacgagaactacgtgacaaatgcacaagcttcagtagccgattcgatcaactggaagaaagggtatcagtgatggaagatcaaatgaatgaaatgaagtgagaagagaagtttcgaaaaaaagaataaaaagaaacaaacaaagcctccaagaaatatgggactatgtgaaaagaccaaatctacatctgattggtgtacctgaaagtgacgggcagaatggaaccaagttggaaaacactctgcaggatattatccagaagaacttccccaatctagcaaggcaggccaacatgcaaagtcaggaaatacagagaacgccacaaagatactcctcgagaagagcaactccaagacacataattgtcagattcaccaaagttgaaataaaggaaataatgttaagggcagccagagagaaaggtcaagttacccactaacggaagcccatcagactaacggctgatctctcagcagaaactctacaagccagaagagagtgggggccaacattcaacattcttaaggaaaagaatttttaacccagaatttcatatccagccaaactaagcttcataagtgaaggagaaataaaatactttacaggcaagcaaatgctgagagattttgtcaccaccaggcctgccctaaaagagctcctgaaggaagcactaaacatggaaaggaacaaccagtaccagccactgcaaaaacatgccaaattgtaaagaccatcgaggctaggaaaaaactgcatcaactaacgagcaaaataaccagctaacatcataatgacaggatcaaattcacacataacaatattaaccttaaatgtaaatgggctaaaggctccaattaaaagacacacactgccaaactggataaaaagtcaagacccatcagtgtgctgtattcaggaaacccacctcacgtgcagagacatacataggatcaaaataaagggatggaggaagatctaccaagcaaatggaaaacaaaaaaaggcaggggttgcaatcctagtatctgataaaacagactttaaaccaacaaaggtcaaaagagacaaagaaggccattacataatggtaaagggatcaattcaacaagaagagctaactatcctaaatacatatgcacccaatacaggagcacccagattcataaagcaagtcctcagagacctacaaagagacttagactcccacacgataataatgggagactttaacaccccactgtcaacactagacagaccaacgagacagaaagttaacaaggatacccaggaattgaactcagcttttcaccaaacagacataatagacatctacagaactctccaccccaaatcaacagaatatacattcttttcagcaccacaccacacctatcccaaaactgaccacatagttggaagtaaagtactcctcagcaaatgtaaaagaacagaaattataacaaactgtctctcagaccacagtgaaatcaaactagaactcaggattaagaaactcactcagaactgctcaattacatgtaaacggaacaacctgctcctgaatgactactgggtacataatgaaatatgaaatgaaaacagaaataaagatgttctttgaaaccaacgagaacaaagacacaatgtaccagaatctctgggacacattcaaagcagtgtgtagagggaaatttagagcactacatgcccacaagagaaagcaggaaagatctaaaattgacaccctaacatcataattaaaacaactggagaagcaagagcaaacacattcaaaagctagcagaaggcaagaaataactaagatcagagcagaactgaaggaaatagaaacacaaaaaacccttcagaaaatcagtgaatccaggagctggttttttttgaaaacatcaacaaaattgacagaccgctaccaagactaataaagaagaagtgagaggaatcaaatacatgcaataaaaaatgataaaggggatatcaccactgatcccacagaaatacaaactatcatcagagaatactataaacacctctacgcaaataaactagaaaatctagaagaaatggataaattccttaacacatacaccctcccaagactaaacgaggaagaagttgaatctctgaatagaccaataacaggctctgaaatagaggcaataattaatagcttaccaaccaaaaaaagtccagtaccagagggattcacagccaaattctaccagagttacaaggaagagctggtaccattccttctgaaactattccaatcaacagaaaaagagggaatcctccctaactcattttatgaggccagcatcatcctgataccaaagactagcagagacacaacaaaaaaagagaagtttagaccaatatctctgatgaacatcgatacaaaaatacaacaaaatactggcaaaccgaattcagcagtgcatcaaaaagcttatccaccatgatcaagtgggcttcatccctgggatggaaggctggttcaacatacacaaatcaataaatgtaatccagcatataaacagaaccaaagacaaaaaccacacgattatctcaatagatgcagaaaaggcctctgagaaaattcaacagcccttcatgctaaaaactctcaataaattaggtattgatgggacatatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtctgcagatgacatgattgtatatctagaaaaccccaccgtctcagcccaaaatctccttaagctgattgtcaactgcagcaaagtctcaggatacaaaatcaatgtgcaaaaatcacaagcattcttatacaccaataacagacaaacagagagccaaatcgtgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgctcatgggtaggaagaattaatatcgtgaaaatggccatactgcccaagataatttatagattcaatgccatccccatcaagctaccaatgactttcttcacagaattggaaaaaactactttaaagttcatatggaaccaaaaaagagcctgcattgccaagtcaatcctaagcccaaaagaacaaagctgaaggcatcacactacctgacttcaaactatactacaaggtgacagtaaccaaaacagaatggtactggtaccaaaacagaggatatagaccaatggaaaagaacagagccctcagaaataatgccacgtatctacaactatctgatctttgacaaacgtgacaaaaacaagaaatggggaaaggattccctatttaataaatggtgctgggaaaactggctagccatatgtagaaagctgaaactggatcccttccttacaccttatacaaaaattaattcaagatggattaaagacttaaatgttagccctaaaaccataaaaaccctagaagaaaacctaggcaataccattcaggacataggcatgggccaggacttcatgtctaaaacaccaaaagcaatggcaacagaagccaaaattgagaaatgggatctaattaaactaaagagcttctgcacaacaaaagaatctaccatcagagtgaacaggcaacctacagaatgggaaaaaatttttgcaatctactcatctgacaaagggcgaatatctagaatctacaatgaactcaaacaaatttacaagaaaaaacaaccccatcaaaaagtgggcaaaggatatgaacagacacttctcaaaagaagacatttatgcaaccaaaagacacgtgaaaaaatgctcatcatcactggccagcagagaaatgcaaatcaaaacgacaatgagataccaactcacaccagttagaatggcgatcattaaaaactgaggaaacaacaggtgctggagaggatgtggagaaataggaacacttttacactgttggtgggactgtaaactagttcaaccattgtggaagtcagtgtggcgattcctcagggatcttgaactggaaataccatttgacccagccatcccattactgggtatatacccaaaggattataaaacatgctgctataaagacacatgcacacgtatgtttattgcagcactattcacaatagcaaagactaggaaccaagccaaatgtccatcaatgatagactggattaagaaaatgtggcacatacacaccatggaatactatgcagccctaaaaaatgatgagttcatgtcctttgtaggggcatggatgaagctggaaaccatcattctcagcaaactatcacaaggagaaaaaaccaaacaccacatgttctcactcataggtgggaactgaacaatgagaacacatggacacaggaaggggaacatcacacaccggagcctgttgtggggtcggaggagaggggagggatagcattaggagatatacctaatgttaaatgacgagttaatggtgcagcacaccaacatggcacatgtatacatatgtaacaaacctgcacattgtgcacatgtaccctaaaacttaaagtataataaaaataaaaaataaaaaataaaaaatataaaaaattataacatgagtgaatggctgatatcggtactctgatgttcataacaccattattcacaatagccaaaaggtcaacaaatccaactgtccctcagcagataaactgataaacaaaatgctgtatatccatataaggcatttagccttaaaaagaaaggaaattctgtaacacactacaatacggatgaaccatgaaggttgtttagtgaaataaaccagtcaccaaaggatgaatattgcatgattctacttataggagtgacctcatataatttgtatggtccaattcaaagaaagaaacagtagaatgctgtttgccagggactgggaggatgggggaaggagcagttattgtttaatggttgccaaatttcagtttaggaagatgaaaaagttctggagatgaataggtgtaatgattatgcaatgtcaaggtacttaatgccaatgaactctacacttaaaaatagtgcaaatggtaaatttaatgtatcactacaattttgaaaagcacaagaccattaatcaatttcaatagtttccaaaaataactgcaacttccgaactgtaacagacttatcctaaaaattacttaaagcaacttaccacacttagttcttcgtgttattttgtaactttttgaaaatgagatctgctgcacattcctttcctaaaattttacttctgtagctgagaacagctaattgttatatttgcctttaaagtttccaggttaacgtgacagccattcatgtattttatgaaattataaggcttgatgcacctatttcttactagaacttacctaatactattttctaaagagaatcctagagcagccatcaggtagtttctgagttgacatcttttatgtgccaaagccaccttctgctactcacctttcacaatatgatatcaaatccattccacctcaacctcaaacataactcaatacttaactgacaactaaaaagggctgaaactaatgtatcttttagggattataactgagaagcataaataacggtatttattaagagacttaaggatagtttttgaatcagtaacagtggtttcctgccattttaagtcagaaggtaatttctttaacacaaaaaaatcacatattcaaacataataactatgcaatgctgatttagaatatagatggcaaaattattataaattcaataatgttttaaaatgtatttgtactttattaatcacagtatttacacacaataagagatacaatgtgtgtgtgtgtgtgtatatatatatatatatgtatatatatatatatatgtatatatatatatgtgtatatatatatatgtatatatatatatatatatatagcaaagcatttttcagtctacatgcaatgttctgagtactgtttataaattcattaattccttgcaataatcacactgtgggatactttaatatattctaaatattcaccgtttgataaagacaaaccattaccattataaagaacacaactttttctgacagttttcacaaaagacatttaaaagaaagaaaaagagagaactttttgcccatcctctgtccattgatccatctttccacttatcttctctcccttccactgactcagttttaaagaattacatgagacgaggtcctatatacacattctacatttgatacaggtgacaaacattatacagtgtcctctaatataggatccataggagctatttctctctactctcagcatcgggccaggattagtaacacatttcttttaataagaaactgtatcttaaaacatggttctttctaatgtgtttttcatattccatgtttaaccatcttgcatatcagcatactattgcactcttatttgcttaatattttcttcaagtattttttcaaattatcaaccctttatgttgttaaattgttactaaaattaattttaaagggaatttttatatccctaccataaaaaaatccagaatcatgtattataaataaaaaagaaccgtaagaagagccaaaataagatattaataaattctaatgacaaactgcttctcactcatttttgaaattataaagtactataaagatacagagtattactgaggaaatagaaagccaccatccacctttcttttatcaaataaaatattgaggaagtggaaatctgaggatttctcagtaattcactgtatctttaaagtaattcataatttaaaaaataataacatgaaaagtttttgtcttatcttccctgagccactctccttccattcttagtggcatattaaagagatatcatctgaataacttgagaggtcagataatatattaacacataggctttttagaaaatacttatgcataaaccattattgctcttcagttcctcaaaaaggaataagtaaacacgagaaaacatccatcagtcatacctctgttacgtcatatgctataagtttcacaggtaaggatgagatatttactaaatatgcttgctgtttagattttaaacaaaaaatggtacgtcagctggtaacactagtacagaggagactgaattatgattgtttttaacagcaacaatttcttaacaaaaatattaaagtcctggtgcaatggttcacacctatagtcacctagcatgttggaggctgacgcaggaggactgcttgagcccaggagttcaggaccagcatgggcaacagagatgccatctttacaaaaattttaaaaagttagtcaggcgtggtgacacacacctgtagtcccagctactgacaagcctgaggtggggcaatcgcttaagtccaggagttcaagactgcagtaagccatgatcatgccactgcactccaacctgggcaacagagtgagaccccgtctcaaaaaaagaaaaaaaaattaaatatatttttcttcctttggacaaattcaatctaaattttaaaatcatttggaaagtaaaaaggctcttgcttttatttgtgaacaaaaaggaagacaaatgctgacttaacatataactaccttggagttggtcaatttaaattatctaccaggcacagatcaaactacatttgtagtactccagtcaggtctgaactgcactgtcataggattaagtgaatctcttctggaaaaagatcagggcatggatgatcaaaaaaaaaaaaaaaaagcagagggtagggagtggaatggaagagaaatctagcatttattttgtatttactcttctgggcactgttttaactatatactcctttaaacatcaacaaaaatcccgtaagttgggccttatgatctctcttttaaaaatatttttaaaaaactaaaaactaagtccaaagaagtggctgaaactctcattcaaagctaaaagcagagttagaccaggtatcaggtctatccaattccgaattatttctaaactattgtttgtagtgtcacatgataacagtagctaacactgaggacttactctatgtactaagtatcccacagtattgtatcacataagcctatggagccagaggcttttctagtctcatttcacaaatgaggaatctgaggcccaagaaaatggatggatcatggcagacaggaggcaggactagactgcagctctaactcggatggacagagcagcatgtggaggctcgcatcatgaatttttgctccagaacgactgcaggaataaatcaggaaacctgaaaggacccacagaccccctgaaggaagcagattcctcctgcaagaccctggagacaccccaaatactgtgctggtatacacagctgagagactcacagatggttcacatcacaggactctgcagacaacctgcaataccagcccagagcctggtagacttgctgggtggctagatccagaagagagataatcactacaactcggctcccaggaagccacatccatgggaaaagggggagagtactacatcaagggaacacctcatgggacaaaagaatctgaacaacagcctttagcgctagacctttcctctgacagagagaaggaaccaaatgagaaggaaccagaaaaccaactctggtaatatgacaaaacaaggttctttaacaccccccaaaatcacacactggctcaccagcaatggaaccaaaccaagaagaaatccctgatgtacctgaaaaacaattcaggaggatagttattaagctaataggggagacaccagagaaaggtggccacaatgtaaggaaatccaaaaaatattacacgaagtgaaggaagaaatattcagggaaacagtataaataaaaaacaatcaaaacttcagaaaacaatggacactcatagaaacgcaaaatgctctggaaagtctcagcaataaaactgaaaaagtagaagaaaaattcagagcttgaagacaaggtcttctaattcacaaactccaacaaagaccaaaaaaatcagaaaatacgaacaaaggctccaaacagtctgggcttatgttaaacaaccaaatctaagaataatcggtgtccccaaggaagaagagaaattgaaaagtttggaaaacatacttgggggaataatcgaggaaaacttccctgaccttgctagagacctagacatccaaatagaagaagcaaaaggaacacctgcaaaattcatcacaaaaagattactgcctaggcacactgacatcaggttatctaaagttaagatgaaggaaagaattttaagacctgtgagaaaaaagcaccaggtaacctacaaaggaacacctatcagattaacagcagatacctaagcagaaaccctacaagctaggagggattggggccctatcttcagtctcctcaaacaaaatgatttttgtcaagcattttgtatccagtgaaactaagcttcatatatgaaagaaagatacagtctttttcagacaaacaaatgccgagagaattcgccactaccaagccaccactacacgagctgctaaaaggagctctaaatcttgaaataaatcctggaagcacatcaaaatagaaccactttaaagcataaatctcacaggacctataaaacaaaaatacaattttaaaaaacaaaaacaaaaatacaatttaaaaaacaaaaacaaaatctaatgtatacaggcaacgaataccatggtgaataaaatggtacctcacatctcaatactaatattgaatgtaaatggcctaaatgttccacttagaagatacagaaatgcagaatggatacgtatccaccaaccaattatctgctgccttcaggagactcacctagctaacatataaagactcacacaaacttaaggcagaggggtggaaaaagacattttatgcaaaaggacaccaaaagcaagcaggagtagctattcttataccagacaaaagaaactttaaagcaacagcagttaaaaaagacaaggagggacattatataatgataaaaggccttgtccaacaggaaaatatcacaatcctaaaaatacatgcacctgacactggagttcccaaatttataaaacaattactaacagacctaagaaatgagatagacagcaacacaataatagtgggggacttcaatactccactgacagcagtagataggtcattaagacagaaagtcaacaaagaaacaatggatttaaactataccttggaacaaatgaacttagcagatatatacagaacattccatccaacaaccacagaatatacattctattcaacaaggtgtggaactttctccaagacagaccacacaatggggcacaaaatgagcctcaataaatttaagaaaactgaaattatatcaagcactctttcaaaccacagtgggataaaactggaaatcaaccccaaaaggaacctccaaagccacgcaaatacatggaaattaaacaacctgctcctgaataatcagtgggtcaaaaatgaaatcaaaatggaatttaaaaaattctttgaactgaatgacaatagtgacacaacctatcaaaacctctgggacacagcaaaggcagtgcttagaggaaagctcatagccctaaacaccaacatcaaaaagtctgaaagagcacagacagacaatctaaggtcacacctcaaggaaccagagaaacaagaacaaaccaaacccaagccttgcagaagaaagtaaataaccaagatcagagcagaactaaacgaaactgaaacaatcaaaaaaaaaatacaaaagataaatgaaacaaaaagctggttctttcaaatgataaacctgagagaccattaacaagattaactaagaaaagaagagagaaaatcgatataagctcagtgagaaacaatacatgtgaaattacaactgacgccaaagaaatacaaaagacccttcaaggctactatgaagacctttacatccacagactagaaaacctagaagaaatggataaattcttgaaaagatacaaccttcctagcttaaatcaggataaattagataccctgaactgaccaataacaagtagtgagactgaaatggtaatttaaaaattactatcaaaaaaaaagtccaggaccagatggattcacagcagaattctaccagacactgaaagaattggtaccaatcttattgacactattctacaagatagagaaagagggaaccctccctaaatcattctatgaagccattatcacgctaatactaaaaccaggaaaggacataaccaaaaaaagaaaactacagaccaataaccctgatgaacacagatactaaaatccttaacaaaatacttgctaaccaaatccacaatatatcaaaaagacaattcactatgttcaagtgggtttcataccagggatacagggatggtttaacatacacaagttaataaatgtgatacaccacataaacagaattaaaaatcacatgatcatctcaatagaagcagaaaaagcattcaacaaaatccagcatcactttatgattaaaactcttggcaaaatcagcatacaagggatatacctcaatataataaaagccatctatgacaaacccacagccaacataatactgaatggggaaaagttgaaagcattccctctgagaacaggaacaatacaaggctgctagctttcactactccccttcagcacagtactgaaagtcctagccagagctatctgacaagagaaagagataaagggcatccacatcagtaaagaggaagtcaaactgttgctgtttgctgatatgattgtttacctagaaaaccctaaagcctcctccagaaagctcctggaactgataaaagaattcagcaaagttcccggacacaaaattattgtacactaatcagcacctcttctgtacaccaacagtgaccaggttgagaatcaaatcaagaatcaaccccttttacaatagctgcaaaaaaaaaaaaaaaaaaaaaaaaaaaaaacaacttaggaatatacctaaccaaggaggtgaaagacctctacaagggaaactacaaaacactgctgaaagaaatcccagacaacacaaacaaatggaaacacatcccatcctaatggatgggtagaatcaatatggtgaaaatgaccatactgccaaaagcaatctacaaattcaccaatgcaattcccatgaaaataccaccatcattcgtcactgaattagagaaaaacaattctaaaattcatatggaagcaaaaaagagcccacatagacaaagcaagactaagcaaaaagaataaacctggaggcatcacattacctgatttcaaactatactattaggctatagtcaccaaaacagcgtggtactggtagaaaaacaggcacatagaccaatggaatagagaacccagaaataaacctaaacacttacagccaactgatctttgaaaaaaacaaacaaacaaaacataaattgggaacacttttcaacaaatggtgctgggatactaggctagccacatgtaggagaatgaaactcaatcttcatctctctctgtatacaaaaatcaactcaagatggattaaggacttaaatttaagacctgaaactataaaagttccagaaggtaacattggaaaaacctttctagacattggcttaggcaaggatttcatgaccaataacctaaaaacaaatgcaataagaacaaagataaatttctgggacttaattaaacgaaagagcttttgcacagcaaaaaaaaaaaaaaaaaaaaaaaaaaaaaacagcagagtcaacagacaacctacaaagtgagagaaaatcttcacaatctatacatctgacaaaggtctaatacccaaaatctacaatgaactcacagaaatcaacaagaaaaaaacaatcccatcaaaaagtgggctaaggacaggaacagacaattctcaaaagaagatatgcaaatggccaacaaacatatgaaaaaatgctcaacatcactaatgatcaataccaccaaatcctgcaagaatggccataatcaaaaaacaaaaactgggtaaatgttggcatggatgcactaaacaggcaacacttctacactgctggtgggagtacaaactagtaaaaccactatggaaaatggtacggagattctttaaagaactaaaagtagaactaccatttgatccagcaatcccaatcctgggtatctacccagaggaaaaaaaagtcataggaaaagatacttgcacacacgtttatagcagcacaattcgcaactgcaaaaacatggaatcaacccagatgcccatcaatcaacgaatggataaggaaattgtgatatatatataagtatatatacacacatatacatatacatacacacatatacatacatatatacatacacatactacacacacacacacacacacacacacacaatgcaacactactcaaccataaaaacgaatgaactaatggcattcacagctacctgaatgagactagagactattactctaagtgaagtaatgcaggaatagaaaaccaaacatcgttattttctcactaataagtgggagctaagctatgagaatgcaaaggcataagaatgacacaatggactttggggactcagggggaaagggtgggaagggggttagggataaaagactacgaacagtgccaggtgtgatgactcatgcctgtaatcccagcactttgggagggcaaggtgggcagattacctgaggccaggagtttgagactagcctggccaacacggtgaaaccccgtctctactaaaaatataaaaattagcgaggcgtggtggcacatgcctgtaatcccagctactcgggaggctgaggcaggagaagcacttgaacccgggacacggaggttgcagtgagctgagatcgtgccactgcactccagcctggccaacagagtaagactctgtctcaaaaaaaaaaaaaaaaaaaaaaaaaattacaaatagggtgcagcgtattctgctcaggtgatgggtgcaccaaaatctcacaaatcaccactaaagaacttattcatgtaaccaaacaccacctgtgccccgtggagatcatgccactgcactctgcattccagcctggctgacagagtgagattctgtctcaagaaaaaaaaaaaaaggaaggactacaaatgtatagcgtaatctgctcaggtgatgagtacaccaaaatctcacaaatcaccactaaagaacttattcatgtaaccaaacaccacctgtaccccaataacctacggaaataaatttaaaaaaaaaaaaaaggaaaaaaaaatgatgtgcttcatcccccattacagagcaaatagtaaagccaggtttcagacatcatgaagtttaactcaaccattatacaagaaaaattttagaggaagggatatctatctacctgtcattgttaactaaaattctctatagtagacttttgtcttaggtgcagatttataaggaaaagaggaaatcaactgtattcagagttatcctatacaaagtcccttaagtttttaataaagtgcagaatagtactgtctcataggcataacaaagctagattttccttcaccagtgtgtcagatcactgtcttttttgtacttctagataaaatagttggtttgtgtttaaaggtttgtgttatacaaaaattacataaaatattttaaacactaggagtccctctgtcactgaagttccaagacaggttggcagaaatgcaagtttagaaggattactataaatatgctaacacatttattttaaatctgagctcattttattgtcttctgggaaccaataaattgttggaggctttttaaaacttaacatattaacaaactacacacacacaatgttacacacatgttcataatgaacttgaagttcagtaagatacttcccttctccccattactaatggtatataaaattttaatactttaggctccctatgcagcctatcacccagagaaaacttagcacagagtagacatccagtatgtatttactgaatgaacgattcaacatgaattgcttatcagctccttgtattaggtactttacacatattatttcatttaatgctcacaatatccataaaaagattattatgcctactttagagataaaaaagcataaaaacacagaagtttaataacaagcttcaggccaccaagctgataatttgtagagccaggagtggaatgcaatttgacaaaatccaaagctggtaactttttacagcttcatgcagttctcacaatgaagttcatctcttttccacaaggctacactgagaagttttatgaagagttaggactttcgataatttaatgaatgatcatgacttcagaaagtagagacaggaagattattatagaccaaagaacgaataggaacacgaacacagaagacagactggaaggatgacagtgccattaagaaattttgttttctacattttagcaatgtgcatgaataagttttagaatcaggaaaaactaaaattatttttgtcacttaaaagaaaaaaaaagtaggttatcaagaggagaatgggaggtgtatcacagttaattcctagatatctgttctttgatccacctgtaacatatcaaaaaagtaatttacaaaaatcagaaaagagccttccaagatgggcctaacacatatgaagaatattcattaaaatgttatctctttttttttttttgagatggagtcaggacggtctcgatctcctgacctcgtgatccatccgtcttggcctccctaaaatgttatctcttaatgaccaataactcaaacatccaaacaacactttgtaaaacatacaaagttatcagatctgctcaaatgagacagaaaaatgactaaaattggccaatgtaattgttacttttctatttactgaatggtaaaatctgaaaatatcccatattgcaaactaaacctctccactaaagtaactctctagaatataggaaacctttcaaagtatataaccaaatttatcttttaagttcctgtcaactttaccttgatctcacaatgatccctgtgtctttttatattaaaaatttttaattactcatcaaagaataaaactaatgcttctaaaacatggaccattttaatcctgtggcaataaattatccttgacgaaaaaccataaaaccacgtaaatgcaaagtttaaaaaacatcaaaataaattaaaatgttttgtagaattacatgaagtgcccaggagcagtggtcacacctataatcctaacactttgggaggccaaggcaggtggatcatttgaggtcaggagttcgaaaccagtctggccaacatggtgacaccccatctctactgaaagtacaaaaaaaaaaaattagccggatgtgatggcaggggcctgttgtcccagctacttggatcacttgaacccaggaggcagaggttgcagtaagctgagattgcgccactgcactccagcttgggcaacacagcaagactctgcctcaaaaaaaaaaaaaagaattgtatgaagtaatgatcttaaactgatgactatgttaaaaacaaaagcagtaatataagatatgtgtcccctttaacaaaagaaatcttaactgaagattgaagattagagattttaattcatatgcacacacaaaaatgtgtaatataagtaaaagttcaattttatttatctttttatgaaaatgctgtaatatccacaaggaggaatactgtacacagtcattaaaaatcacactacagagattttttagtcaattcagaaaacaaattttaatggtagctaaaaaaattaacaagcctataatcccaacactttggggaggctgaggaaggaagatcacttaagccaaggagtttcagaccagcctgggcaacacagtgagaccccggctctgccaaaaaaaaaaaaaaattaattaattaacagtatcatgtacatatatatacatctcaaatacatacaaaagtagactgatttaaaatttttatctataggaaaaatgtttttatgttctttttattgtccaacattttgtcatttttcttagtggtaagtatataacatgacttttatatgcgtattatatatgtgaatatatatatatatgtgtgcacacacacacacaacaaaacatatcaatgggaaattctggcataagtggccctttaattaatagcaggcactgaaaatgaaactgagccccaattatcttttcttacactgaaactatgtcaagaataacatctctcaaatgtaaaaagggacaaccaaaagcttaatactgtatacttctattagactgcccaatagttaatcacaactgaattttattattttctttctatgcaagtcttataaaaccaaagatagaacaaatcttttaaatccgatttcagtttgaatcgtacatcacaagtaaaggcatctatacagtgctttgtaatacgccaaaagttttctctcacaagttgattctcacaataatgttaagaggagagttagttcaatttgaaagaagagtatccacagccactagaatgaccctcaaaataaaattggaaaataacaagcattggtgagcatgtggagaatcaaaatactaatacttcaaaattgctggtagaaatataaaactacatggcccttttggaaaacagctggcaagtacttcagtgagttaaattaccatatgatgagataattctactccttggtgttaccagtggctgcttaggggctggaagataggaagcgacggcttaatgggtttggagttatcctatgggttgatgaaaaagttctgaaaagagatagtggtgacagttgcacaacattgggaatatacttaatgccactgaattgtatactttaaaatggtgaaaactgtacattttaaattatgtatacctgatcgcagattttttaaagggctggggaaagtgggggtgggtgttaggtcaagtccctgagaggcaaaacctaagaactctgtgcacatgattgaggaactgctcttagtaaaaaatttaaagaagtgaatgaggcaacaaaactgtgggttcagctaaagactagcctcaacctgatctcagagtgagctctggagtctaactggcaccagggagatgtcacatattgagacaaagacaaggccttatacccttatatcaaccagtcattgactacaagtcacctacctaccccctgggaaagtgggaagcttaagatctctggggtttctgggcaggcaggtcctggcaattctgtggcactagtgagaactgagagctgtaagtcaccaacactatgggtgagggataggtaaataaaccatccagataaaaagggactggatggggtactaacagcatctactgcaacgagaaaaaggaagcttacaaaaactgagtgacttatctggaaacacagagcaggtacaattggaacttgaaacttattctctttaccttataactcatgctcttttccattccagctttatataatttcaacctattaaaacataatgggaagttctcttttttctattcattagccctttaagtttttccccttattctttttagtttagggtttttctcttattgttttgggtctttttggtgcaggcaggggttgaggataattgcttcatctctgcttgaaatgacctttgccatcagttctccctcctggcaatctcctagttaatgttacatcaccttacagaagtggttcttctaatttatgtccctaaaaatcctgtttatagctatgatttgtattatttcatatgtatcatgtgtgcaagactgtttactcttaacattgtcaaatacttgaaagcaaggatcattttagtttatcaatctttatattatcggtatgtggcacctaatgggaatttgaaaatagtttgttgaattaagctgtactttgttttaatataactagaaaagagccaaaggtacagtatttttttaactttgtatctttcagtgtcctttagcaagtggatttgatttgttaaagtttatggcaagtcactgttttagactagcctcccacactaaactttagcagacaaaaccaaaccaaaatggaatcactcctgttaagtgccaagtaaatgaactgaattttgagatgggccagttttccacagcaaccaatgaggcccagtttacctggagccagcatgataaggaagtcccctctgcgtcaattgtatgagggaagtaactttttaaataaatttatttccataggctttgcgggggaaaggtggtatttggtcacatgagtaagttttttagtggtgatttgtgagattatgatgctcccatcatgcaagcagtatacactgaacccaatttgtagtcttttatccctcacccccttcccacccttttccccaagtccccaaagtccattacataattcttatgcctttgcatcctcatagcttagctcccccttatgagtgagaatatacaatgtttggttttccattcctgagttacttcatttagaataatagtctccagttccatccaggtgctgtgaatgccattagttcctttttatggctgagtagtattccatatatacatatatatatatatggaatatataatatataatgaagtatctcaggaatatatatatatatatatatatatatatatatatatatatatgcatgccacaatttatttatctacttattgattgatgggcatttgggctggttccatatttttgcaattgcaaattgtactgctgtaaacatgtgtgtgcaactatcttttctgtatagcaacttcttttcctctgggtagatacccaggattgggattgttggatcaaatagtagttccatttttagttctttaaggaatctccacactgttttccaaagtggttgtactagtttacattcccaacagcagtatataagtgttgccttttcaccacatccatggcaccatctattaattttttattttttgattatggccattctcgcaggagtatagtggtattgcattgggttttggtttaaataggcacaggaccaatggaacagaagagagaagccagaaataaacccaaatacttacagtcaactgatcttcaacaaacgaaacataaagcggggaaaggataccctattgaacaaatggtgttgggataactggcaagccacataaaggagagtgaaactggatccttatctctcaccttatacaaaaatcaactcaagatggatcaaggacttaaatataaaacctgaaactataaaaatactcaaagataacatcagaaaaacccttctagaccctggcttaggcaaagacttcatgaccaagaacccaaaagcaaatataacaaaaacaaagacaaataggtgggacttaattaaactaaagagcttctgcacagcaaaaggatataaacagcagagtaaacagacaacccacagagtgggagaaaatcttcgcaagctatacatccgacaaaggactaatatccagaatctacaaggaactcaagcaaattagcaacaaaaaagcaaacaatcccatcaaaaagtgggctaaggacatgaacaattttcaaaagaagatagagaaatggccaacaaacatatgaaaaaatgcttaacatcactaaggaaagtaactttgaaacaaccaatttgctttttgtttctcgtttctgttttcttcagccatttttggcctataaagccaactatctctgctcagtccattctatttaatagaatgagatgttgcctgattctagaagtaaaaaaaaaaaaaaaaaaaaagaaacaaacaaaaaaagccaggccgggcacagtggctcatgcctgtaatcccagcactttgggaggccaaggtgggcggatcacgaggtcaggagttcaagaccagcctggccaatatggtgaaacctcatatctaataaaaatacaaaaattagctgggcatagtggtgcgcgcctgtagtcccagctactcgggaagctgaggcaaaagaattgcttgaacccaggagggggaggttgcaccactgcactccagcctgggcgacagagcaagactctgtctcaaaaaaaaaaaaaaccaaagccaattaaatctttaaattaaatttgttgtacttctcttttaatagactatatactgtagaaagctaaatatgttggcagatgagaactaagtactagtatactacagatcaggatcagtaagagttagtcactctcacaaagtggatgctttataaatggaaaaataatatactttttatctatttaaatgtgtaaacagcaatatctaataattatatttcacttaaaatatattaaaagacatttaaaactgctttatacaggaaaatattacagataaaagttactaatctctacccatccatccaaattatagaggtctaattttgaaaatcaatttagcagaggaatgttacttaatttaaaggaaaaatcactttgataattatgctcaaagacacacctcaatgaaaccatccaaaaaactaaatatgtaataaatttttccactattttatcgttatgtttggcattaatgataccacttagtattctactgctctacaaggctagtatcattttctaaaactaaacagactgttagcagaagttatttcaaagctatacaaacagacctcagaaagtttctgttaaattttttttcctaaaaagaaaggtcaaagaggaagaagttattaggaatacagggtgagaaaataaaagaagtagtattcaaaacaaaaccaaaaatacgaatagaaaagaatggcttcaatgatttttttccagttgcttatcctcgcaaagtaaccatttaatgggtaagaatgccaaaaatatcttagaaaatgcacaatgccattatacctagattctttttaagcaccaatggccatcatcagtcaataatgtacttaaaatgaaaacccacttgagcactaaaagaacacaaatagaagaaatcaacagcctgaaacgtttatttttacaaacagttgattacagaaacccaactcaagaacaccatggcctgatcttctttttgaatacataatgtatccaataggaatcacagaggaataggcattttcttcacgcttttatatttgcttattcgtttgcttttcaaagaaaagtattattttcatgaggcataaattccagagaatgacatggctaattatagtttgtagaactttttaatctaagccattagactccctgaactacctcaaacgaaaaacatcggcttttagctctaaatctaaatgaattgtttccatattaccggaacataactcgtttcatctcaccacctgtattacataatatcatggtcttttcataccaactccaatataactacaatatttattgcttccgctatacctactgcattttatgattcagtgttattacacatataaaatgaatggtcgtgttttgaaattttcaagaagttacaaaagtcttttcacaaatacatctacataaattcagctagattattctaataacatttgacaaaatgttccttccaccaacttgtttgtttataaattaaattacatgcacaaaactaattttcaaccagttttcagagttccctttctttatgtggttttagttcattcaagccctcagcattgttcactacaaaatccttctggtcccttctaatatacactatataccacattgctattagatgattcaaaaccatacatcatgtaactccttgccttaaaaatccaataatggaaatgacatcaccaacgacagagtagaagccactatctttcccaactccacacctgccccaaccccagaactgcagtcattctacaaataacccactccaagcccaggcaatgtggctgcactgggcccacatttcagatatctgagccatcaccttagtgagcaacttcatattccctgggctaaaagccaagccctcactgctcatgcttgtactccaagtaccaaaccagctatcacacagagctaggccccacgtctacctaggagcctctctaattctgcatatacctgtactcccaattctcatctccactgatgtgttcacaagcctccaggcatcacatactgctgccaacatggcaggtgaggtgcctacatgatacatatcagtgccattatggacccagatgccagagccatactccctccacaagtacccaggcttcaggtctcaactccaaggccacatcacaggcaacacacatcacaaactagtaccactgctatttcaagcaagtccacaagccatacccagtaccaaaacgaatccatgctcagccacaacttccctgttaggagtaaaagagatcacaaggaccttagcagccattgtcaccaaagaccccaacaacccttgctgccaccacagacatcagtattagccactgaggattcacactattggccactgagcatccctccaatcttggtctaaaatcaacctcggctggcagagctacacagattacccagcttgaaccctcactggtgccagaactgttgtaccctaaccaacaagcgccctcataaggtgaaggtctttccatagcaaaactagcccaaaaagtctgcaaggggtgactactccaccaaatgctcagacatcaacataatgcaacaagaaccatgaaaaaccaaggagacaaaacaccaccaaaagaatacaatcgggcggttccaagatggccgaataggaacagctccagtctacagctcccagcatgagcgacacagaagacgggtgatttctgcatttccaactgaggtaccgggttcatctcactgaggcttgtcagacagtgggtgcaggacagtgggtgcagcccactgagcgtgagccaaagcagggcgaggcatcgcctcaccctggaagtgcaaggggtcagggaattccctttcatggccaagcaaagctggaaaatcaggtcactcccaccctaacactgcgcttttccaatgatcttagcaaacggcacacaggagattatatcccgcacctggctcagaaggtcccaggcccacggagcctcactcattgctagcacagctgtctgagatcaaactgcaaggcggcagcaaggctgggggaggggtgcccgccattgctgaggcttgagtaggtaaacaaagccaccaggaagctcgaactgggtggagcccacggcagctcaaggaggcctgcctgcctctgtagactccacctctgggggcagggcatagccaaacaaaaggcagcagaaacctctgcagacttaaacgtccctgtctcacagctttgaagagagtaggggttctcccagcacacagctggaggtctgagaacagacagactgcctcctcaagtgggtccctgacacccgagtagcctaactgggaggcaccccccagtaggggcagactgacacctcatacggctgggtacccctctgagacgaaacctccagagaaacaatcagacagcaacatttgctgttcagcaatatacgctgttctgcagcctccgctgctgatacccaggcaaacagggtctggagtggagctccagcgaactccaacagacatgcagctgagggtcctgactgttaaaaggaaaactaacaaacagaaaggacattcacaccaaaaccccatctgtacattaccatcatcaaagaccaaaggtagataaaaaagacaaagatggggaaaaagcagaacagaaaaactgaaaattctaaaaatcagagtgcctctcctcctctaaaggaacgcagctcctcacaagaaacggaacaaagctggatggagaatgactttgacgagttgagagaagaaggcttcagacgatcaagcttctccgagctaaaggaggaagttcaaacccatggcaaaccttgaaataagattagacaaatggctaactagaacaaccaatgcagagaagtccttaaaggacctgatggagctgaaaaccacggcacgagaactacgtgacaaatgcacaagcttcagtagccgatttgatcaactggaagaaagggtatcagtgatggaagatcaaatgaatgaaatgaagtgagaagagaagttttgagaaaaaagaataaaaagaaacaaaagcaaagcctccaagaaatatgggactatgtgaaaagaccaaatctacacctgattggtgtacctgaaagtgacagggagaatggaaccaagttggaaaacactctgcaggagaacttccccaatctagcaaggcaggccaacatgcaaaatcaggaaatacagagaacgccacaaagatactcctcgagaagagcaactccaagacacataattgtcagattcacctaagttgaaatgaaggaaaaaatgttaagggcagccagagaaaaaggtcgggttacccacaaagggaagaccatcagactaacagctgatctctcagcagaaactacgagccagaagagagtgggggccaatattcaacattttaaagaaaagaattttcaacccagaattgcatatccagccaaactaagcttcataagtgaaggagaaataaaatacttcacagagaagcaaatgctgagagattttgtcaccaccaggcctgccctacaagagctcctgtcctgggatcgggggagggaggagggaaagcattaggagatataactaatgtaaatgacgagttaatgggtgcagtacaccaacatggcacatgtaaacatatgtaagaaacctgcaagttgtgcacatgtaccctagaacttaaagtataacaaaaaaaataaatttaaaaaaaaaaaagtcaaaaaaaataatgaaaattctgaattaaaaaaaaaaaggtgcacaatttggtttgttatgcaaatttttgtttttcctgagctattcagctactttaaaacatgcatataagctagctagtcattttgaataagaagaaaaataaatggagaaatgattatgatagcactgtttatgccttttaaaaacagaatgtctaaatatttggaaaaaaaaaaggtgcacaatttggttatgcaaatttttgtttttcctgagctattcagctactttaaaatatgcatataagctagctagtcattttgaataaaaagaaaaataaatggagaaaggattatgataacactgtgagtgtttatgccttttaaaaatagatgtctaaatatttaggaaaaaaaaaaaaaagaatacaatctcccagtgcctgaccacaaagaaatgaagataaactgcctgagaaagaaatcagaataatcattttaagtgagctcagtgaacttcaagaaaataaatgaccaaaatgaaaaacctaatagattgaaattataaaaagaaacaaattccaaagccgaaaaacacgatgaaatgaaattaaaactttaactgagtatcaacaatatcagaactgatcaagcagaagatctgtgatcttaaggacaagttagttaaaaatatatagtcaaaagagaaaaaaaaaactatgtaactgaagaaagcttataaaatatatgagacagcatcaaaacagcaaatatttcggtcataggagttcaagaagaagaaagagaaaaagtgatagaaatcttatttaaataaatagcagaaaatgtcccaaatctgaagaagatataaatatcaacatataggcagggaaaaaaatctcccatcagagttaatccaaacaagaatagacgaaggtatattataaccaaactgtcagaaatcaaacataaagaaaagatcctgaaaccaacaagagaaaagaaagaaatcacatataacagagttcaaataaggctaacagcagttttctcggtagacaccttacagaccaggagagaatgggatgatatagtcaaagtgatgaaaaggatggggagaaaatgtccaccaagaatagtgtaccagattgtgaatgttagcttctgatcaactgcaggaacaaaccagcaatcctgagaggacccacagaacctctgaagaaagcggactgctcctgcagtacctgggagacacctcaaatactctgggaagtggaaagcctctggtaagttttcaagcgtgccctccacctggaaacagacttggggctgttgtgggcagcacggtgggaatgagaccagcctttcagttcgcttgggagctaagtgaggcctgtgattgccgcttttcctcacatccctgacaacctgcatgactcggcagaggcagccataatcctcctaggtatacaattccagtgacctgggaatctcaccccatcccccacagtagccacagcaagacggcccaagtagagtctgaattcagacacacctagccccatccccacctgacaggatttccctaggaaacctggtagccaaagacaaaggacatacaatcctgggagttctagggccccacccactgctgatccctctccacactactacagctgatgctttctagaaagcaccacctcctggcaggaagtcaaccagcacaaaaatagagcattaaaccaccaaagctaagaaccctcacagagtccgttgcaccctccaccacctccaccagaacaggcactggtatccactgctgagagacccatagacggttcacatcagaaggactgtgcacagaaaccctcagcaccagccaggagctgggtagactcactgggtggctagacccagaagagagaaaacaatcaggcagtttggctcacaggaagccataaccacaggaaaagggggcgagtactacatcaagggaaccccctgtgggacaaaaaaatctgaacaacagccttcaaccctagaccttccctctgacagagcctacccaaataggaaagaaccaggaaatcaaccctggtaatatgacaaaacagggttcatcaacacccccataaaatcacactagttcaccagcaatggatccaaaccaagaagaaatccctcacttacctgaaaaagaattcaggaagttagttattaagctaaacagggagggaccagagaaaggcgaagcccaatgcaaggaaatccaaaaagtgatataagaagtgaagggatcaatattcaacaaaatagatagcataaagaaaatacaatcaaaaattcaggaaactttggacacacttttagaaatgcaaaatgctctggaaagtctcagcaatagaacagaacaagtagaagaaattgagagctcaaagacaaggtcttcgaactaacccaatccaacaaagaaaaagaaaacagaataatatgaacaaaccctccaagaagtttgggattatgttaaacaaccaaacctaagaatactctgtggagaatgcacaattactaacagacctaagaataatcagtgttcctgaggaagaagacaattctaaaagcttagaaaacatatctgggggaataatcaaggaaaacttccccagccttgctagagacctagacatccaaatacaagaagcacaaaaaaacacctgggaaattcatcacaaaaagatcaatgtctaggcacactgtcgtcaggttatccaaagttaagacaaaggaaagtatcataaaagctgttagacaaaagtaccaggtaacctataaaggaaaacctatcagattaacagcagatttctgagcagaaaccctacaagctagaagggattggggccctatcttcaacctcctcaaacaaaacaatcttcagccaagaattttgtatccagcgaaactaaacatcatatatgaaggaaagatacagtcattttcagacaaatgctgagagaattcaccattaccaagcaaccactaaaagaactgctaaaaggagctctaaatcttgaaacaaatcctggaaacacatcaaaacagaatctctttaaagcataaagcacacacgacctataaaacaaaaatacaagttaaaaagcaaaaacaaaaaaaacaaagtataaaggtaacaaagaacatgatgaatgcaagggtacctcacatttcaatactaacatggaatgtaaatggcctaaatgctccacttataacatacagaattgcagaataggtaagaactcaccaaccaattatctgctgccttcaggagattcacctaacacataaggactcacataaacttaaaggggtagtaaagagcatttcatgcaaatggacaccaaaagcaagcaggagtagcaattcttatatcagacaaaagaaaccttaaagcaacaacagttaaaaaagacaaaaggccgggcacagtggctgacacctgtaatcccagcactttgggaggccaaggtgtgcagatcacgaggtcaggagatcaagaccatcctggccctggctaacacagtgaaaccctatctccacaaaatatacaaaaaaattagccaggcatggtggcgggtgcctgtagtcccagctactcaggaagctgaggcaggagaatggcgtgaacccaggaagcggagcttgcagtgagccgagatcgtgccactgcactccagcctggacgacagagtgagactccatctcaaaaaaaaaaaaaaagacaaaaagggacattatataatgataaaaggccttgtccaacaggaaaatatcataatcctaaacatatatgcacctaatactggagctcccaaatttataaaacaattactaacagacctaaaaatgagatagacagcaacacaataatgtggggggggggggggacttcaatactccactgacagcactagacaggtcaacaagacagtcaacaaagaaataataaatttaaactataccttggaacaaatagactttgagcagatatatacagaacatttcatccaacaactgcagaatacacattctattcaacagccaaggaactttcgccaagatagaccatatgataggccatataaagagcctcaataaatttaagaaaattgaaatgctatcaagcactttctcagaccacagtggaataaaactggaaatcaactccaaaaggaaccctcaaaaccatgcaaatacatggaaattaaataacctgctcttgaatgagcactggatcaaaaatgaaatcaaaatgaaaattaaaaaattcttcgaactgaatgacaataatgacataacttatcaaaacctctgggacacagcaaaggcaatgctaagaggaaagttcatagccctaaacgcctacatcaaaaaggttgaaagagcacaaacagacaatctaaagtcacgcctcagggaactacagaaacaagaacaaaccaaaaccaaacccagtagaagaaaaaaaataagagcagagcagaactaaacaaaattgaaacaaacaaacaaaaaatacagtacaaaagatacatgaaacaaaaagatggttatttgaaaagatatataagattgatagaccatttgcaagattaaccaagaaaagagagaaaatccaaataacctcactgagaaatgaaacaggagatactacaactgacactactgaaatacaaaagatcattcgagactactatgaacacctttacacacataaactagaaaacctagaacagatggatcaattcctagaaaatacaaccctgctagcttaaataaggaagaattagataccttgaacagaccaataacaagcagcgagattgaaatggtaatttaaaaattataaaaaaaaaaaaaagtccacgaccagacggattcacagcagaattctaccagacattcaaagaagaactggtaccaatcctttcaacactattccacaagatagagaaagagggaaccctcactaatccattctatgaagccagcgtcaccctaataacaaaaccagggaaggacataaccaaaaaagaaaactacagaccgatatccttgatgaacatagatactaaaatccttaacaaaatactagctaaccaaatccagtaacacatcaaaaagataatccaccatgatcaagtgggtttcataccagggatgcagggatggtttaacatatgcaagtcaataaatatatttcaccacataaacagattttaaaacaaaaatcacacaatcatctcaatcgatgcagaaaaagcattcgacaaaatccagcatccctttatgatcaaaaccctcagcaaaatcaacatacaagggacataccttaatgtaataaaagccatctatgacaaaaccacagccaacataatactgaatggggaaaacttgaaagtattccccctgagaatgggaacaagacaaggatgcccattctcaccactcctcttcaacatagtactggaagtcttagccagaacaatccgacaagagaaagagataaagggcatccacgtcggtaaagaggaagtcagactgttgccgtttgctgacaatatgattgtttaccttggaaaccctaagtacttctccagaaagctcctagaattgataaaagaattcagtaaagtttccggatacaagattaaagtacacaaatcagtagctcttctatataccaacagcaatcaagctgagaaatcaataactcaatcccttttacaatagctgcaaaaataataaaatacttaggaatatacctaacaaaggagtcgaaagacctctacaaggaaaactacaaaatactgctaaaagaaattacagacaacacaaacaaatggaaacacatcctatgctcacggatggccagaatcagtattgtgaaaatcatcatactgccaaaagcaatctataaattcaaagcaatccccatcaaaatagcaccaccattctccacagttagaaaaaacaattctaaaattcatatggaaccaaaaaagagcccacatagccaaagcaaggctaagcaaaaagaacaaatctggaggcatcatattacctgatttcaaaatatactatgaggccatagtcaccaaaacagcatggtactagtataaaaataagcatatagaccaatggaacagaatagagaactcagaaataaatccaaatacttatagccaactgatctttgacaaaacaaacaaaaacataaagtggggaaaggactcccttttcaacaaatggtgctcagacactaggctagccacatgtaggagaatgaaactcgatcctcatctctcaccttatacaaaaatcaactcaagatggattaaggacttaaatctaagacctgaaactaaaaattctagaagttaacattggaaaaacccttctagacattgccttaaacaaggattccatgaccaaaaacccaaaagcaattgcaataaaaacaaaaaaaaatagctgtgacctaattaaagagcttttgcatggcaaaaggaacaatcagcaaagtaaactgacaacccacagagttggagaaaatcttcacaatctatatatctgacaaaggactaatatctagaatctacaacaaactcaaatcaacaagaaaaatcaatcaataccatcaaaaagtgggctaaggacatgaatagacaactctcaaaagaagatatacaaatggccaacaaacacatgaaaaaatgctcaacatcactaatgatcagggaaatgcaaatcaaaaccacaatgcgataccaccttactcctgtaagaatggccataatcaaagaatcaaaacacagtagatgttggcatggatgcggtgaacagggaacacttctacactgctggtaggaatgtaaaccagtacaagctgctatggaaaacagtgtggaaactccttaaagaactaaaagtagaactaccatttgatccagcaatctcattactgggtatctaccctgaggaaaagaagtcattattctaaaaagatacttgcacacgcatgtttatagcagcacaattcacaatagcaaaatcatggaaccaacccaaatgcctatcaatcaatgagtggataaagaagctcagatagacagatagatagatagatagatagatagatagatagatagatagatagatagatgatggaatactactcaaccatacaaaggaatgaattaacagcatttgcaatgacctggatgagattagagactattattccaagtgaagtaactcaggaatggaaaaccaaacatcgtatgttctcactgatatgtgggaactaagctatgaggacacaaaggcgtaacaatgatacaatggactttggagacttggggagaagagtgggagtgaagtgggggataaaagacaacaaatatggtgcagtgtatactgctcgggtgatgggtgcaccaggttctcacaaatctccactaaagaacttactcatgtaaccaaataccacctgtactccaataacttatggaaaaataaaattttaaaaaaataaaaaataaaaatgaatcagggggatgtctatgttgaaagctgtaaatactaaataactcctataaaaagcaaaaaaaaaaaatactgtatcaagcaaaattagataagagaaagaaataataggcatccaaaggaaaaagttatatcatctctgtttgcagacaacataatctttcatggagtaaaacctaaagactctggaataaactgttagaacaaataaacaaattcagtaattctgcaagacacaaaattaacatgtgaaaatcagtatcatttccatactattcaaaaaagaaattttaaaaaactcattaacaatagctaccaaaaaaaggtaaatacttagaaataaatttgaccaaagaagtacagcctgtacactatactgtgaaaactacaaaacactgatgaaagaaatggaagacacaattaaatggaaagatatcctaactttatggattgaaagaatattgttaaaaccaggcacagcggctcatgcctgcatgaacactgaggaaagaaatggaagaagacacaattaaatggaaagatattctaactttatgtattgaaagaatattgttaaggccaggcacagtggctcatgccatatggaacctgtaatctcagaaatttaggaggccaaggtgggcggatcacttgagctcagaagttcaagaccagcctgggcaacatggcgagaccccatctctacaaaaaatacaaaaattagccaggcatcgtggcatgcacagatagttccagctactcaggaggctgaggtggaaggatcacttgagcctgggaggtagaggttgcagtgagttgagatcacaccacttgcacttcagcctgggtaacagaggaagactctgtctcaaaaaaaaaaaaaaaaaaaaaaaaagaatattgtcaaaatgtccagactacccaaagtgacctaaagactgaatgcaatctttatctaatgacactttccacagaaacagaaaaaaaatcctaaaattcatatggaaccacaaatgaccccaaatagccaaagcagtcttgagcaaaaagcaaatccagaggcttcacattacctaatttgaaaatctactatcaagctacagtaatcaaaacagcatggtacgggcataaaagcacacacactaacggaacagaacagtgaatccagaagtaaatccatacatttactgtcaactgattttcaataaagatgccaagaacacaaaatgagggaaggatagtctcttcaataaatggtgctggggaaactggttagctacatgcagaagaataaaattagatccttatctaacaacatacacaaaaatcaactcaaactgcattaaacacaaacataagacatgaaattgcaaagctgctagaagaaaacagaggggaaaagctctatgaaattggtttggataataatgttttggatatgaccccaaaagaactggcaacaaaagcaaaaataggcaaatgggattacaataaactaaaacacttctacagaacaaagaaaacaatcaacagagtaaagaaacaagcatacagaatgagaaaatatatttgcaaaccatacatctgcaaaggggttaatatctaaaatacataaggaatgcaaaaaaacaagtaacacaatttttaaaatgggaggttttcaggtgatgagagcctcaccctcaggaatagattaacaccattatgaaaaggacttgcaggattgggagtcaattccaactacatgacatactggaaaaggcaatactatagacagagtaaaaagatccgttgtcacaatggttaagatagtaaatttatgttatatgtatttaaccactattacatacatgtatcagtaaaaagaaagggaagaaaaaaatagttattaacagggattgtggagagagaaggataggaggtgcacagaggatatttagggcagtgaaactattctggatgacaccgtaattttggagacaggacattatacatttggcaaaacctatgaaatggtacaacataaagaaaaaatcctaatgtaaactgtggactttagctaactataatgtatcaatattggttcatcaattgttattaagtgtagaccaccaatgcaagatattagtaagagtaaactgagagctgttggcagtggcaggaaggtgagagcttatgggaattctctgtactttgtgatcaatttgtctgtaaatttaaaactgcactgaaaaataaagtctattaatttaagatattatcactaatcaactttataaatatttcatgcagtaaataactaaatagcaatgctagagtatacaccaaccagttgtattgaataatccataaattatttcaaaaatatgccatctttaggatttctcaattttcaaaaaacatgaatttataactaaaaatgacaggagtcctagagatttaaaatagtaccaagagatagtgaaataaataaagtaaatctatattaaccatttattattagtcaagattttatttctcagagattttcctactacatgatcattatataactttaaatgtcaaaactatttttaatttattaattttggatgaaaatcttccctacataaatattaaatatttcccagtctttcataaaaaagtatgtttaaaaaaatgttcctcttgtcaactagttcattaaattcctacactgatatcttttaaaatgtactgaggcagacagggcaatcaatctgccctcacattaaatgacccttgaagatgctttttgggtttgtatatgtgtgtgtttctctctcagacgagctatctttcttactgcttgcaatgatttatgtgttttataattaaataggtgtcttataattatgtgtcttatgatgtgtcttataattaaatatgggaggtacaaacaatcactttggaactttatcataaatgagggcaaacaggcaatcaccagagtttgtaaggcaggaggaagcaggcagaaagattcctcctccataacaaaattacttgagacatattcttgccggtatatctaataattagaattgcttaaaatgatcatggacaaaataaagtacacaataatttgaactgtaagctgttacttaaagccatcccatttatataaaaccttaagtgttaacaggctaaagatctgaaattcagatcagaatacaagctcaatttttatttaccaataaaaatacataaaatattacttttcttactcagtagtaaccaccatcatcaaataatactcaaagtctacctaatgtaggtaaatcctcagaaaatgaatttactttggatattatgtccaatggaagatgcaatgactgtttctggaaatacatagtaatatcaaatataactagttactttttccactcaatgaaattcaaatatggataaaacagagggaaaatagttgatcatagttgttactaagatttctgctaaaatatttcatgcttaggcattaaacgtagtgaactctaaaagagagaacatttctgtggataataagtacataaatcttaacatcttattagtaataatgaaaagtaaataaattaaatattgagattgaagataatttatagatggactctaatcaaaattatttggattccaacctcatcctaaaaggactttagggtgacacaatataatgattatatgatcaagatgaacttgcatgactcaattcaagagatggttattacataccatagacacgatctttcacgtaacaatattattaaaaaaatttccaaatacttcaagaattctattataatatataaataagaaacatgatcttcattattacaagtcattcttgcctgttctataagaggagtggacaaaccactatggcagcttcccaggttttttttgttttttgagacagggctttgctctgtcgcccaggctgtagtgcagtggcaagtacacagctcactgcagcctgcacctcctggggtcaggtgatcctctcacctcagcctccctaatagctgggaccacaagcgtacgtcaccatgcctggctaatttttcttttccatttttttttttttctggtagacatggggtctcaccatgttgcccaggctggtctcgaactcctggggacaagtgatcctcccacctcagcctcccaaaatgctgggattataggtgtgaaccaccatgcctggccacaacttcctgtttttgtaaataaagttttactggaattcagccatactcatttgtttacttatcatctgctttcacacggcaatggcagagttaggtagttaacagaaatcctatggcccacaaagccaaaaatatttactacctggccttttagaaaaagtgtgtcaattcctggtagggcatcaactagtataacacaaattcaaaattaatactttgtacatagagacgtagtcttctgatcattaaaatactccttgtaaagtgtaatgtagtagtataaacaatttagtagtattagtacagttgtagtagtataaataatttagtaacagtagtacaatataatagtatttaatgtaaataaactttttaaggcttttatatatatattccagaagcatatagctaagaatacacaaatgacataccaataacagatgcttgttttgatcctctaaaaatttctagccttgaattaccataatacaaactcataattcttaaagttaggattttcaaaaatcttttaccatcttcaatttatatttgccatatataaataaactgtgaaaactagccatttttttactgtgaataaaatttaaagactaaaactataaactaaaatctaaaattgctgtatagcccaagctactcatattcactcatttttaaaaatttatttatacatgagtgaattttcctcaagtatgatttccatttgaaatcaaatttctgtatcacttaaacataaaatggtttacctttcagaattcactgtttaagctgaaaaatgcctatatatcctttacttatattcaccaattaacattttgacacatttattttacaaatgtatttattttatgaatgtatttaattaaattttattaattcagctcatatctcttttaagactatggatattgtactataaaaacatgatagcattatcacatctaacttaatacatattccatagtatcgtcgcaatccagtccatattccaagttttctcaaatatcctaaaagtgaactatgcagctctactttcaatctagcaaccaatcaagtttcacatgcatgttgatttctgacaggtaagcaccagatctttctctaaacaatctatttgtatctaatacattctctcttctacccataaacttgttctcttgaaaagcgataggaacacaatttcccactacttacctgccagaatcattcagcagtggaaggatattgtgataacaatagggaaaaactgattttccaattatttctatagaatctgttttccctatgaagctagaaaaaaaattgtaatctcaccttagatggttaaaacatattataaataaatacctaagaaatattcattaatcatcaagtaaaaagtcttgtgacctcccagttcccaagaagttttaatattgttaatactaataacttaataagaatcatgaataattatccaatgcagcattttataaaaagaaacaattaacattttataaaagtctagagtgatctctactggtcactaaaaaagctagttttagaaaactagaaatacttatttttaaacatattcaaacaattttatagttcattaagctgaataaagttttaatcatcccataaaaagactgaataacacgtatattatgcctatgcatcaagaaacagacttcttcaggaattagtttcaatgctttcaagcttctattaaagtgtaaaacctacattttaaacaatgctttattataccaatattataaaaatgtatacttttataattttctaatattaatataattaaaatatatgaatattttaacatttctttcctgacttccttaatcttaaaagtaaaattagtgcaagttttcactgctatgctttctgagaaattgagatttccaatgggaatactgtcaaatatataaaaacaaaaagatcagtattctagcgcttcattttcaatatattttctatattgttaattatgctagaactcaaggtattttccagcataagttatacacaaggcctaacaaatagagacctaaatctgcgatcgcctttactgaaaccaatgaaaaatctatacacagtaatgaaactggcatgcaaataaaagaactgtcaagacatgtattcctaaaaataagcctacaataactattttaaaggctgtgtgtggtctcgcccatatattttggcaagatgcactttctccaaccacagttagattcatccaaaagcagtggcactggagagcctctgtctcacctgtcaaagttgaagaacgttgttccaaagaccaccatgagtccatggagaaaagccacagtgctacagctgttattgataagcagtttctaaaggagaaaaaacttcaaacaattaagcaaatcatccttaatagagatacagacagacatacgatgatattcatgtttaaattatgagatgacaattactgtgccggttgtgaaacaaaacactgacaatttatatactggaatgctcagaggggaatccttcataagtaacactaacttacaatcttctctattcttcctctaactaaacttgtatacattggttatcaattcaaaaactctattatgttcggttaaaccttcaacaacctcctttataaacctcaaaattcatctaaattattaagttactaacttcatcaaaattgctgaagtctgacagctaagagcacagtggattaagatttataaacggaaaccttaaatatattaaaacccgatttttttagatgatgccttaacatgtttttcaaccacattataaaagcagttcacatttttgctttagaataacctccctacagtaaagcacatagactgatagagcaagccattaacatgaataaagagcaagaaaaacaattacttgaaaaagaaatatgcctcagtggacaattcaagtcccacccccaacttggcaataaaagacatcttaaaacaaattgtaacgaaatatacatgactatactaaaagtttagataatgacaatgagtatctcaaaatttaacttatttttccaagtgataatatcctctaatcctatttaatactaaaagagttcaattgaaagagaggagattttccttttgtaccttttccaagaaagctaatatacaaaagattctcattataggacagttttacctacagccatgttccatagcacaaagttacagcagtgttccaacgtatactataatgtcctacagtttcatttactatattctctaagtacaaaggttctaaaaagattactttcacttctccctagatacgttaaatagcatagctgggatattatttttctttggttttgtcagtagcatgtttgatataaattatattaagtggtagtgtatgtaacattgcattgtgggtagtagtttcctgctttagtctagccacatcctcagctgtcatatgagcatgtttcccatattttctgcaagttctcgcctttttttattattacaaaaatgacagcattcaaagatgaattgttctaataattacaagaaacatgaattacttatacagctacattaaacaagtatggatcactctgcacttcaaagaataatcaaagaaaaaaaagtaatcctcataattaaagtgttaatactatgtgaacaatgtattaaagtaaattagcataaaaggattcaagaaacaattaaaaacagctgaaagaaattaagtctctataatcagatgccaatactatctaacaactgaggcattacatattagaatataacaatttctaatgaatgttaagagctccaaatctaccgagtattcattagtgaggattaatgtcaatatcccctactagaacttaagaatctactttgaggctgtatagaaatgagggaaaaaaggaagagaacccaaaaaagcctgaaggagaaagaaagggaaagaggaggaatgggggagacaggtagagggagagagattggtagagagagagagatagggagagggagggagggaaggcaggagagattgacttagcattttctcttctggcattccacataatctcacatttagacagctgctaaaactaatcaaatgaagttgttcaaacaatcagggaaatggtgctagtttgggtttttacctgatctaattaaaataaactgagaaaaatgctcttattacaaaaagtactacaaaacaatgccttgtatacatacgcaataagacaaatgtgcatgcagttgtgtacataaacatataccccattaaacaaggaaatggaatactgcacagtcaccataatttaacagatgaaactatacatattttactaacagaagtagtcaatataaggccaaatagatcccgtgtaagcttaaacagctatacatcaaatccaaaaaaaagaaaaattgtcaaaaaaaagtaaaataagaaacagtcacataccaagatgaaacaataagttaaaaacttccttcgtaaaacctcataatcagaacattttaagccaaattaggacttctaaagtttaaaaattcctgcatcaaaccattttctcctttgtttttcaaagaatgagcagcaaataaaagaatagagttagcagcaaataagtctaaaataatccttaaaaaaatgcatagaaatgagcacaatattgataaagtaaaactaatgtattaaaatatgatcattagttaagaaaataaaaaattactcaaatggttacaatgaagacacacatagcatttaaacacaaataccttggtattttcaaaagttcaaccaattctaacacattttattcactacaaagcaatggagaagcaagataccaacaactttttttctttgaaattgatttcaagatcaaaactgtatttcatttccatggcattaaagtatgtgatttatacagtatacctaaacttgttgcttacttcaaaacagcaaatactaacatgtccccagagaggataaaattttatgggtctttaaaaagcaaaaataaaaataaaaataaatctgtggttttcaatttctgattataaccatggtataaatctataatcaagagctttatttgcattgacttttctaaatcagtatctcttcaccacgtgtagtaagctatttctaatgaaacacactgttatcaaatgtgtaccaattatcaaatgtgccccagttgtcattgttttttaaatttttacaacaaagtaatatttgctccaaagaggatatattttcgttttaggaaaaaaattcatgtggataatgaatatactaacttaaagcacatgatttcactatctttctcctgctagaatttgataggcctcacagaggacaaaaagtgcatatataacaatatctactaaactctcaaatcctggtccaaaaattacatgcaggaggattacctgcaaaaagtgaacaggtaattaaatgacaaatagatgttaaaaattacttaaattcttatcaggtcaatttgaagagccaaagtttacataaagaagattttaaggaagaaaatagcaaaatgttgggtttgtaagatgtttcagtgaatgctaatgtagaaactataagcttatttgaaaagaagaaaaccatttgctgatcatactacagcagctacctacatattttcaattaagtgattctgctattataggtacacatgaaaccatgtttggaaatcccacaagctataaggacaaaaccctccttttgtttactttggatactaattagagatacagataatatggatacgacttatttataaaagagaaaaaataatttttctctccttcacatgaataactgcatgttaaatgaacgcttttacctttcaatgtaaaatctgtttacacatacaataaggcatgataaatccatagttaaaataaaacaccaaaatgtatttctggttttttatcactaaaagtttattctgaaaaggttctggacatttgaaaaataaaggactagaatcattcccataccctaccagtgtattttgggaaaatcaaattttctgtaaagaaacttatgaacatatttgtacagttattgtgatctaatatgaaccaaaagcagataatgaatagcactaggaagaacacagggatattttagttctaacaccctcctgtctccctagcccttacctccctgcacattccaaataatcttttgtaattcactgtctccgcccaccccatttactttatgccactcctagttactgtcacactaggaagaagtctaacatgcagatttagagtggcatggataaatggcaaaaaaatgcctagaaaattggtctgttcgcctttataattttggttgaaaaatactccatcgctcccaactgatgaaaacaggaagctctattcataaatataaaattcactgcctatgatatataatcatcctaataagaaaatgagttctatacatacttgtccaaaggggcaaaaaaggagatagtttcccaaagatgtttccaattttcttctgaatcagaattagcaaatcgagacgactaacatactctgtctgtgggcattattccttactacacacagcattttgtaatttatttcaaagcttccattagaaacaaaaaaatacatagcttctgttaacccactctattctaagctcatagaatcaaatactgaacaatctacattataacataagcattttactttatagaagatctgctatcagaaactctattaatgtctaaactacttaaagaactatataaactgaatacacttcaatgaaagacaaaaaatattacaatcataaagaaaactaagattcatccaataaactatattacaatccctgtcattcatttttttaagatcttcaaactaggcatgagataatggtatacatgaaacattacatttaatctttattgtaaaggccgccatctaatagattgataataaactagacagacgtgatttaaaatttgtaaaagaatgcccagactaacactttcatgacagccaattatagtcaagcctagcaagcagtttgcaaccagaccttaaggtaaactttttttttttttacaatgagttacagattcacaagtttaagaagacaagaaaaaggaaaacagaaggaatccagccacccagcaaatatgaagcagaccccagaatgtgatacagtccaaagatgtgaattattgtatatcatcactgttgttcagaatttcacacagactcttgagccaattttgttcatttttccacagacacaataatgaactaaaaagaggaggcaaaaaggcagaggttgagcggggagtagaaaggaaagcccttaactgcagagctctgctctacaaatgcttaaccttacaggagtttgggctccttcagcatttgtattctatccaaatcctcatgagtcacaaaaattaaaaagctatatccttctggatgccaggaaaggccttaccacaagccttttgtgagagaaagagagagagagaaagagcaagggggaaaagccacagtggtaggcagtcccactttacttaagagtactgtgaggtcacaaaccacatgattctgcctctccagtaatagtgcttgcaaaaaaaaggagttttaaagcttttgcttttttggattgtgtgaatgcttcattcgcctcacaaacaaccacagaaccacaagtgcggtgcaaactttctccaggaggacagcaagaagtctctggtttttaaatggttaatctccgcaggtcactaccagccaccgagaccaacagagtcagtgagtgctctctaaccacagtctatgcagtaatagtaggtccttcaaatatttgctcattctctttttgttttgtttctttgcttttcacatgttaccagctacataatttcttgacagaaaaaaataaatataaagtctatgtactccaggcatactgtaaaactaaaacaaggtttgggtatggtttgtattttcagtttaaggctgcaagcagtatttacaacagagggtacaagttctatctgaaaaaaaaaggagggactatggcatcaaacagcctcttcagcacagtgacaccatgtcagcaaaacttcttttggggtaagtgttaccatttttaaaatcctgtaagatatgaacctgttaaacataaaggtatgattctttgataaactgctagcttttccaaatagcatattaaagatcctaattatgctatcttgttgcattaagaattgaaaaatgaaatttctgtatatatttgcatttggtatctgtaatgtatctaattttcaaagtaatgacttgaaatatacaaaattaaattatctcacattgatcaaaatgttttctagagttatagaggtgaggatatgaaaacagtaaaagaaacagtttaatactctcattaaccctcaccagaagaaaagtcagatcctaaattaatcaaagcattataaattattgactccggcagctcccaatatttgagcaaacttcaaaaaggaagcaattttacaaaataacagaccacagaattatctcaacattatggtctaccatgtataacacagaaataaacctgtagtacagttaacattttaaccagctcaactaaaagaaatctacttataaattcaaactgtatcctatctaaataagtttgtttctaaacaactttatataagtatacattcagctgaaataaaattatgataagcacatcacagccatttttaaaagatctttatagttgcccaggatattaaaaagttcatggaagtattttaaaacttacatgcaactgcatttttctatgtaattttaattttacatctacacactgttatccatagaccttgttataaacacactgaaacactgaaacgtctaagattcttttaatcacattcttggacctaccaaaatgaataactgctgtttagtctcatgaaaaataaagctccataaggataccctgtatgatttttaaaagccacaactattaaaccatgctggactttaaaagaagtaggcataatcttgtcccttaatatttaatttcaagttactgttgatacagatatgtaaatgactttaacattcatcagctgatgtgttattatagcaaaatatctaaacacacttacaagattctctttatgatctccaacatgttccaactacaaggcaagttttcaaaaatttttcttatatccattaaaataaaccttcttgctgtgtacatctatattaactctgcttttaacttacaactaatgactggagtttcctttactcctcctacttcacacattttaactggatactactagaggatcagtctcagtttaggtcaaacagaaataattaaacctgaagggagaaaaaatggtttctcttacagggtgaggaaatgtactttgtattttacaaaaaaaaatgtaaaattgctttagtgactccctcaatagctgtaagtgggccccctcagttataatatatacaatataataatcacagattaatttaaaattttaatgatgggtaccaagtattactctaaaaacttctatattaaggaagcaggacataaacacagctagactacattacaacacatagcataattacagcttatacatcgaaagttttgttactactacccaagagataaaaggaaaaagaatagttaaaactactgttacacagagggataacttgaaacagggataacagagatatcagggagggataacagaggcagttaagttactctttcacgttatcactctgtttaactatttattttaaacacattttaaaaaccagatcaggaacaacacaagtttcaaaaaattcttcagtattagaagtaaagttatcatgaagaatatgttaaaattctcacaaagaatatattaaactgcttcttattctatcataacagggatcttatacttctgtaacattcttaataactattcaaaatttccaaaacttgacaggattctaagcaaggcatggtagtgaaccttttttttttccaacattacaaccagttcttcctcttttgaaaagtgggctgcaccttccctccccgccagcccccaaacagtatcttgaagcctgaatagagaacttaacatcaacccactacctcagactaattacaggtgagtagtggacatcatgtatatgttatcacattgcaaacatttccccattctataatctatgcaaagcctaaaacctcacttcaggctttagatttttatataatgattatcaccaccacctaatgaaatgtcttaagtatgtgccccaattttgtaaaatagttaaaaagaaagtttaggattttcctaggtgaggtacaaagcacacattaacaactgcttcacctcaaatacaatgagtggtgtgtgtgtgtgtgtgtgtgtgcgcgcgcgcgcgcacatgctagagaaagagtatgtctgtgtccttgatctctcagcatacttcactttgagttaatcaaaaattttcaatctgtactactcaaaatctgtccatcatttatcataaatatagcttgctgaaaatcacagatgtgactcatagagtatcttaaaattaatgactcatgaaaatatatcagctgactgattatctacataaaatctttgtaactgcttgaacatgatgtgtgaacactgatttccaaaacagcaattgtggtccatatcaataatatatttatagtttcaagattcagtagtgacaaagttttatagcttctttttaaaatacagagctaaattccaaaactagggagcagaattacaaagttaagaacaaacacagaaaatcactctaacacatatcaaaagctaaaaatgtcaaagtaattcccaaagactcatataaattattttaaattataataatcctaattttacattacaaactgttaaagatttttagtttttatttttaaaaaatgttttgaaatctaaaacactgaaaagaaattgtggaaaaagatctggctggtctgtctgactctcctgatcaatccgtctctatatcacaaggcatgaaatatacatgattacattatgatatattttagttatcttaaaagaacaaaatattaatttattcaattactctcttccagctaacaactgatagtttgacttgtttaaatcagtcatgctaaagttaaattcggtaagatagaaatgttccagtttgttaaaagaacactgaaatatttgatggttaaataaactgcaggggcggggggagctaactcattgaaggcactaagattttatcaaacacacagaattaatatttattgaatagaaccattcacaaatcaaaactcactgtactccaatactttaaagcagcgctaatcaattacaaaccttttctagtgcttcaaaattcatgtgctttcaattttacacactggtggtcctcaagtactgtactgaggctgagttaagacattctgtatcacaactttttttttcaacaaatattcatctagagggctttccccctccccccgattcaagagctgctcacatgaaaactgtggtaatatttttatactgtacttctttgttgaagcaaaaggttaggggttacctaaatacctcaactgtatatatatatttaaaaaaaaggaaaaggtaagtattcatagaaaaaaatccaatgggactatattatttatttttgcatttctcatgattaatgatgcacccgtgcatacttgaaaattgacggcaaaacagggtaacatctcaaatccctctccaaagcatacaaataccaatcttccatactgttctaacctttgttctaggatactaagatatgacaactctaagtcaatagtgaagtcatgcaaaagctcattaaatgcattaaaactgcaaatactattacctaacaaaaatctttagacattttatatgaaggattcaccgaaacagtctacctctatagcatctattaaaaatatataaaaacatgtgaccaaatagacaaatgccatcaactcaatgtgaaaaaaatccttcctgcaaatactaaaattgtaattatggcaaagcataactattttttctagtcactcacaagtcagacattactaatcaggtgctagcagatccaatggtaatttaagcagagacttctcaatacgttaccttaatgtactattttttctcctataccaatgaacgctgcaacttccactgaagatagataaaattctgcctctcctcaccccccaaaaaatcataaaactcccataataaagataacaatgaactccaatacttggtattttctaaataataaaatattctaagctaactgtctaaagcatgtgaaaattcttcatcaaatctgagatgttagtatcttaaaacaaatctttaaaagaagtctcacataatgaaattttatgccttaatataatctcttgccatttcaaaaagattatgaaattcactggatatattttttgattaatgtgttacgattcaaaaaataacagggaaattctataccttattaaaagggagtttccttacatttttaaccacagtcaaccacaagcttttgtccattcaacagcacatacacatgaaacagaccatacattcccatacaactgttttaagacctgtatagcaattcagattaaatgctcttttactgtatacagtatcttcactttatgtagaattcttaggaatttcctcccctttatactatttattaagggcataggactcaagatttggaacagtgttgagtggatgtaagcaacatgttatcaaacactttaggttttgttgttactgctgaatagaaagaagcctaactaaagcaaagtttttcataaacactaataaacagaaactgcatcatttaacatgatataaaaaacaatcattttttatatcatttaacctgatataaaaaacaatccccaaataagatgagctgtagaattaaaacaggcctttaaaggctagttgctacataagtacttaatacatgaagagaaaaaaattgttattcatgcacttcctctactctatattcttgttaatactcataaatccaatatacacccaaggaacaaaaatcataccaagggtgacttgagctctaaataaaagataaatgtttaccttgattagatgattttcatcttttaaatcaactgcccacaaaacaaggaaatctctgacatatatacatacgcaatttcgataatgtttgagatatttaaaaattatcatactgatgttagaaaatttaccaagttaacattattcccagaaatatatctaagattattttggcaaacagtttaaagactcttttatctctactattcctattgccaattctcttaattatacattagttacatcagattagtgacatttctaaaaaggtatatctaaatatcctatgtaaggcaaataattttcaccacaaagtcaaataaggtaattttattttacatttcagttacatcgattttttacatcaatgatgtctaccagaatcattatataccatcaactataaacatatatttacataatagactaagttaaaactcaagaacttaaatacacatttgtaggttcccctaaattacatgaaccataccattatttacatattccttatagtcatgtatcttacacctacatctattttgtgcttcaggaaaagcaaaaaaaaaaaaaaaaaaaagacaaagttaaatgctagccaaatcacaataacaatcatcaataaggtttgaatacatatatatgcagtctttctttagaaatatcagaataataacgtgatattccacagaacttcacatgaacacgatgtatttttacaccgaaacaaaatacgtgtcatatatgttcaacttaaatttcttctggctatgtttgtcttaacatttttatacatggcatatacacatgcatgagtgtgaatgcattcacaccaatgactacagaacttgtaataatgattataaaccaggaaaaaaattgtaaattatgtaactgaggtactatagttctgtcatgaaatataatcaaaatttttttgcatgtaagttaacaaatgtcaatctataaaaccagtaacagggattaggcatctactaggaatttcaagactaaaataatcaatcttataaaatccaaagatgttattttccagttataaacttaagtaacaataattaaaaactgatatcagttaaacaaagtattagagtttataagggcaaatatgaatggaattaatttgctaatagattcctatttataaatattatctcaaagaacaactctggcttgaagctaaacaggtatattttctcattgaccatgtaacctgggtaaacaatttaagcattgaatttctaatttttctatgataattgctagaattaactttctttttaaatttctgtactgaacttcccagtttaagacttcaaattcccaatataattttaagtgaaaagatataattttactaaatgattacaaattatttaaatgtatctaaacaatgtgaatttactttgaagcttaaaagaaaggatcatgacatttattttactatgtaatatggtattacattttacaacatgtcaacctactgctgtatcactataacgatcctagaaaatccatgtgtatcaaaaaggtacacagtatggattctcttcaatcaattacaattttattataagatactttaatgcaaacacagctcattaaaatacatttttttagataaaagtaaattctcattttatttcataaactgtcagattacagatatctgtaacaactgtacaggatcacagaaaggaaacttctttatgctaacaatccacattatatcaatcactgtgttttccataaagctgatacctgtgaaagtacataagcatttcatactaagaacctaacacccaattcaaaaatattaagacaccatgaagtaatctatgagaaaactcccatcaagacaacagcatcttaacattaggcaggataaatggttacaaaagataatctaataagattaatttttttacctctcatgaaatctgtaaagcatttcggtaattcagcttttgacaaaatgcagaaaaacttgctactgctcttataagagtcaatgcaaaaatgaaatatttaagaagataatgcctatggagatactacttacaaagacaatgtgctacagtgtatttctaaagaaatggaaatatacaagtcaatgtactccaacttttgatcattaatccaacctcctttccacagaagaaactccttttcacatattataaactccagtgtccacccagaattcttctattctcccagttttcaaaaccaaacacatatacattatttctctctctgtaatttagaaggaaaacttaacattttaaaaactttttaccactagtaaccacttcattttaaaagtgttagctagataaggacaatgagtactgtcacgaaagctttattcttgattatgtagtaaagatttaacaatatccctcccttataacacgcataagcatattgcagaatatttttgtacaccaataggactagagaaaacacataaagtgatctgtttttaacattatcactcacaagtacccaggaagaaaatttagagccatgtgctgattattaggcttatttttattttcataaatattctggtcctatcaagacacaagacacactaaaatcagaatctatcaagatacacttaaatattttttaaaacatcaaaatacttggcttaaattgctaaattatttaattattaaatggttaaaccactctatatatgtacaataaatttttactcagacgtattcaaacaattttcttgactataaaattaaatcctgtgctccaagaaatactgtaacacagtatttttaataaagtatttacttacaaagtaaatacatattagatgtacaaaaagataggaagtgattttctataatataacttcattaataatacatgtaactcaaattttctacctctgttttaaactttcttcattcaaatacatggtcaattcacttaatttttttgatccagaaacatcttaaatgctgttttaaaggaaactttaataaaaatggccttactcattattataaactggcataaaaatattttttgaaacttgctgtgaaaacagtgtgatctgaaaacttacatacttaaaacttatgacatgaacacaaaaaatgcaagcaaatgcataaaactacatagcaacaataatatagtgagaagccaaccccgaacataggagatatacatatgctttctaaaataaaagctcaaattaaagcttgccttttgaactgcccatatgaacagaacaacatgccaatgacttacagaatttttttctaaactggcaagactaaaaagaatcacatccaatccctattttgcaattataatgtgtgatactttctttaaccataagactgtcatttattctaaatttgctggaaaagcttgccattgcatttttcctgtacgtacctcttccttatcaattatggtgtatctccagcattcgaagaaaaaaaagctccaaaactttaactgcatttaaaatatataattaaatcaatatatacaagggttactctaaaaatactcatttctagaaggccagaaaatcttatttttttaagctgatgcatctacacatagaaagcaacttttagtaagttcttttgctacgccataatgatctgctccagaaactcaagggtacctaaaacaacggactacctgttctagccatgcttaggaatgtgtccaaatcatttttattgatttaacctttataggaatgctacatatcctcagagcaaaacattttgaatgtatttataatatgatacacttctagaagccatgaaaaagaaagctaaaaacaaatctaagacgcccctccactgttggttgttatgtttatttttgtttatttgaaacaaatattaaatacatattaaataattctttttgcgaaaactcactttggtactactgtaagtagaaataagattttatttttttagagaaaaagtatatttaagtaaattctaactttaagaaacaaaactcctgacttgacaatgatgttatcacctataaattttaaaggattctaaatgcttctttcatactctaattacacattaatcatggaacctataaacaaatcaaacttaaacttacagaatttagtctttattgaataaacttaagttgtactctagttttcatcctcagagtttacagataaagttctgtgtagcctatctttctagctttctgtaagttgtactttacaaatggtttcaacagctaatgcctgtattaggtatgtttgccaaataattcacaatattatgcttcctcacattatggttcagcatttgctaacttaaacatcacctctaaagaagttatactttcactgcagattgttctctcaaaaaaggcaaacaacttttgagcatttccagatgtagctctcataaaaaaaaaaaattataggcaacttctcaagaaattctaaaatcagtaataaaaatacaataaaactggtatcatttctgattacttcaaatgatcacatataagcttatataaaaagctgatggtactatattttgaattaagaaactttgacagctacaagagcactgatttcaggtagctgccagtaggtaaaacaaccaagtgtatttcagtgtcaaacaagattctgctgaactggaatttaggaagctctgagggttactgaccatgtgataaaaataataatactatctttctcaaatagttaatttatttttatactgggcaatataaatttgggttcagctatactatttcgttttgtcatcaatttttttataaaacatccaagtatgcatgagattatgctaaactaaaataaaaataatttatatgcagcctatttctctggatgagacaagggaggcatccagggcacaaaatttaaggaggtactcactcttgcacagtcctcaaagagacagcctccttaaattttgtgccctaggcactttgcttgcctcatacaaattctagtcctgagctgaagacacataagtataaactatttacactcatgtgagtataaaatgacatgtaataagcagggtgacataaaacatagaaataaggtaatataagaagaaaaattaaaaataagaatatttacattaaagaagacatacttgccataaatatcttgcaaactaagatagttatggccttattgcttgactataaggctaagtaatcttattacttgactataaggctttaagaaaaaagggattgaaagagtattccattaaagaattcactagcctatacaagacttcttatgttacagtggtatccaaatctggctgatcaacagaattacctggggagtaagtcttggggaagagcagcttgtggagagaaagccttcagaacttttttaaaacaaaactccctagataaattagccaagattgtgagccaatagatagccaacttttaatactcctagaaataagctaaagacaaaatgcatatccaaaatatattaattccaaattgtgtccccaataaacatttgtaaagcttgttcacaagaaaaaattagttcctttctttccttccttttcttccaatagaggtgatagtcaatggttatgtgtttaaccagtaatattaataagaaaaataaagttgtgtttaacaagctatattaataaggaaaataagaagtacagaggattccataagatgactatagccaaaaacattaatattcttatttttctattaggttcaaatagctattctaagtacataatcaatctaatccaaaactttattttaaatgttgttttaaattatttaaaatttattaaagttttaatttaattagacaacatattttgaaaaatcaatgtaactaacatagtctataatttttatagagtataccttaattgaaactgtactttgttagctttcattgtcgagcgtttactgtaccgggtactatgctaagccatttataaacattatttcctttaattcttacaactcccttatatgagacatgtatcataattatttacagatgaggaagctgagaatgaggtaaaggaacttgctcaaggttacagagttgaagagatgggattccaacccaagccttttaactcttaattaccactttacagtgttatacatgatctaaatgaagttacttcctagtcctcaatcaatttcatctgtaaaggtgttagttctcagaaacataattattctaaagttattaaaccaataaaatacaaacaagaagataatcctggagtcttcaaattaccctgccacatatctttaagaaatactaatctgacagaaccaaagagattaagaaaaaataaaagtatatcaaggaataagattaaggtgaggtttgttaagcccccttccccctcaagacaaggtctcactctgtcacccaggctagagtgcactggcatgatcacagctcactgcaactttgacctcctgagctcaagggatcttcccgactcagcatcccaggtagcttggactacaggcacgcaccaccacgcccagataattttgtaattttttgtagagacaggtttttgccatgttgcccaggctggtctcgaactactgggctcaagcgatcctcccacctcagtctcccaaagtgctgagattataagcataagccaccgcacctggcctttaggtcgagtttgatcagaaaaaaaaagtttcaaggaattagataattcttaatcattataattaatagtcttaatgtccacaatacacatatatactctatgtgatataaaaatataatttaggggtaaaaaattaaacacttaaacaccaagaatgtctaatcctcatttataaaattaaaataatcttgtatcataaatatgattataatcataggctttggtgtcagatctggaatcaaatcctacttcctatatttatctgtagcattccttatactatggtctcatagccccatttacaaagacctatacccctacacatatgctaagtgatccagacaacctttatttctaagctttaacttctaattataatttcttaaattctaattcatttgatattcacaaaaatccactagtaagtgtactttttcctgtgcctaccaaaaaaatactgcacaagattctaagaagtaaatccttgacatgtactattcaccccaattttaaccacaattatccacattattactcaaaacaaaaagttctcaaacaagccacaaaagtgctccgcttttttctctggcagagggtaggaataaagctatgagattatatttttcagtctatatggttttgagaaaaaatgctgattagaaaccataggttatgatatgatacatgagatattttgcaaagataaagcactaaggaaaagagaaaagctgtttggggatctatgaatctcaacagacttctccaatcattctgcacctatatttaacttgataggtaatattttaatgagcaaactaacaacttttaaaagctacatgaggtaggatcacactaaaataaatacatatgcaagtataaagtcataactacattttaaaaggaaaacacaaattttcatattagttttcattagaaacatccactgaaaaaggttaaaagtgagtttgtctccgcaacttcataaagagtacaatggcataagactcgaggtaacaaaaagaaaggaatgaaatggcaaaatgtatacacatgaaaataactacggaataacagatagttaaaagtcctcagcagtagcaatattattacaagttctcagattctggtaccctatctggcaatgaaggcaagaagttagaaaaagatgtggttacaaattaaaaatgacacactaagataattcatcgcttttagtttaaaccctacaattattcacacttatttcatcagaagccactaaaaagatgtatgaagatagacaaaaggttctgtgtacagccagaacagtcaaccaaaacagcagagaataaattcacaaataacatggtgatttagtagttattaacctagcattaaaaaaaaacggagactggactgaaaaatatgggcaagttgaagagatattacaaagaaactaacagaagaatttggcagcagttatggaagaggcaaagaataaggaaaatgagactgccacttaggacagaatggttgatggtgccaatgatcatgaggaaaataggaaagggtttttattataaatagaatgagttctctttgtcactacagttgtgcctagtgaaaaaaaaatagaatactaagttatatataacacaatctcaattttttttttgagacagtgtgtcgctctgtcaccaggctggagtgcagtggcacaatctcagctcactgcaacctccgcctcctgggttcaagcgattctcctgcctcagcctcccgagtagctaggactacaggtgcgcaccaccacgcccagataattttgtatttttagtagagatggagtttcaacatgttggccaggatggtctcgatcttctgacctcgtaatccacccgccttggcctcccaaagtgctgcgattacacgcataagccacgacacccagccctacaatctccatttttaaaaataatatgagagtgcctctatatcagaggaactcaaaacagtcataatataaggtttacacagtagcaggattttggaagcctttttttttatttgccaatatttttcaattaaaaaccatcaatacataaaatttcaaaaatttagttaatagtttgcgttaatgttttaaaagcttatttttcctgaacccatacaaaaaaatacatatgaagaacaatgtttttaatttttcatgctcaagttgtaagaaacagaacaaagtcctccaattacaagatatttgtaaatcgaaaaagtattctcatgaaaaccatagaatgtcatggaaacacaaggacagcaggggttttggtgttaagtttaaattccagttatagcgcctagtacataaccctgagcaaccaacatttaagctccctgtgtctcaatttcctcatctgtaaaaatattaccacctaccttgaaagtttccagttaaataaaatgtaaagtgtctacactgatctgacaaaagcattacaattattaaatataatcaactttccaaaccttaaatcatcttaagtctaaactcatactcatagtgtggctcacaaaacagcagaatcagcatgacctgaaagcttgttaaaaatgcagaatctcagccgggtgcagtggctcacacctgtaatcccagcactttgggaggccgaggcgggcagaccaagaagatcaagaccatcctggccaacatggtgaaaccccttctctactaaaggtccctaaagttgttcacttgatctgtttcagagttctgatactgagtgaagagcacctggtagtttactcttaattctgaaggactcgagagactaacagagatcatctaatctataataattgcacctccaaaaggcagcttttcaaacctgaatagaattttcacattcatacacccctcagtttacccacaatgactgattaagagagaaggtcctatgtacataactctctcttgtaaaaaatgccttcaataatttgagacattctgcaaattattaagttgcataacagtacgaactagctactagtctatatttcttcatgttgtcaatgatgtctcaccacaagcttgtgaaaagccttgatgaagtttaaaaatggtgtctctgtcccatgttcctgagacagctatccagtagctctgatgtaacacagaagtttgtgaggcatgactactgctgaggaaaaccatttggctccaactactcaccttctaggtgcttaaaatcatgcttttaataacccatattagaatcttagccatcaaagacctccacctgacaggtctacaggctttcattttataaccagttgcccttgatattctatactagttgtttactggtaaaatattttacaatcacaggtgcctattcctgtcttttttcctctccatgactactaattgaataaaacagaaaatatgagacaattgtatatatgaaaaattgtcaaactaaagagcaattcaaattccttttattcggagagataaaagttgatatgaagtggatatgacaaagagaaagaacatccactaaatacttagtagtatacaaagagttagaccatgacaaagttcctagaagtttagctcctctgcaggggtttcttagactacttgaaccagaattttcaatcttatttcttatacagttgggaaccacttcatttatacttggcctaaacttccccttgtctgtatacttatttttgctctccacccttaaaactgacttgcccttagctataaacaatgtactttgttgcccattcatgcagtgctttattgttttcattctctgatggttttttttttcattcatgtccaaatgagcagtgccttagattctaaatatccagtggagagcccatatatgtacattttcctttgaacgtctagaacagtaacattatcaattaagtacttaactgctttacgatatgcacaacaaaaactattaagaggccacaaaaagctatgcctaccacaaatttaaaacccattaaaaatcaggaatgtcaaaagcatgttaactttttaggtaaagtgtataaactagctcttcatggttggctaggaaagcctagagaaaaaaaatcctaaatatgaaaggtgagtctgcctttaagacaaaagagaaatatacttggtggacctaaaaaagaaggccacttcagaagttaaaaatgcagtaagccaagattcagactatgacaagggagacggtaaaactaatggtacagaatttttaaatccctgaagtttaagggactctttacaagcaggatagtttagtagttgccatggactatgctctgaagccaagcttcattctggtgagtttagaaatctgtttcacctagctgaatcagaatttagcaaactgatttatgtaacaaaaaggctgtacattaaaacgttcctcatgggatgaaacagaggagaaactacccactcatctgcgctgcctcacatggatgttttgagatttaaatgagatattaatacaagatgtcagaatacttataaaaatctttgacactttataaaaatatcaaagataagctattacaatttagtattataaataaaacttctgttcacttgattgttaaagactgtaaaatgtcatgctcaaatgacatgttttcctatttgctatgaggttgacagtaaaacttttgccccatctcagcaaccagagggactttattatatgcatctctgcagacttttaccttctagattaattttgtatctctattcctttcaggcttcatctcaatttccattttttaatcctttagtattataaataattatgatagactcctcaaccaggatacaaatgataaaccaacgctcaaacctgcagcttaatggcacgatcagcttgctagtcctctaagatagaaaccttggaatcatttttggtaactaattctctaatctcataaatccccaagacctaacaatctaacctatgcaatatcacttacacttgcttgctattcttcattcccattccctcttacatggactactacaataggtctttccacagccaactcattttacatgatgcattatcaattcttcttaatgagtatcaatgcacaccgtacctttatctttcaaacatttttcaaaggtttccaattgtctttgaaaaagacttaactcctcagtctgccaaagcttgccacattttgatactaatcatgttttatctgtattttctatgacccagtttctctctagacacagtaagctatttgctccaaatgcctcatccctgcctctgtgtctttgatcatgctgtctcccgtacttgcaatattccctacctatcctcactgtcaccctacctacaaatctctacagggctaaatattgcctatccttgaagaaaaatctcaaacgacactattttcactggctttcatcctccaaattgaaaactctctgatccacctccatattcctatagtagcatatctgtaactcttttcacatacttacctgcatctaccacctgtcattctctcagtttctatgtgtgtaagattctcactctacttatgtatatatgtaaatatatataattctactagacaggtgatactgaagtttttaaattgcaaaatccattgttcataggaaatgctatgagaaagcccaataaataaaatagatttttaaaggagtctacagggttgaaacgaagaagggtgagagggtagctagaacctcgcatgccctcctgagcagccccacaggcaacttcattaagcacagagatacaatacagtacactaaactacacactctcttggtagcacagatacacaagaattccctctctcccactcttactttcttttcacatcatctagccaaatgcctggcatataataggaattcaataaacatttctttttttttttttttcttgagatagggtctcactctattgcccaggccaaagtgcagtggtgcgatctcggctcactgcaacctccacctcctgggttcaagcaattctcttgcctctgcctgactagctgggattacaggtgcaggccaccatgcctggctaatttttatatttttttagtagagacccagtttcaccatgttggtcaggctggtctcaaacttgacctcaggtgattcgcccaccttggccccccaaagtgctaggattataggcgtgagccatcgcgccgggcctcaataaacatttcttaaatgaattaatgaaacattaggtggaagtggatggacaaataaacaagtgcctaaacaaaaagtaggaggacttagcaaagggacgtggtaacagctaaagaaatactatataagaaaagaaaatgccttaaaaataacttacatggctgaaaagagaggtggtactttatataattaaaaattgaacacattttaaataaaaataccccacaaatatgtgtgagtttactatcaaagaaagaagctaagactaaagaattatttacatgtatcatattaagataagtgaaataatgggatatctggctaacatctaaatttaatttatattcaacaccttagaattaagagatatagtaaattaaactacagtgaataattaaatttctttaaaatgaattcgatttcactgatatatatatgactgttagggaacagtgttctgattttaagatgtatttccttctttctcaagttacaaatgtaaagttctgcaattgtatttaaaatcttttggtggtagatgtacacaaaagaaatacctcaacataaatcactatggcacataatgaacccaaaaggaatatccatgtatcattataggcaagatgttaagtttgagaaaaacaaaatctgacctttaatatattttttaaactggttaataaacataaatgcagcaaggcttacattccatatatttttaaattccccagcattcttggggtctgtctgcaaaagcaagggaatatgcacatgacagagaaaaaaattttaaataaaagaaacataatcctgtgagattattccctttaaatagaagagtgaaatccaaatactttatttttctacatccaaaaaagaacttcacaattcttttttttaaaaaaaaaagacgtatatttcattaaaacactgtttgtctatttatcagagaataattctgtattcacattgtaattactatttttaaaaaatactacatgcctactgaaataatgaaacagaatgtcagtatggttacctgtgaatgaaaaaattatttccctccttggttctagagattccaaaatctcaaacaaatgcattacttttacaatcagagaaagtttaaagttatataaataggtatgtatgcatgtgtacacatgtgtggatatgtggatatgtgtatgtatccctctaaatggcctgcttatgtctagcttatagtttttacgttaaaagcagcacctttctcatttccatagaaatgagaaaaaaggggcatacttacattatttaataattaagaaaataagtttaaatctaatataacatagcagttaaaagtctgactctggagtcagaaagaccaaatctaatcccagttctaccactgaatagctggatgactctggaaagctatttaatttctattaaagaaattctaaattctaaaaaaaaattctctaccattagttttatcgtctcctcattttcttaatctaaaatttggcaatagccaggcacggtggctcacgcctgtaatcccagcactttgggaggccgaggtagaaggctcacttgaggtctagagttccagaccagactgaccaacacagtgaaaccccgtctctactaaaaatacaaaaaaaaaaaagttatccaggtatggtggcgcatgcctgtagtcccagctactcaggagactgaggcaggagaatcacttgaatccgggaggtggaggttgcagtgagccaagatcccaccactgcactccagcctgggtgacaaagtaaaactccaactcaaaaaaaaaaaaaaaaaattggcaataatatcattcaactaacaaggcattaaatgaaataatatataggaagatgttagtgcacattacctatttagtgatggaagtgatatttcctcttcccacaactctgtgtaaccaaaattcctatcgatccttcatgtttcagcttaaatgaactctctttgagaggctttagttcccccattacactatctcatagtatcctgtacattttccttcagagtccttatcacaatttataattatttatttccacaaatgtatacacagttcatggcacaccacatgtacttagtaaatgttgaataaatgaatttatgagtggaaagaggtttataatctttccactggtatcattaaattctgtcattacgtaaatcagtgggatcctgattataaatgttactgcctataatacaaatggggtatttaaatttcaatttagttcttctagggacaactacactagagggggaaaaaagaatatcgctagtatttcagtctacttctacatatttaaagtcacaattatggaatcacaataattctctatattttgtcccacaatcttccatttaatgagtccactaaaataaggattaagaaaaatgtgggttctttcttggctttcagtttacctgctgagttttctttaagtcaccatctgctacggctatgattaaattagctacttattgataaatcggggcactacaagatgacattatataaaagcactagttttccaagtatggtctctggatcaccaacatcaacatcacctgggaatttatttgaaaggcaaattgctgagttcacccttgatttattcaatcagaaaggctggaggtgagacccagcagtttaatggttcagcaaggctctcaggtgattctaatgcacactaaggtttgggaaccattgcactggaagattcatttttttaagtcataggttgtttcactggttttcatcaatttgctgctctttatatttcatcattaaaattatattatttcaatatagtctctaaaatactctgaagtctgacaaacaggtcatctgtcagaatataagaaaggcaaccaaacaatgattgcttaacatacaattccatccactgcataatcagttcatgttgtcaatgttctcttttattcaaaattaattccttttacatctccttttaaataaaaagatctttgcttcagaaaagctaatttcaagtaaaattgggaagtgactcaaataagcaattactgttttcaaaggttttattagtcacaggaaaaaaaattactagagccaaaaatataaagtagtattgccactatatgtaaagatacatacaattaagtctaaagtttttatacacaaaactataaactgcaagaatacagtttactacaaaaacaaaagtatttctgagaaatgagaaataaaattgatatttctaatacaattagaatgtagccctgagattaaggattttgtgtttgttttattcactgctatatctccagagcctagaatggtgcatagtacacagtaggcacccacttggtaattgtgaatgaataaacaaaaaacatttgtatataataatcttctagattaaatgtggtctgcccaacaggtgctagtctaaaaactgtttcaagtacacaataaaatacaaggaatttgcaccagaatgtaaatcaattacattaggtaatttgtaatacacaccatttaatttctccttttatcacaagaaaactatttcaacaaaggaagcagggaattggtttacattttggctcaagctgctttctcacagaagaccaataatagtcacaaacttgctgagtaacactgctttagactaaatgttgagagtagaaatgagagggaaaaatagggggatgaaaactaacttcaaagcaaataataatttctaaaaataatttctggctgctaagatgtggtcataatcatattactatgccttttaaaggaagcttataaaacacatgaaaacaacaaaaaattttaaggataagctctttttgtcagctaaatgccaggttctaatcaggaaatttaagatatcccagtagtgtctaaatgaatgaagtctttacattttcagacggatttataatagctcaggggtccccaacccccagttccagttcgtggcctgttgggaaccaggctgcacagcaagagcgaacactaccacctcagctctacctcgtgtcagatcagtagcagcattagattctccgaccctatagtgaactgcacacgcgaaggatctaagttctgcgctccttatgagaatctaatgcctgatgatgtgaggtgtaacagttgcatcccaaaaccatacgccccatgtccccaccccaccaacccaggtctgtggaaaaaatgccttccacgaaactggtccctgctgccaaaatggttgaggaccactgtaatagctggtcacagaaactaagatacatacaaaaaaattatgctctaaattagtgaaaacacttcaagtatacaactcactcatcacttcagccactcccacagagactgccctcctacgctatactaacccatcaagatcacaacttcctatgcattctactaaattcaacacctaccaggcatacttacgtaccaggcactgtaaaacatgaaatttaaaacaatccccataatcagggagcttatggtgaggaagagagaaaaataaaaagatcactgtaacatagtaaaatgaggacttaaaagagtattataagttaccacagcacacagaaaggaaactgagtggagatgtcaaagaagacttccaggacgatgagatttccaaggtgatacttgtattttctgttacattttctgttcctccagctctcttaattactacttctactctacctagttttatacttcactaaaatctccaatcccttctccctccccatttttctccaaattgatcaactccatactttctattctatccctcccaaccagcccaaagttagtgatcagaacctccaacatctcaaatttcaatagccttctgccacatctgcccttcaaatacctaaattaacccaattatctttctttcccagccctatgcccagctgctgagcactttgaaaaagagtaatacagcctgttagaggccttataaatgctgactaagctcagctgagtcactgacaacttaggcaacaattagtatactcctaattagctttctgtccctaattctaccgctgacacaacaaacctttaccactctcttcaaactcccctacctcaaatctttgccatcccaaccagctgtcttgcctgcttccttaaaatgatatgaatggtaattaggcatagctgaaaataaatattacctgaccttttttataagcaaaagaagtgtactgaactacagcaatctaactaaaaatcctaacagtatttcattgagaaaagagtcagtcccaaaggacttacaaataacctttgatcgtctacctgacaatttcagccttagaaaatacaataaaaaatatgaaccaaggagtaagcaaacccctctcaaaactgatattatgtttatgcaccaaagatcaagtagtttttttcagaaaagaaagtgtatcaagttttcctagtttatgaactcttattatagatacaaatctaataaatttgattactatactgttgtagactggaagcaacattcaaaaggaaagaaggtgaaacattgctggagtctggtatgacagcaacaaaattaccagccaaggggagagaaaacaaaaactataaaaataaatctataaattcaaacaaaattacagattgggactatttatcctaggaacaaagtacattttatgcttctatgattcactaggacatcactgtattacaagtagagtactatggagcaactgtacctagtattctgtttataagtagtcatgaatattcataatctactgtagaaataatttctttaaaatagaaccatttgatcacttagatcatgtatttacaaaataaagaatacattaaatacctttattctttattacttatattgcatagatatctacatatatataattctattagtcagaatgcagttttatatatctataaaaaaattaaactggtcatttatttccagctatgactaccattcaaaattaagacaataactgcatgatttaaaattgagggaatagtttggctgatttttacatactgcagtcacagcacaattctacattctagcaagaaaaacaaatattaaagaaaactgagaagttcttcagagtctctaatagtacagtagttaaccggcccactcattagtcagttgtttttactgtttctctccagtgttgtttcaaataaactttctaaatgtaaaatgatttcattaatcaactttaaaagtaaaatgaattgcacagaccaatgtctgaaatctgagtacacagcaaaaagcagaaaaagaaaagaaaaatgaaactacttaaaatttgcacttagaatttgttttggaacttgataaaatgattcctaaaaattcatctggaaaaataaaaataggaaaagagtcaaaaatattttaaaaagaaaagttatgcggatggacttgaactataatactaactattaaaacatattaagaagctataataactaaaataatgcagtactggcaaaggaatagactactcaacggaacaaagcagaaaagtttaaaataatttattatctgataaaggtagtatttcaattctgaggagaaataaaggcttatataatttgagatggtaagtacactggcaaatcaatttgaagaaaaattattctaacttagaaccctccctgacatcataaaacaaaacaatggattaaatattaaaccatagaaactaaaaatatgaaatgtaagaaagtgcatgaagatatgtatcaaaatcaagggtaggacattctgtcaaagacagaagcaataagatatataagactgattcaactatatgagcaatgaaaactcatttttttttttaatcactatatacaaaccttaaggcaaccacgagatttaggtgctggcggggaaaatagggaaaatgccaaatataatcaaccaaaggtcagtgcctttagtatatcaaaggtccttaataggaaaaaaaaatacagtagaattatactaagaatacagacaagcacaaaagaagaaataaaaatggccaaagtattttcaagctcagttgtcaaagaaaagctgaaaacacaatatttttactgttaaaaattgtcagggaagatggagggaggtgctctcataacttgatagaaatacattagttcaactttcctgtaggaaaaattaggaagttagtatcaaaaaagtctttagactcaaaaattcctctatgactttcaaatagtaggtttcaagattccattatatcatttttaataatagtggaaaaactggacaaaacctaattacttaacagcagggattaaaaataatatgatagatatacacacaatgaaataaaaagatctgataacatagttgttcacaatatagcaggtgaaaggaaaaaaggacagttgccaaaaaagcacagtaatgactaaaaattactaagaacataaaaattaagtcacacacaaatgtacacaccccaaagtgtatgcctcgcttggaaaggaatcatagatgcttttatgatcttcttttttgctcatctgtgtgaggatctcattacttctactgccgctgctaactcattcagggattgtctcagtttccttggataataaggggcttcactgcatttaaggcttcctgatttattcaaacagtaactacacaaatgcacgcacacatacacacacacacacacacacacagtctcctatatgttgctatgcagagatctctagacacatttaaaaaaagaaaaaaaaagttttaggccaggtgtggtgggtcacccctgtattcccagtactttgggaggctgaggcaggaggatcgcttgaggctagggtttatagtgcagcttataaagataatgctgtgtatttatcaacatggaaaagtcctgtgatatatattaagtaaaaacccaagttacacagtagtaattataatatgggcttttggtattttttaattttttgtatgcattggaaagaaactggaaagataaataccaaagccttaatagcactttgaggttttttttggagacagggtctcactctgtcacccaggctaaagtgcagtggtacgatcacaggtcactgcagactcaaccacttgggcttaagcaatccttccacctcagcctcccaagcatcaggagccacaggagcatgccaaaagacctggcttttttttttttttttagagatggggtaccacagactggtcttaaactcctgggctcaagcaatcctcctgcctcagcctcccaaagtactgggattacaggcatgagccaccatgcccagctccaataagcactttaatttaatttaatttaataattaaggtgttaattatgaactttctgtattttctaattttttccttttcagaaaataatataaactgtctctatgaggaagtataaaaaatacttcatttattatagaataaaatgttgatataacagttcccctacccataaaatttccagggtttttcattgggggtgggggttaattgttcctaaaatataaaatccaccaatacagaaagaagtgaaccaagatcttgcagctccaaacctagtcttctccactgtatcatgctaccttaatcactcagatgtagcattatttttctttgtatcaatttgccttttgaaatatttatatttaattacaaattccagataagtgaagttttatttctattaaaaataaacattaactatgttcacatacttctaaaggattagagatatataaaagacattaatatgcacaaattctaaattggaagaggcagaataaaaaatactatcagtgcttgacttagaaatgggttgtattccaagtctgaatgtttggaaagtaattccaaccaaaaagaatgttatttttgttgaataaataaatattaattgattgccaggccaaccccaaaaatttaatttccccccctttccctattaaacacacattactaaccagtgtaatacaggaatagagagaaagccatgaaaggctaatagaactctactagccatggcaaaaactggttgtaacgtagttgttttaagacacagaaacctatgaaaggtaagaagaaagcagtcaaagataatagattctcactcctcttctctagaaaagtggttgtgtactctattctgtcataggaaaaaaatgttatgccaattagaaaactttctaatgactacaacaacatttttttcaaaggcatatggtatttcacagctaaggttttttttaaaatctacataggtgtccaaaaaagatatatttgcaaaagatggcatactcatttgaatatatattttttatatattttagtatattaaaaacacacacacatatacacacatatatgttaatatatgttaacatcttaaaacacattggaatatatcaattctcatttctttttttttctttttttgagacagagtctcactctgtcacccaggctggagtgcagtggcgcaatctcagctcactgcaacctccacccaccaggatcaagcaattctcctgcctcagcctcctgagtagctgggattaaaagcgtgtgccaccacgcctggctaatgtttattttttttttagtagagacagggtttcaccatggtggccaggctggtctcgaactcctgactgacctcaagtgatctgcccacctcagcctcccaaagtgctgggattataggtgtgagccacctcgcctggcccaattctcatttctttggctgtaatgtaaaagtgtccatcagtctcacatctagagataatcaaaactgtgctttggcaaacttaactatcatgggacttcagaaccagcaaaaagtcaaaatcaacaagatttattccactatattaagaatttactactcttttctaaaattacactcaccttttttaatttacagaatttactgtaacgaggcaaatcaatatataatataggcatcaaatattaatttcctatctaaaactactaaccactctctgatatatttttagtaatgaagaatccatttttttcttttctgagacggagtctcactctgtcgcccaggctggagtgcagtggcacgatctcggctcactgcaagctccgcctcctgggttcacgccattctccagtctcagcctccagagtagctgggactacaggcacccgccaccaagcctggctaatttttttgtatttttagtagagacggggtttcaccatgttagccaggatggtctcaatctcctgaccttctgacccgcccacctcggcctcccaaagtgctgggattataggcgtgagccactgtgcccggtcaagaatccatttttatctagtaccttttttattttttattttttgagacagtctcactctgttacccaggctggagaacagtggcaggatcatggttcactgcagccgtaacctcctaggtgcaagtgatcctcctgcctcagcctcccaagtagctgggactacagggcccagataattgcttttaattttattttctgtagagacagcgtctcaagtatgttgcccgggctagtctcaaaactcctggcctcaagagctcccctgacgtcagcccctcaaaagtgctgggattacagacatgagctaccacacctggtcccccttttctaaagattaattttgaagctggtacatttaaactaacaagttttcaaaatctcaccataataaaaataatgaattgacagaatactacataacattgctaattttacagctaccagaaattttgtaaatctagctacataaaaatgagaacctaaaactcacaatgacattacatattcaattacacatgctgacataataatgaagtgtaatacattcagagctacagtcataggatttttcagaaagactaagagtatatatatatataaatacattcacaaaagaacatttttaagaaactgaacacatttctttattattcatactttctaaaaaatggaacataaatgtaatattaaacttctcaatcaaatctgacttgccaaagtagccaaaaattaacatcttcaaagctataaagaactgtgggacaatgacaacttaaaaaagagagacaggaaaaaagtaatcaatgaccgtgttaaaatcaaatataaaaacaggttataacatgtaaaatgtatttttcccatctcaataaaaatgtaacagatgcaacccagaaaagaagcattctataaataatttgtatttactatatttcttctgtgctgcccaatatggtagctgtttgctaagtttatggctaaacttaaataaaatctacaattcagttgctcagctgcctggcttatttaatatactcaataggtacacatggctagtggctatcacaccggataaaaaggaactaaaatttctatcactgtggaaagttctacagcatgctataatgtagacaaatcctttcttctctataattatgaaattcttcccattaaattgcaaatatttccccctatacttgaattactttttataaactccttaatcagtatgttgatgatgatatttattttttaaaaagataatggtaacaagagcacaatgtttatcatctgccaggaactacactatgtgttttaattcaatcatctcatttaatcttcgtactaaccctgtgaggtagatacaggttcacagtctcttatctgaaatatgtattgcagaatataaagttttcagatttttgaaagttaatactgtacataaatcacataatactttcagcagagtctagagaagcattcaggaacatggtgaaacgtatgaatattcactctaaaaataaaaaaagactataaatagctatatatcaattacagcatggatctaccatcaaattagttcagaacagagactgccactctccagtgtgataatcagcaattatactgcaattttaggctgatgggtctgtgaatttttacctatttttccccatataactaaggattttcatcacagaattactcaaataacttcatctacctgaatttcaagaattcatttctgtaagtaagcaagacacttttttccctggtaattacacatataatcctaaactgaaagttctagttattatcttctcatgagagaattgatagtaatatttaaataaaaaaatcaattattttatgtagccacatttataaaataacattttttaacacaagcacttaatttcactggatctagaaacttaaacatttcctatttcatttctgaaaggaaaaaagactttccattatgcagtgtttttatgttctcaatctgcttttatacataatatcactttcaggaaatctgcctttatacatattctcacttacattacaatttgaaaatattcctaattactattatagttataaactaaagtatatcttaaaatatcccaaacagatgcatttcacaaaaagtaaatgggtaagtttaccacatattttagtgtaatttaaatatcaggaagatcaattattatttaacagtgaaaaaacacaaaagtaggatagacatttaaatattcaaataatatggccacatttgtatccaaaattatgaaataacacaaatacaagcatctaataagtatatagtaagtatataatttctatgaaaaagtatactttcttttggttactgatatgcccttgctgaaaaagatctgttgttagatataggaaactgcaacaaatgctatgataatataaaaatgacaggctgggcgcagaggcttatgcttctaatcccaaccctttgggaggccaaggtgggaggatcacttgagcccagaagttcaagaccagcctgggcaacacgacaaaatcctgcctctacaaaacaatacaaaaatcagccaggtgtggtggctcacccctgtagttccagctacttgttgaggcaggaggatcacctggtccttgttactaataaccgagcaatcaactgaaaaaacatttagctttcacattttatttcattatagcacagtagtcacacataaactgttgaaagtcatttataaactaaattttgtaaatcaaaataaaaagtttattaactgaaattagtttagcataagtgcaacagcacggaatctggagtcagacttcctggcattaatccagaatttgccactgactataggataatatttggtgagttactcaacctttgtggctctattctttcgtctataaaaggggaataatagcatctaccctcacagagttgtgtgaggatgaaatgaaatggcatatggaagtactcaagagagtgcctggtacacagcatgttctatacaagcattcattattatcactgatattattaaagcacccttggaattacagtatgttcgtactttttaccttcagggtttttctttctcccagtttcctgaaaaacttaaatgaaccaggggaacaatatttgaaggaagcctgtgttagcttaaaaacccatctactaaaaattcagagactatacatatcagggctctctaaagtcagatgaagggggcacacattctttcacagctcatatcttcataatacttaaaaaatagtcaaatgataccatttcacatataaaacaaagctctagtacactgcagcaatgaataaatggtcattgctatttatcccaaacactctcaggagaagaagcaaatcttactgagaaaattgttagttcagttttggacattctaaatttgaggtgctcgcagaacacttaacagacattccaggaagcgggcagaactacagacctaaacgtaggtagcttatcctcagaagagttcctcattccctcctttgtactaccatggaatttttcgcatcctattgcattacaaatatttgtctccttctctactgctagactatatgcctcttgaaggcattcagttcctgccatataataaggactcagtgaatgatttttagctgggcacagtggcacatgcctgtagtccaagctactcaggagatgggggcaggagggtcacttgtgcctaagagtttgaaaccagcctggcaacatagagaccccatctcaaaaatacaaaggtaattttttaaaatgcaaaaattgcagaactgtacaatttttaaaatgtattttattatatataagaaaattctgattaaaatttttttaatttgtggatgttagataaggatgaaattttcatttggaagaattcttacaatataaaagtaacatgtaaacaagattttttcaatgttattgctatttatccccaaaactcccaatttttaaaaacgtggtgacattataattactaagcactactgagctgtgaaatctggcatcattatcatcaggcctgtaactctgaaaaagtacatgacaaggcaagaaatatataaatgggtaaagtaaggaagaactcagagaactcagtgaagactctcaaagtgcatttaaattaattaaaattcttaagaagtttgttaaaatacctgtaatgtcaactgaaaagatttcactttcaaatttacaggctgcttgagttcaataacctaaaaatgaaaaacctctggaccattccagtacaggttattcaaaggagctgtgataaagagcatatagcaaatgtgctcagttatatgcactaggtaaggcacaactgctatcatcccaacccactaacacttgttagactactaatcctttcctttcaaatctgtaagaaggggccaggcacggtgggtcaagcctgtaatcccaggcactttgggaggccaaagcaggtggatcacttgaggtcaggagtttgagaccagcctggccaacatggtgaaaccccatctctactaaaaatacaaaaatcagcctggcgtggtagcgcatgcctgtattcccagctacttgggaggctgaagcaggaaaatcacttgaggccgggaggcagagtttacagtgagcagagatcaggcaactgcactccagcgcctgggcaacaaagctagattcctctcaaaaacaacaacaacaacaacaacaacacaacttctgttaagaatgcctcactggtgatattcaccacccaaattcaaaatatggtaagttcttcaaggctctaatactaggacagattggttgccagttctagatttaatagcagatcatgactatttcatttgtgcttgacaactagacaactttcagtgaaaccattccccagaaatgacactacaatattgttacttatttagacaccagggagccaaaagaacaacaactcattaatagtgaatggattggggaagacagcagcagaggactgaaaagcagcaatataaacaggcttagaactatgaacagcagcagtagggagtcacagaatgaaattactgtaacacaaaataaacatagcagaataagtccacactttctcatttgaaatatacataagcaagaattaaatgtatattgagtctaattttatacaatcaaaagcctaaaaatctcataacaatagaaataccagtaaatttaaaaggattctcccaattttggccctatttccctgttctataaagaaattcctaagggcaaaaaaaataacttcagactataaatgatgaatgtaactattaggagtggcctctctatgaggtctgaaatagaaggaaaatgtacatttcttccagagctgtagccaacaataacttttgcattccgaattcagcttaggtacattggttgggaagatgtttgcaaaagtatttaataagaaagtgctgaatttagcctttattttttctcagtttttttaaaatggcccaaggtccatcaaatgcactaaatagaagctctcctaagtataaataacaaaagaatataatactctacagcttttaatttaatttttaatttttgtgggaacagtttggtttttttaatattttatttttaattttggtaggtacataggttttttatttttatttttaatttttgtagtcttcttcttaaaggcaactgtcttttacagatcagagattatcaaactttttctgtaaaagaccatatagtaaatattatcagctttacaggccatatagtctctgtcgcaaatactcaactctggcacagagcatgaaggcttcaatagacaacagatagatgaataagcctgggtatggtacagtaaaaaattatttacaaaaacaggcagcaagtccatggccataatttgttgacttctgctataggacatctgtttttaactttactaacaagtatattgttttaataaatactataaattttgaaataagatgtctgggatttgctttaaaatacttcatatttttttaaaaagggagagtagggagaaaggttaaataagactggaaaaacacaattattgttaaagccagattatggatatataggtttcattacactgtaagtttgaaaattcccaaattaaaagttttaaaaatacaaagtaaatcaatgaaccagctctacagaaaatgaattttttcaccttattctaaaccttttaaaacatgcttagtatttttaaacataattaacataacacaacataaaatattcttaatataaagccactaaactataatgaaaaaaattaaactaatccacaaaaatgtatataagcataaacacttataattttccataatttaaaatataggctcacttcacgcagttgctaaatatgtcaaatttattggcatctcatctgaaaggtgtaatcaatttttggctttagaatatttttataagaaatatattatttatattaacatataacaggtttactacttttcaagttaatgcataaatttctttctttttaaattctaagtaattctggccaacatggcgaaaccctgtctctactaaaaatacaaaaattagccgggtgtggtggcatacctctgtaatctcagctacttgggaggctgaggcaggaaaatcgcttcaacctaggaagtgaaggttgcagtgagccaagattgtgccactgcactacagcctgggcaacagagtgagactctgtctcaaaaaaaaaaaaatttaataataaattctaactaataaatattaatagatataaccctcataaacaaatattcttcaggatcttcaatgattaaaagtataaaaggatcctaaggccaaaaagtttgagagctcctgaactaagtgttttcaatattgtataaagtaagttgatcatgcaattataagacatctgctcaaactcattttaccttttaacagtaatcatcacatagtgacgttaattcaactatgaaggctatcaatttagccacaagaggaagacacttaaaccttcaacagatatattcttttcaactacctgttaagtcatgaataatgtatccacaggaaaagaagagcactataatatcttgccccccaccttatacagacaaaattgtctcctgaaccaatataatgaaaaactactatgtgtcaacagacatttctaataaatatgctacctcttatcaaatcaagagatatagtttcacttaatgcaagaaaccagaaatcaagatgaacagagccttaagaaatcttaatgactctgcaatttcccaaagattgaatacatgtttttcaaatgctctaagtttttccccaatgctctgaaacacagtgatttcaaatattatcagaactaaaaactaatttaaattaggcttactgaattattacaagagttgagaaaaactaagaacttccatgtgaaaacatttcaactgtccaagaatataatcagtctcaaaatttcctaaatctataaactagaatagaaataaacaatacataacacagactcaggcaaataattagagcaattgtgtccacctgattattcattctatcatttataaagatgaactaatactcatttttcaaatacagtaccactgtagcatttttaaccaattttgcctctacatatggcaatttaaaatgttaccacagtatttcatttttacttgattaataacaaattatttccaagttaagttttataaatgttgttatgtctattgtctttcaacatgaataaatttaaaatagtaatagcaatagcatgcagggacatacttacatcatactctgtaattctgttgcaaagcttatagacttccctgtactccttccactacttgaagttgcagtagacattggactagctgccgtattattcatctaaataaaaaggagaaataaagcttacaaaatgtacctagctataagtaaatgcaaaaaaaaaagaaagcaaatataaattacttcaaaaagtagagaaaatttaaatttctgatttgttttgcacaaaactgattcacttatacttaatgttctttattaaaatgaaatagcaaggtggaaaaaaactagtcaagtaagatgtcagccaattactcacttcagtgataaatactttagcacctattttacaataggtaatgtaaaaacagtatttattaacatattttactagagctcattggttttcaaaatgtgcttcagggagccctacggttcatcagcaatgcttcagggcattctagatggaccccaagcacaacacactcccagtttcattcaggccacggaacaaccctgatttttctagttgatatatgaaggttccaagtaagatctcatttaaagaaacaattccacagctgaaagatacaaaattagaaaactacagcataatctaaatcctatttgaacaaaagcctaaaatacaaataataatgtcaatcggtagatcaaaagcattatattttataatcctatgggtaaataacttactcaattttaaatgtgacatttttcccaataaaattaaggtgatgcataatgataaagtgggtgccaatcctaatgtatgacattttatttaatgcattaaaaaaattggcaagatttagtcaaagtaacattaaaataatgtcatgaaagtaggtaaaccctcatctattacactattatactggaagtgctcaataaacattagttattatttcatatgcttgcataaactttgcaaagctgtaattttcctcaaaatattttttgcagtttctaaagaagaatgtaagatatttagaacatatgataaagtaaagcagtgcagaggactttcagtaaactaagagggcaggttctggggtcagactgcctagatttgaatcccagctccgctcctttgctaagactttgggcaagttacctaacttctctgtgcttcagtttcctcatctgtaaatggcaacgataatctcaccttcttagggctgttgtgagaattaaatgaatacatacaaaaatttagagcagtactgatagcacacagtggatacacaataaatgttagctattgtaataagcagaccttaagaactccctcttccgttaaaggggaaagttaaagaagaaaaaagaattcccctcctttatctgctaaaaacttttatataaatttagatgtattaccctttttttcacaatcaggcaagtttttaaaacttaaacatttttactaaaagacctctatgcaactaaacaaatactaagtagcttctttataagttgagttttcactgatgacatcactacaactactagtcacttgggctcaaagtctcagtcactacctttgactccttctcctgcaccctacaatttgtaagaagtcaagtaaattctactttctgtatgttctcagacccttcccctcttgtcctacggctatggccttctaaaaactcttagctacatcttctatctccatctcagttcattctccatactgctgccaaatttatcttcttaatatatctttctaatctaaccactcctgtgggtaatgataaaattcataaagggaatctaaaccagggtcacttaccaagggctgagatggaagggctgggccccacgaaagaaggttggggaaaaaaagctactacaaatcactgatggagataggctttatttgaagcttttgagaaggcgacaggacacagatctaaggcaagcagcacactagctaggtgactaggtttggaatatcccaatatccctctggtctagtctgagggccctaacagccaggccaaaaccactataccaagaaggcaagagcacaaaaagcgaaggaaaacaaaaacgttccacttaaactgagcccgaaaaccaaaattctaaaacatatgaagaacataatgctaagaaagaccatcgctttttttaagcctaaatttgtgccattgtttaaaaagacttttggaataagtacttttctctacaaataacacaggaaaagaaacataaccatttgagactcggattaaaaaaaaaaatcacaagtccaagactgggggaaaacaggaaacaaaggacttccctaaatagtcctgcagaattgggacaaaatgcgaaaaaaaggagcctggatttctcaaagacctcaggaaatgttcccttgtctcaatagaaggctgacagagctatcttcgagaacatgttaaactcaaagagtaagtagtaaccccagcctccagaaagttatgatttgagttgacttgtctgatttgacagacatgccattccatgggattatcctatggtcaaatgtcctgagacactgctggagcaatctgctcctttttcattttcaaatccagtcaccaaacctagtttattataaccatgatcatcctttcacagtcaagtcaatttttatatcaaacaggtgaataacatttttcttgacatgatgagctgataggtcattagactctttaaaataattatttcccatacccacattgtttgatttagataattaacttcttttgacattaacttctttacacatcaaagtcctatcattccaatgctctatttcctttcttctagacattaaaaaagaaaagtctgttaaaagcagaagcactcaagtcaattttcactaataaatacagttactgtggaactgaaaacctactgtaatcttttcaatgggttaatgtcctgcagttgtttcagctttcaattgaaaatgcatctgtttgccatattttacaaaatgaattcagatgtgcagattgggacctagattatttcaacatgccagagtttaaatgtgaacccaaggaataagttcatatctgattaatagtatttaaacctgatcattaagctaatagctaatattataacacacctgtaaaactgtgttccagagaagaaaaattggcatttacctttcaatttaaaatgaaggaatttaaggatgcacgcctttcctcagaaaatattgctatcaaaaaaaaagttttaattgtagtgaagttaatcacaaaaagtgagttaaacaaaatgcactgaacatgctactgggtttctagttagatctcatattttgggggactaaatgaccacagaagaaataccatgaaacatctttaagcttaaaagacctcaaattgttgagaaccttattactagtttctgcaccctccaaacatcatcaaaatctggactgtgaaaactatcagtcaatccactaaaagagagaagttttaatcttttcttctatattgctgaagaaaactatttcagcagacctatgtactgattttgagcatctacagagtctcaattctaatgataacctgaacatctcacataatataaattaatagaaaacttttataattagaacatttttattttcataaaattccaaaggcaggaaacaattatggttaagccaacactattatgcactgagttttcgttttgttgtttaaaaaaataatcaggttacatcatgatctaaatttcttctgatgtgaaaaataataccaaatggtcaatcactgagaatgaaaaaaattaaaaattaaatacataaaatatctataaaaacttctagacctagtgtttagaataacacaaaggtaatctcaatatattaatatatgccccattttaagtggactttggaaggtattaaaaagcctggtttataaacttatctcaaatcagtcacacctgacctccccagcctccttttctaccacagtcaaatcaaactttcactatctccagaaccattccatgttcttttgaacctttacccctacagttctctctacttgcaataccttttgaaacaatacagtatctctcaacctacccaaactctactgacctaagcccatctccaagaaaccttcccagatatgtaaacaaaagaaattctttctctgacatctaattattttagtttatattagtttaatattaaattactttagtgcatactaattatttttgttgaatgagcctctgtcccacagtgaatccctcccctagctatggacagttgacatcatcttctacttccagagaaataaaaagctatcatttagtcattccctccactctcctccaccaaagacagtgtatcgtatcctcccttaattccctcctcttataataaagacacactcttatttaaagccaacaccaccagtgctttggattcttcatatctaagtatttacggggcacctactacaggccaaacaccgttctaagaggtagggatatagtagtgactaagtcagacaaaaagaaatacattataatgcaagagacaagcacataaacaaatataatttgaggaaataacaaatactatgaaatcaaaaaaacaagttgatttcaactgggaggtggcatttaatataagatctgggagggagctctggagaacttcccaacagaaagaacagcaaagtaccaaaatcctgtggccagtgtggctagaaagatatgaacacaggggtagcaagagggcagatcttataaagcctttaggccacaggagtttacatttcacttgagtgtaatgtgaagctattagagaattttgaaaagggaagttacttgaaatgttttaggtttaaaaagataactccagcagctgggagaatatactatatggaagcaagagtgcaatcaagaagaccagttaggaagttattgaggttgtgcagacaagagatgacagtgggttgaattagtttaacaagcggagatgatgagaagtggtcagatttctggaatacattttgaaagcagaactgatttgctgatggattacacgtggggtgtgagagaagcgcagtcaaggatgaccgaattctggagccttagaaactggttgaatggtggtgccatttactgagatccagaagactgggaaggaaaaaaaaaacagttcagttgggcctatgttaagtttgagacaactattagacattcaagtggagattttaaaaagctgcagaagctttgtgagagatgttgtaaagcagaaaactgaaataaaagccatggtcacaagatttttgttaaggataattaatcaatataatagaactttgtataaggatataaggatcaactaatctcataagttcagtttctctgtcaggaataatttatctcacaggaatccatataatgggcactaaaaaaaatctgaattgaaaatatcaaaacaccctgtaaacatgaaaactacccccatcctttctctctggatgataaacagctaaaactgtgcagcattacatatcctacctgagcatctttttgaacagacataggagcccagtgatagactgctccgagacacaggagtttctagcatatcctccttctttagtctcacattaagtttctattccatatgctttcatatccagtactctcacagaaaaattgagtttaaaaaaaaaatttctttgcaaaaacagtccctaaggtgcactgcaaatgtgcctatcagattatccttaagccctgacaaatggcacatagcacacttacttttccaacattaaaacactgttgttcttacacaaacttaattaaagagttacttaatggttaacttttgagatatgtggaagattttggcagcaattatactcctaacagtaagaggtaagtgtatttgacaaacatgtcaaaaaaataagcagctcccttaaaaatcaaaactctcttccagtctagagtcacatttcagaaatattaaagcttatgagaattctgcattaaacataaacaatttacaaaatatctgatgtgtttaaaaacagtttatgtgaccaaaaagaaaaaggactgggggatttactgtaggcatgtaaaaaatagaggaatttggagtttataaagggtacttcaccagtattagctcacttttttttttttttttcacaattaccctacaagacaagtattctccctctaccaatgaggaaactaagactggctgaaggtcacaaatccaataaacaacaggctttgatcccagatagcagataacctgaaatattcaggccatttagatatactatgttttaataacaatcctctcattttagtgctttagttttttcattagtaaaagatctctatctcctaaaacactaaaatattgtgaaattaactgaaaagttgtaaacatagcagtcaggggacttacatggtcattaagttatcttggagactgatgactttaaacactcagttaagaaattctttgtttaaaagaaaatcttaggtagatggataagcaactataacagacaaacatatatgcaaattggtgggagggaaccaaagacatctgagcagacttcagaactacagtttgaaaatcactaatttcctccaaatccctcatttttcaggtgaggaactgaagtccagaggggtttcttgaactgcccaaggacacactactatttagtgatacaagctgggactaaaactgaggtcccccgacacctggtccagagttctttctactatacatcaaagaatatacaaataaaagtttatcataactaacccaaaaggcctccacaatgtgtatgtcacagtgaactgtgttgtgaaatattaatatctgactatgccaaaccacaatggaagcagtaaagagctaggctctggagttaaattataggctctaacacttacacatgaccttgggcaagttatgccacctcactgcctcagttccctcatctctaaaatggagattaaaattacttctcttataggttacataaaataacatacgtaaagcccttagtaaaccgccttgtacatataaggcatttagttcatgctgatgatgatgattaactcatgcaaaagcatagcttcttgaaaatatatcacaaaagattactgttaaacatgtatattctcaaagaatgttatgactaagagtagacctttaaagactaatatgaataaagtgaaatatacagaattcagtcataaaaccactatagcatttaaatcagcaaaagtacatttcaagattttttaatgatttatatttgtatgttattttagtttataaagtatattcacataaattgtttcaatttactgtcctgtgaattcaacagcatcttttcagtaactcctacataccatacaccaaacagagtactattttctttttgagacagggtctctctctgttgctcaggatggagtacagtggcacaatctcagctcagtgcaatctccacctcctgggctcaagcaatcctcccacctcagcctcccaagcagttggtactacaggcacaaaccaccaagctcagctacatttttttttgagatggagttttgctctgtcacccaggctgtagtgtaatggcacaatcttggctcactgcaacctccgcctccagggttcaagcgattctgatgtctcagcctcccaagtagcaggtgcacgccaagacacgcggctaatttttgtatttttagtagacagagtttcaccatgttggccaggctggtctcaaactcctgacctcaggcgatccacctgcctcggcctcccaaagtgctgggattacagttgtgagtcaccgcacccggcccagctaatttttgttttaaattttttctagagaccaggtctcactatattgcccatcactcttaggctcaagcaacccgggcctgtcttggcctcccaaagtgctggtattacaggcatgaagtcacagagccggccacgattttcatgttcattatcttatttaaccttcactacccattaactatgggccaggtattttcagagggagaactacagtacaaaaaagcctcacagaccaattctagaaagtaagagcctcattagtataacctattaggtgggaatatgtttggataaatgagatacaacggaaggaacacatcaagtgcccaagaaaatgttggttctcccttagcagtagtatggggttgttttccgtagaaaatatattgtgaccagatcaaaaaagcaccattactgtgacttaaaatattatttgtgtgtgtgtgtgtgtggtttttgagacagagtattgctctgtcgcccaggctggagtgcagtgcacgatctcggctcactgcaacctccgcctcccgggttcaagcgattctcctgcctcagcctcctgagtacctgggactacaggcatgcaccaccatgcccggctaatttttttgtaattttagtagagacggggtttcgccatgttggccagtctggtctccaactcctgacatcaagtgatccacccatctcagcctcccaaagtgctgggattacaggtgtgagccaccacacccagcctgtgacttacaatattatttgtaaaagagaactgtcttcagtaatagtgcctattatacactatccatgctgttacacaaaatttacacaacaatttttgcaggtcactctttagtggaggctgaaggtagacaagatgagacaaaaccaattcaatataaaaatgtttgtaaagtaagacgataatttttaaatgtaattctcatttgatgccaccaacagtcctatgagaaagcgggatgaggatgggtactaattccattttactgataaggaaattgaggctctgatattaataagttaaataccttaactgaaatgacaaaagaatgtgccagaaaagggcaaaagctaggtttacagaattgggtcttagtgctctgttcaccaacccacataacatctcagaacattattatcacttctagattatccaataaacttaaggctacagcagctaacagttactgaactgcacacaacccatcacatgagttatttaaattaacctcttatgaacctagaagcagatgccattaccatcttcattttataaatgaggaacccagtattcttaggaagattaaataatttgtcccaaatcacatggttaggaagcagcagagcgagaactcaaatcaagtgttagagcctcaataaaatattttacccacttcagtataaacttaatataataatgcatatggctgaattatttttcattaagtaaactgtaagcaaaacccttctttaacattctaatacataatcagatttctgacggatttcactattcaacctcaccataaaataaaatcagtgttatttcaacacaaatactcaatcacctgatttgactgacatagactaccatgcagtcacccccaccaaaagatgattttcttccagagggaaccaaaactcaagctgctaaaggtttatattcaaagcaaaattttaaaattatcagtggcttaaatgggaaagtcacttgctggccttattccaggtatcttatttattatttagacacaaaaacagtaattttgtcactgttttaaagtatatttctggccgggcacggtggctcacacctgtaatcccagaactttgggaggctgaggcgggtggagcacttgagatcaagagttcaaaaccagcctggccaacatagtgaaactctgtctctacaaaaaatacaaaaattagccaggcatgctggcatgtgcctgtaatcccagctactcgggaggctgaggcaggagaatcgcttgaacccaggagggggaggttgcagtgagctgagatcgcaccattgtactccaatctgggcaacaagagtgaaactccatctcaaaaataataaagtatttctgatattgcaatgtggttaatcatcctaaaactatatattacaagtcccaacaaggctaacagtagggtgacattatgatgtggtcccaattcgaacattttgatagtgaaaggggttctattaaataaaataattgtgctggaacaatcaggctttatactacgactgtctcagaaaaattaagatactatagtcacccataaaagcaccccattctgatttgtatattatgagctattctctccatctgatttaactcgtgagctttaagttattgctccagatctaacaattatcttcagccttaagaccaagagcatcatttttttttttaaagagacaaggtctccctctgcagcccaggctggaagcctggcctgaccatgattcactgcagccttgaactcctaggttcaagagatcctctggcctcagcctcccaaagtgctgggattacaagcatgagccaacgtgcctggcccaagggcaccattttacagacatcaggccaaggttaagggtgctaccgctacctataaaggttttttatttgttcttttagttttattttcaaatttgactttatatacacttgctttaaaaaaaaaaaacagatgcacatatttcaagtaaagtaattttgtgaaacatctattacctaatttcacttatctctccaaaagatttggataaccataaaactagttctaaaatgtcctaatgctcaagagttacaatttttcaaatcgctttattacacaaaaggttaaaaaagaaaaaaacttgaataagagctggaaacttctcactgaaaaaccaaccaaagtggtaaaagatagcagaaaccgacaatcacaaaatagtacaataatgtttaaagaaaactccagttaatactgtcatagctctctgaatctggcattagctgtacaacctaggagacaacgttttgctttaatttgtcaagatgtaaataagtactaacagacccatggtctgaactgcagtatttgaatgaaaggcattatttgaatataattacaattccctatggcaataaatgttccaaagagctggcttatctgatttaaaactcaaccatatcaagactcggaaggactctcaaaatctaaattgtagccctgtgctgtccaatgcagtagctaccactagccacatgtgggtatttaaacgtaaatcaatttattaatttatgaataaaattaaaaattaagttcctcagtgacacttatcacatttcaagtgctgaagagccactgtgcctaggctaccactagtgcctaaaggcacagattatggaacatctccatcaaggcagaaactgctagtgaaaagtgcagccctagacttaggcatacttcgctccaacgtcccgaatatcctgagataagaaactttccatagcacaatgaagagcattccattcttgcaaagtactctcacgaactgtttctcataggcaaattcagcctctttgaaacattcaccagaaattccccaagttttgtccttcaagtaaatctttgcagggcgaatttaattcctcttccagagtctgcccttcacatatactaagaccccaggtcctctccttccaaatacatacatacatatatacacatacatatacttatatacacacatatgtatatacatatatatacacacacatttctttctaccgaaataacttaacatttctattagcctcttggagaaatgctaatttatccacgtgtacagtaatactacgtccaggatcgtctgagtgtcaaatattacatatcactgtcttcataacttcactctcacgtgtgagaccaagtgtcctgattctctgagaaaataaggtcacagtcattctgaactcctaaaacgtggagagcaaaagcagagctaatatgtactgagcagcacctggcgctgttctaagcgtttaacgtgtattttctcatataatcctcacaattctgaaataggctataagatcgccattttacagaccaaaacaaggcaaagacaagctaaataatttccccaggggtcacagacgtgagctcaccccacagagaacacagcggatcttttcctctttctggatgctacactcccactaactacctaactcttctctcgccgtgccataaagcaacaatttccctctttaatgattcctccggcagcccccacactacctagacgacccgcgcaccccgcttctcagcacagcccagcccccctcaccccacgcccacccgccaaaagggaggagtcgagaggcaactccacgctcggcagcggaaccagggcgctgcgcccggccagcgcctcccacagccgccctcccttcaacactccggcgtagaccacgaagacccaggcagccgccctcgagccggggccagggcgtggccggcgcgggggcccagcgacgctgggatctccgctctgcgtccctcccggctctctgacgtctcccccgcccgaatccccgcaccgccccccgcaagccctacaacctctgctttaagaacccttggaggcactgctgcgcttcccgcgaggagaatgtgggggtggagatggtgcggtttctgctgctgcggcccgggacacgcttggaaaggggcggggtgggggactgagagtgtggagtgtagaaagggaaaaggtgactcggctgtgtgacggggcgatggggggggtacaagatggcgtgagcccgactctcggtggggcgggggttgcggagactgaggagtaagcgatacggacgccccccgcactggcagtgcgggcgcat

SEQ ID NO: 340 - DNA, 551322 bp, Homo sapiens; identical to SEQ ID NO: 339

SEQ ID NO: 341 - DNA, 551322 bp, Homo sapiens; identical to SEQ ID NO: 339

SEQ ID NO: 342 - DNA, 69283 bp, Homo sapiens
tggaattacagggtcacattttaattcctgaattttacagtttagcattaatatcaccacatgtatacaaatggtgtaaaacaagtacagtggtattttttaatacaaaataaacatctgttttatggaaaaaactatacttcatatctacacagacagctcatcttttccaaacaatagccaaaattaaaattaactacaaaatctccaaaacaggggaaactgctttagattaaacgattccaggaaaaatggacccgtaacacattacaagggtgatctaaagattgtggctggaattactgttaaagtttttttttcccaatgcattaaattgtattttggggagatttttctcacttcggcatgatctcagatcatagatgagcaaactaacattaaaatatttacagttaacttgttgctctaaaaataaaacttaactgtttgcctcaatttatttttaaaattcacttacgtatatggaatgtgcttttactcttcttaaaaaagcagctttcatatcacacccttgtttacagaaaagctacatgtgctgcatgctgactttgacacttaagtagcttcttggatcaaaatggcttctagatactaaatgccacttaattcagcactattcttggttggtctgtataagtaacactttaaaacttgcagctctggaaagacagaactttactaacaaagtagaaagtgatttcaaagtatcttccacaaaagattgtactggtaggcggttgacaacattctgttcgatctactttcaaatttctagagaaaatcattttggaatactactgtactgattcttggccttcgttgtctctaaaagtgctgattttaacattatcttaaaactgtccagtttgaattgagcttgttttcatcaatatacatattgaaaattcctggtgtagaaaactcaacatgtgctgaatacggggtgtacttcccttcaactacctaaaaggctgaacttttgttaaatcttaaagaaatggtcccaacagcttaacttcatttttttaatgatagttgaatgtgttttccataaaaatttcttttaaaaagaggcaactgattaaaacaacaacatggccagcaccattatacaagtaatgttattgagtttacaactgaagttctgtaaaattgtttctagatcgacaccccgaggagcaaccctgcattattatatcaaccttttcccctcccctaaaccgtccccaaacctgtgacttttccttgctgagaagctgtctcccaggttctggttactaatgtttgttttgacagcctaaaaggcaaaccccttaattactagcaagcaatcaagttcctgggaagcctgatttttattagaactaaactctcttagctgatatactgtcttttgctactccttgtatattttataagttcaattgagaaagctttctgattcagattttcagctcactgaacagttgcagcattgtaagaccacatgttgagggtcccctaataaatattttatgagccaagacgaggtcttttcctgggggacgattcttcttcttcatcttcctcttcatcatctggataatccactaagccaaccaaacttccctattgaagaatttaaaaattttttctttaaacatatataacaaaaaagagcttttagtacaaatacaatcacttgtaaaaatatcagaaatcgtttttctaaatcatatcagaaattaacatttgaatttgataaaggaactgcttgaaattatgaacgtttgagtagtaattggtagcacttgcagtaacccttaacttttctatctggttcttggattattaatgatacttcaaaactcaattctgcaaaattttactgtgggaaaatgtctacttttccaaacagtagggataacaattaataacatttggaagctggaaaggacattggagatgaactggttcatttctctaatttcattaccacaagaaagccccttgtagtctttgttcatcttgtgtatatttcatcactaagtacacattattttcattgtgcttttgaagtacagcttaaatggctggagataaacacatgaaatgattcctataaaataataagtaaaacatttagggctagctcgctgaccaaaagaacaataaggatgaggtaattcgtggtcttggcctttgatgagtaacagacctctgtgaaaatcctagaaaaactctgggtactctccagaaaattacacatccacagggtttcattcattttgagccaatcccatgaaaacttatgtcctataggttaagagggctactgtaaacactgtatttagttcaaacccttcagacctctaggagataaaacaaatacaactgaagtaactcatacttcatacctgaagtactgaggtatcgggttttaccagaatgtaaccaaatcagtataatattaaccaaccaaaaaaaggcctctgggcagctagaaacagttatcagaaagacttatatacctgtctgagaatctgtttctcaacttaatcacacacacatcttaagtctggatatgcaagaagcaatatggctaaattgttaaaaataggctaactgtaggtctgatgtcaaattctaatgacaccacgttttatgtaaaaaaaaacaaaaacaaaaacaaaactttggggctgggcttatgcctgtaatcccagcactttgggagatcgaggcggatgggtcacctgagagataatgagttcaaaaccagcctggccaacatagcaaaaccctatctctaccaaaaatacaaaaattagcctggcgtgatggcaggcacctgtagtcccagctactcgggaggctgagggacgagcatctcttgaacccaggaggtggagattgcaccactgcactctagcctgggcaacagagcaagactccatctcaaaacaaaaagaaaaacaaaaaaaaacacaaaaccttgggcaagtggtttaatacctctgcctcagtttgtctgtaaaattggtatagtagtatttaggcctcagtgaactattttgaaatttaaattgatggccaggcgcagtggctcatgcctgtaatcctagcattttgggaggccaaggtaggtggatcacctgaggtcaggagttggagtccagcctgaccaacatggtgaaaccccatctctactaaaaataaaaaaattagccaggagtggtggcgcatgcctgtaatcccagctgcttcagaggctgaggcaggagaattgcttgaacccgggaggcagaggctgcagtgagccaagattgcaccactgcactccagcctgggcaacaagagcaagactccatctcaaaaataaataaataaataaataaatagataaccaaacatctaaagcacttcagcacagtgcttcgtatgtagttagtgttcaataagtgctattagctgctattactactatcatttttctattattttgtttctaagccaaacaaattggaagagaggaaaaacaagaaataattctggtataaaaaggcaccaatctgataatcaaaaagatgacagcaaagttacaaagttttaattatgcttagtattacatatcataacgtacaaacatttgtattccaaatggttaacacttaattgtttctgcccaagattaataaattgtctgaaaaactcacttatacaatttgagttttacttatattatctctgcaaactaacatacatttaaaacatgtttacaataaaaataataaaaatgcaaaatatgaaatgttggaagtaaaaaggcctgtaatctagagatgcactttgtgaagctgattccatacttttaatatgtatctagaaatgtactgttttaaaatagcagattgaaattatatttactcttttacaatcatgttcatataaaaaaaagctttcgatgtcagtacataaagttccatttcattgttttaaacccttgcattccatggtatgaatatatatatattttttaagagtcttgctctgtcgcctgagctagagtacagttgtgtgatctcagttcactgcaacctctgtctccagggtgcaagcgattcctgtgcctcagccacccaagtagcttgggctacatgcatgcaccaccatgcctggctaacttttgtatttttagtagagatggggtttcaccatgttggccaggctggccttgaactcctggcctcaagtgatctgcccacctcagactcccaaagccgagccaccatgctcggcttcatcatatactttaattcctgaatttctggttggacatttgggttgtttttgcagggtatttaggtaagaaatttaaaaagtgaataccagcaaagaaaacaggagaagagagaacagcagtttagagttgccaaggcatttttggaaaagagaaatcagaggcaaggcaagtcatacaacaggaagaagccaagaactaagtatttgcagagggatacagaaacgagaaactgatttgtcttaagaaaaccccagaaagaagctaggcagtaaaggcaccaaaatattggggaaagcagggaaaacagtttaattatagtaaaacagacaactgggtcattgattctacacctctgacagccaggagatttctgttcctccaccatcaccaactacagagaattctacatagaaaatgactctataaagaataaattctatagagaatgtaatgaactttacagagcaaaggaccatatacttcatgactttaggcaaagtaaagggcatgggtaaggccaggctgaaaatgaaagaataaatttaaattttgtatactgagcagacacgcctaccccacaataagctttgctatgtaggcactcagaacactaacaaccattcttatacttacaaggtgtaagagactagctttgtctgtaaaaattagatggcttcacaggagtatggggggaactacaaacaactaacacctcccgaaaaaagcagggcactactctctaagtccataccataaagtcaagtttttaaagtgtataattttcacacaccataaactcaccatttcagagcatataattcagtggttttagtatattcacaagttacgtaatcaccaccaattccagaacatttccaccatttcacccaccaaaaaaagtccccataaacagtcctcattcccccaccaccccccacaccacccagctcttggcaaccactaacctactttgtttctgcggatttgcttattctggacagttcatataaatggaatcatacaatatgtggtcttttgtgactggtttacttcaattaccacaatgttttcaaagttaatctatgcttagcatatcaggacttcattcttttttatggccaaataatatccactgtatgaatatgctacattttgtgtatccattcatcagctgagagacatttgggttattcttactttttggctattatgaaaaatactgctattaacattcatatacaagttttacagtggacacatgttttcaattttcttacaatatatacctaggaaatgaggtagctgggtcatatggtaactctgggtcatatggtactctgactttttggggaaccgccagactgtactccaaagctgctacaccattttatttttatatatttattttttgagacattgtcttagagactcgaaagtgcagtgatgtgatctcggcttattgcaacctctgcccgctgggctcaagtgatactcccacctcagcctcccgaatagctgggaccacaggcatgtgccaccatgtccagctaatttttgtagacggggttttgccattttgcccaggctggtctcgagctcctgggctcaagcgatgctcctgcctcggcctcccaaaatgctgggattacaggcataagcctatgcaccaggcctgttgtgctattttatattctcactagcaatgggtgtcacaatttacattcttaccaacacttgtttttgtgcatcttttttattatagctatcctagaggatgtgaaatgctatcatattgtgattttgacttgcatttcccttactaatgatgctaaacatctttccacatgtttatatgggccacttgtgtatcttctttgcagaaatgtctgttaaaatcctttgtccattttaaaacggggttgtcatgctgaggtgtaagagttctttatatattctggataccagttacttatcagatatatcatttacaaatatttcctcccattttgtggattgtcttttcaatttatggtagtatcctttggagtacaaaatttttgaattttgaatgagtccaatttattatttttcttttgtcacttgagctatttgtgtcatatctaagaaatcactgcctaaatccaaggtcatagatatttatgcctttttttaaaaaagagttttagacttttaacttttacatttggatcttttcatccattttgagaggagttttggatatgatgtgagatagggatctaacttcattcttctgcatgtggatatccagttgtaacatttattgaaaagggtattgtggccgggcgcggtggctcacgcctgtaatcccaacactttgggaggccgaggcaggcagatcacgaggtcaggagatcgagaacatcctggctaacacagtgaaatcccatctctactaaaaatacaaaaaattagccaggcgtggtggtgggcacctgtagtcccagctactcaggaggctgaggtaggaaaatggtgtgaacctgggaggcggagcttgcagtgagccaagattgcgccaccgcactccagcctgggcaacagaacaagactccgtctaaaaaaaaaaaaaaaaaaagaaagaaagaaaaagagtattctttcccccatcaaattgtcttggcactcttattaaaatctgccttatttttttttatgaaaggaaatcctaagatcaccacttgagtaaagtttccaatatgaaagaaaggatcaaaataaatgacaacaataacctatgaaaaagccctttgggaggccgaggtgggtgaatcacttaagatcaggagttcctgacgagcctggccaacatggtgaaaccccatctctactgaaaatacaaaaattagccaggcatggtgtcgcacacctgtaatcctagaacattataataaatgcacattctatacagaaatacacacgtatatgaaatgatatatgcaagtggtcacatattgcagcaatgattttaactacaaaaagctgcaaacaactttaatgcccatcacattgataggggctaattataaattgttatatccatacttttaagttctatgcaggaaatctctaatgtcctgatatgaagagctcaccaagataaatttgctacacaaagaagcaaaataacaggtttctctactgtgaatctgtgacgtgtttattttagtatccacaaatggcttctcattctgattttatatttttcctcatagaaaatatacgttttacagttacacaactaaagaagtattttgtgtctttatgacatttatatcataaaaacaaatgttttaattcattagtagctaatgtctagccagccttcaactatagcaattaacactgttagtgaaactggctaaaccaaagggcaattggtgataaagaatctgtcaccacttaggaatgtgggcatggtttgttaagaaggttgagagcaaattaaagtggtgcttaacttctgtcaactcctgtcttgcttaatttcaaaattctgtgtctacagtgatagagcaactgtttcccaagaacactgtttttatccctatctctaaaaaggatgtataacagatgtattctgtaatctgctgttactgtcaagaagagtgaaaaaggtgttggtgcttgcatttaattttgctcattcataagtaaattatctgaaaggataataaaaactcagagaaatataacagaaaatataacaggaaaacaaaatgaatagtaggatataaaagtaggatagaaaaggtatgcagtattgacatattattagaaatagaagacacagctaaaagagttcaaaggtatctttgtggaggggaacagagggactgatttttttctaatataaacttgccttttggtaatatttgacttttgaaagtacatgcatgtattactttgatttaaaaaaaaaaaaagaaaaaaaagaaaagctaatatatactgagaaggtgtcaagcagtgttctcagcattttacatttgttaaataatttaatcttcccaacaagcttataaagtaggtactaccttacccctttttaaaacaagaaagtcggccgggcatggtggctaacacctgttaatcctaacactgtgggaagctgagcaggactgcttgagaccagcagtctgagaccagcctgggcaacatggcaaaaacccatctctaccaaaaatagaaaaattagccaggcatagtggcatgcgccagcactcccagctactcgggaggctgaggtgggaggatcagttgagcccaggaggtggcggaggcagtgagctgtgatcacaccactgcactccaggctgggtgacagagtgagactctgtaacaacaacgacgacgacgacgacgaagcaggaaggcagggagcttaaggcccagagagattaaataacttatacaaggtgatacagctacaaagaggcagagccaaggtttgaacccaaacaatacaaccctatggcaaatattcttttttgagcagggtctcattctcttgtttaggctggagtgcagtggcaagatcatggctcactgaagcctccacctctcaggctcaaaccattctcctgcctgactcttgagtagctgggaccacaggtgtgtgccaccacacccagctaattttttaatactttttgtagagatggggtctcaccttgttgcccagactggtcttggactcctgcgctcaagcgatcctcctgccttggcctcccacagtgctaggatactgtgcccagcccaaacattcttaatgtagtgtcacaatattactctaaattgtcccatcataaagttgaaaactaattttaaaattttccagttgaaaaacataaaatatgtttcaaataccgaataccatgaaaatgctattgtcaagagcctatctcactatactactgaatgaaaattctacatttttgtaaaataaactcagacttatattttgtgttccaaacaagatgcattcctttaattaggtatgtactaccacggtgtttctgcttgtctttctacctttatacaatagttgtcccctatttatgcctttttattttaagccactcctttttggggaaaaaggatgatttcatataacatatgaacaagaaaaatgtttcatataaaatttaaacttgtttataaaaaaagtaaccaagggaaatacatttgttataagaacaacagaaagtctaatatccttaactaaagattcatcgacaataatataatccaatttgcagagaagagcagattcaaaaggctaatatttagccttactactaatagagtatacacgattggaaatgagatattatatactgtctcccctacctaactggcaaatactaaaaataattatagcactggcaaagctgcaattggccacgcacactcatacacagtttatggtaacataaactggcatagactttatgaagatgaatttgaccgtatgtgtgaagacgttctactactaaactatccaagaaaataatttaaaatgcagtaacactaagtagtcagtgaaatattagaatcaacttaagtgctccaaaatagaatgggggacagggaggaaggatgcttacatttattatcataagcctaaataaaatgaaattctctttgagaggccgaggtgggcggaacatgaggtcaagagatcgagaccatcctggccaacatggtgaaacctcgtctctactaaaaatacaaaaattagctgggtgtggtggcacgcgcctgtagtcccagctacttgggagactgaggcaggagaactgcttgaacccgggaggcggaggttgcagtgagctgagatcactccactgcactccagcctggcgacagagtgagactctgtctcaaaaaataaaataaaataaaataaaattctacaatcaacattttggtaacagaaaaattctaaacaattcattgaaattgttttgattatccaaatttttttcagtaaacatgaaaaaatctcacagacgggaaaagcaaagtttgtgtgtaatgctgtttcacctaccttggtggctgttactgacgtaggcaagtttgtggttttggaagaggatccattagaagttgctggtggtatctgagccactacagatttactgtttgttccattagcagcactggcagagtgggagaaagtaaatttgaagccaccaggagatgtccttttgggaaggttttccttgtcttcactttcttttgctaaagcaaaagtaaaattttgaacgtatatcaataaatactgctaagtcaaaacatctaaaaacagcagtaattaaaaaacttataaaacattgctgcccgggcatggtggctcacgcctgtaatcccaacactttgggaggctgaggcaggcagatcacccaaggccggagttcaagaccagcctgaccaacatggagaaaccccgtctctgctaaaaatacaaaattagccgggtgtggtggcgcatgtctataatcttagctacttgggaggctgaggcaggagaatcacttgaacctgggaggcagaggttgtggtgagccgagatcgcaccactgcactccagcctgggcaacaagagcgaaactccgtctcaaaaaaaaccaaaaaaacaaaaaaaaataacaccaaaattaattgcctttgtttcctaagaacttttgaaaaagaacatgatgtgtacagtgatgatatggtctggctctgtgtccccacccaaatcgcaaatcaaattgtaatccccacatgtcaggggagggacctggtgagaggtgactggatcatgggggtggatttcgcccttgctgttcttgtgatagtgagttctcacgagatctggttgttccaaagggtggcacttccccccttgctctctctctcctgctgccatgtaacacatgccttgtttcccattcaccttccgccacaagtttcctgaggcctccccagctatgtggaattttaagtcaattatacctcttttcttcataaattacagtctcaggtagttctttagagcagtgtgaaaacgaactatacagaaaattggtaacaggaatgtggtactgctataaagatacctgaaaatggcagggcgcagtggctcacgcctgtaatcccagcactttgggtggctgaggagggtggatcacttgaggtcaggagttcaagatcagcctggccaacatgatgaaacctattctctattaaaaatacaaaaattagctgggggtggtggtgcacacctataatcccagctgctctggtggctgaggcaggagaattgcttgaaccctggaggcagaggatgcagtgagctgagattgtgccactgcccaccagcatggatgacagaataagactccatctcaaaaaaaaagatacctgaaaatgtggaagcgactttggaactgggtaatagacagaggttggaacaatttggagggcttagaaaaagacaggaagatatgggaaagtctggaacttcctaaagacttgttgactggttttgaccaaaatgctaacagtgatatggacaatgaagtccaggctgaggaggtctcagatggaggtgaggaacttattcggaactggagtaaaggtcatacttggtatgctttagcaaagagactggcggcattttgcccctgccctagagatctgtggaacttgaacttgagagagatgatttaggatatctggtggaagaaatttctaagcagcaaagcattcaagtggtggcctgggctgggcacagtggctcatgcctgtaacaccagcactttgggaggctgagacaagcggatcacgaagtcaggagttggagaccagcctggccaacagggtgaaaccctgtctctactaaaaatacaaaaattagctgggcgtggtggcacacacctatagtcccagctacttgggaggctgaggcaggacaatcagttgaacctgggaggcagaggttgcagtgagctgagatcatgccactgcattccagcctgggcaacagagagagactccatctcagaaaaaaaaaaaaaaaaaaaaaaaaaaaaaaaaagaggccttctggcggtttctaaaagcgtatgctcatatgcatgaagaaagagatggtctgaaattagaatttatatttaaaagggagcagagcataaagtttggaaaacttgcagcctgaccatgcagtagaaaagaaaaccccattttctggggagaaattcaagctggctgcagaaatctgaataagtaacaaggagccaaatgttaattcacaggcccagaggcctaggagggaaaaatggttttgtgagctgggcccagggccctgctgctctgtgcagtcttgggacaccctgcatcccaggtgctgcagctccagccatggcgaaaaggagccaaggtacagcttgggccatggctttagagcgtgcaagccccaactcttggtggcttccatgtgacacggggcctgtggggtagaggcaagaactgaggtttggtaacctctgattctcaaaccacctagatttcagaagacatatagaaatgcctggatatctaggcagaaatctgctgcaggggcagagctcttatgaagaacctctactagggcagtgcggaagggaaatgtgaggttggagcccccacatagagtccccactgggatactgcctagtggagccatgagaagagggccaccatcctccagaccccagaacagtagatctaccaacagcttgcaccatgcacctggaaaagccacaggcactcaactctagcccatgaaagcagccatgggggctgtacctggcaaagccataggggcgaagccagccatggccctgggagcctacctgttgtatcagcatgccctggatgtgaaacatggagtcaaaggagattattttggagctttaagatttaaagactgccctgctgggctttgcacttgcccagggcctgtagcccctttgttttggccaatttcttccatttggaatgggagcatttacccaatgtctgtacccccgttgtatcttggaggtaactaacttgttttttattttataggatcacaggcagaagggatttactttgtctcatatgagactttggacttggacttttgagttaatgctggaatgagttatgggggactgttgggaaggcatgattggttttgaaatgtaaaaaggacatgaaattagggagggaccggggtggaatgatatggtttggctcttgtccccacccaaatctcattgtgaattgtaatccccaggtgttggaggagatgactgaatcatggaggcagaaaacccccttgctatttttgtgatagtgagttctcacgagatctggttgtttcaaagtgtgtggcacctcggccgggcttggtggctcatgcctgtaatcccagcactttgggaggccaaagtgggtgaatcatctgagaccaggagttcaagaccagcctggccaacatggtgaaaccccatctctattaaaaatataaaaattagctgggtgtggtggtacatgcctgtaatcccaactacttgagaggctgaggcaggagaattgcttgagcccaggaggcagaggttgcagtgagccgagatcacgccactgcactccagcctgggcaatgagaaggagactccatctcaaaaagcaaacaaacaaacaaaagtgcatggcacctcctccttcacactctctgtctcccgctccaccatggttaagatatgcttgctttcctttcgccttcgaccatgactgtaaggttctcgaagcctttcagccatgtttcctgttaagcctacagaactgtgagttaatcaaacctcttttcttcataaactacccagtcttaggtagttctttttaacagtataaaacgaactaatacaagtggtaagtctttattagctagaatcttagaaatctcagtattagaaaggaccttacggatcataacaaaattagccattctatgctagaactctacattgtggtatctagcacatacatctaaaatctcattagctgtctgactcttccttttattgtctccctgtagcttccactcactgactctacacttctttactcatggtaaaaacctagtaatttctctcacaagtcaatattccaaatgcctaaagacaatgatcaagtccgtaagtcctaaatattccaggttcctttttctgtttgtgttatgacataggtgtccaatcccttttaacatctggttattatttttatatatgattcttaacagcatctcactcaacactggatacagaacttcaaatatggctgtactgcctcttttgacaatagtcagggcagtacctgtaatgagtaaaggcagaagaatttgtctagcaaaggtaccgatttcttaggatattttaataagctttttgctccgccacgctgaggcaaataaaacttatcaaactaatgagttgaaaatgagtacgaacaatagtttcaaagaaaatgtaataaatgaaattaattttctgagaattgtctttagaaaatgtcacattcaaaatcacaaacttacataataaatccaagaaaggcttttatcttctaagacataaattttttcttttgtttttgagataaggtctttctctgttattaagctggagtgcagcggcagctcatggctcactgcagcttcgacctcctgggctcaagtgatcctccagcctcagccttcctagtagctgggactccaggtaagtgccactgtgcccatttaatttttgtgtttttttgtagagacagggttttaccatgttacccagggtggtttggaactcctgggctcaaatgatccacctgcctcagtctcccaaagtgctgggattacagacgtgagccgccatgcccagcaaggtataaattttaattaaatatttaaatgatatactcagggcagtattccaaaaaatggtaattcctcaggccacagaagtaaaatggttagttcttttgaaagatatattactagcaagatcttcattttataaaacaagttaagcacatctgaaagccaggggaagttttactttttcacttctcttgttagtatatctttatgtaacttttgtaattttaaaatttcaaagagcaaagttacttgtttgagctcagtttatcagctgtaaaagacacaggcaaagtactctagaaggtttctatgaagctatatggtctctgttattactgagaatttcagtatagaaataaagccaagactattcacagaaagaaaagtataagtagataattcaatttctaactagcaaattaacagcattacaaaatagcaagtttgaagagaaacattttaaacatgaaaagaattcccagacagatttggaaaaagtacataattttaaaagaacacagtttggtataaaatttttgtctttcttgctttgtaaactataaacaaaccttcacaaagcaacaaaataatttctgcactaaataagagggtacactgtgcaaaaattccgaattttaataccttttttagtctccataaacttttcataattatctggaaaatcatcttctggcttaggtttttccactggtgccacaactgcttttccttcctcttcttcatcttcattaaaccacatttcttcatcctcttccaaggcttttgcatctctgcgaaatctgttactacgcaatatagatggtacactgtaagaaatatatcacaaatattgagtaatgatttaaagttcatcatcagattgaactgaaggaaaaatatgtataaccaagatgaactgaagtaattttaactgactataatttatatcaaaataatctctgtaatgatagaagatgtagccagagaacactccaaaatattttaggatgttgtaaattaaactaaatattcttcgtaagttacaacatggagtagtaattcaacatataaatgatatggggtaggggggacgccttaccctcctattcaactctatgctatccagtgatggaaagaaaattcctcagtaaatttcacatggaaaatctgaactacaaacaattttggacacagttttgtaggctataaaagcagtatacttaaacaatacctgttcagtttctgattttgtctgtctttttcttgctcatatttagtcttcaatcctttgaatgtctgaacatattcaatcgattcaagtgctttataaaagttttcaactatatgggcagtaagagacttgatatcttcctgtataagcacaaaatttacatttaaaatataatacaatgcttgttagaagaaaaactttaaaattttgttttgtagttctaaagctgatcaaaaaaggtttttcaaaatcaccttccaaaatgtaatgtcctggtttctttacacatgagtcaggactgcacagaaaacttgaaaaaaaaggagaagcaatttactggagtccttttataggactataaagagcattcgaaaagtaaatagatttattttacatcttctattttttgtatatatatatatatatatagcagtttacaatttaaaaagcacttttacataaaatttcatttgatcttcacaacaattctatgagataggttttattattcccattttagagaaaaaccaaaattgaggctctaagagaggctggatggtttgatccagagcacacggctggttagagggcagatgttaaaattacattttcaaaatactcacggtgatggataccccaaatacccggacttgatcattacacattctatgcatgtaaaaaataaatacatgtaccaaatacatctgtataatattatgtattaataaaagaaaaacatatttttcaacaaacaggtcttatttaatgacttcctgtttaactgctatcaaaatgggatatggttgtggtggttttctttctggtacatttgttaagttttcaaatgagcctaactctgccacatatatcatataggagctggcaaaggcttgatgacaaagagatctctctcaagcctttcccacatcagaggctggctttcacacacacagaagaagaaaaaacaacagaggacacgtgttacctaaataataagaagcaaagacttctctgactatattatacacacagatctgataaactatctggaattctacttgtctattcctatagtcttccaatagtataatatctgtgaaataaactaattgatagtaataacttctaaattctaaaccatcactgcaaatgcatgcatgcccagtaggcttattttaaaaaaaaaaattaaagttgtgattgaggactttacagataacactacatagtaagaaacacacaggtcatttcttgaaaagatacaccataatttggttgcattatggattttaagtcttaaaactagttctcctgtacttctcaattgaaaaaaaatacgcaaatcagaaattagaaacctaggtaatggctctatgttatatgtgaaacgaaaaaatacattaagttttggggcacaaggtacacaaatcgaccactcgaacttattttcacaaaaacaattccatcatgggcatagggacagggttgtaaactctaccatttgctttatctgtatctcaccaaaattttaaaggagaataatataaagtaaataaaatataaagctttgatttattgcagcagtacaatgggaactagtgagctagttaaccatgttccttcttttaccaggttaaagacttctatcctcttcatccttttaaaaatcatatacttggcaattgaccacttttagaaaaacaatccagtcagccaaataatcttcatatgagaatagcatgttatcagcaaaaatctgacttgtaagaaataaaactagataatgaatttctagcttggactttgatttttcaaattatttccagccaggtgcagtggctcacacctgtaatccaacactttgggaggctgaggtgggagaactggttgagcctaggcgtttgagaccagcctgggcaacaaagggagaccccatacataaaaaaaaattaccattagccaggcactttagtgcatgcctgtagttccaattactcaggaggctgacgtgggaggatctgcttgagcccaggaggtcgaggctgcagtgaactgtgattacattattgtactccagcttgggcaacagcatgagaccttgtctcaaacaaaacaaaacaaaaaataaaacccaaattctttccaactatgtggccatttcctcagtggaatgatttcggtgtgtttaagtacaggtgaagtaaatttgttgtactggttctacagttatctgttgcattcctgttattcacatagactgccctccagattgtttatgacaaatcttctgttgcctaaaactaagctgggacaaagcttcaagttctgactggtcctgattgtgctactatccaaaaggatgttcttgaataggtcacttaataactttgggtgtcttaatttcctgatctataaaatacggtaattggagtagtccatctaacttcctgatctctttaacttaaaattctaggattccatcctaccttttatgcatgttgtattaatgtctaccaaatgatttttttttttgagacaagagtcttgctctgtcacccaggctggaatgaagtgatgcaatcttggctcactgcaaccccacctcctggatgcaagtggttcttgtgcctcagcttcccaagtggctgggactacaggcgtgtgccatcacactcagctaatttctgtatttttagtagagatggggtttcatcatgttggccaggctggtcacgaactcctgaccttaagtgatcagcctgcccaggtctcccaaagtgctgggattacagacgtaagccaccacgcccaaccccaagtgaattatttttccatctttctattctttttaaatcattacctctacaataaaaatatcaccttttcctaaaagatcacgtgaataaggcatgattgactgaaatgtccacatacaccaaatgagatcatgaaacatttggccaataaaaatggaactgagaaaatcaagtaaatatgggctgaaagactatgctgaatttcacttttatatttcacaattaaaaatattagcgttaaaaaatatcagtgtcaaaagtaaaaaccactaaactataaccatgtggcaaataagaattaaaaagctactgatttttaaaatttctgtttattagaatagattctaagacacatggaatatataatttcaggggtgaaaagggaatgaagtcactttgcttacatgtaattcttttacataaaaaattatttacatataattacatataataacagctgttttatataaacttaccactcttataaattcaaacaactcaataacagctgaattcaacagattataccgagttccattatccagaagtgcatttataactggctcaaaaagatttcccttggtgatgtaacgattataaaattcatctttaagtccaattatccgcctcataaagcgaagggcacctaattaaaaataatatagggaataagttaatgatcttactaaaatcaattattatacaggtgtttttccaccataaagcaatgtatatgctcttctaaaatgaaaagtaaaactgtgtataaagtaaaaagtaaactcctctaaaatgaaaagtaaaactgtctggtaaaactggactttgaggaaaatagagctgcagaggatcgctcaaaacctgtacaactttgtagccagaactaacaacaacaacaacaacaaaaacagtaattggaatctaggagataaactacccaggcaggtagctctgtgacagagatttaaaaatatgcaaaatccatagactgcaaatgctagcagtatttacagcagtgctggtggatgctgagacaacgcagtgaaggcagctcagaatcagtgggggcactgtcattaaggtgggcacaggagtgggcaacccaccatgagctaagattgccttgcctctctgagggagggagctttagaggcaaaagcttgttttcagttttctgaaaatacagctaaagtgtgggcagcaagccacccaggtgccgaggcaagagactgagggcacgagctgttctagtataataaaatatataaaataagaatagttatactagatatagatcttagatatgattatatatgaatatcattaatcattagtttgcagtaattattctttattccaatattataataatcctcgctctacaatcataacctaggaaaaaccaggccatgcagagataggagctgagggtacatactgagaagtgaccaaaagaccggacagggccaccagagggctccttggtctagcggtaacaccagcgtctgggaagatgcccgttgccaagcagaccatggtctagcggtagcgttagtgtcaaggaaaaacacctgctacttagcagaccgggaaagggagtcaccctttccctgggggagtttagagaagactctactcctccacctcttgtgaagggcctgacattagtcaggcccacctgcagttatccagaggcctaattgtttccctgtgatgctgtgcttcaggggtcacgctcctagtccacctttatgttccatcctgtacacctggctctgccttctagaaagcagtagcaaattagtgaaagtactaaaagtctatgataagcagaaataatggtgtaagctatctctctctctttctcctctctctgcctcggctgccaggcagggaggagccccctgtccagtggacacgtgacccatgtggccttacctatcaatggagatggttcacactccttattctgcccctttgtcttgtatccaataaacatcagcgcagcctggcattcggggccactaccggtctccgcgtcttggtggtagtggtcccccgggcccagctgtcttttcttttatctctttgtcttgtgtctttatttctacaatctctcatctctgcacacggggagaaaaacccaccgaccctgtggggctggtccctacactaaagaggctcctgatgccagatgccaatcacataaaggagatctaaaggttttttacttctctgatgaagactatttccactcacactattctacttctccttgccttgaaaaaaacatttgtgctgaggcaggcagatcacgagatcaggagatcgagacaagcctggccaacatggtgaaaccccgtctttactaaaatacaaaaaattagccaggtgtgctggcaggcgcctgtagtcccagctactcgggaggctgcggcaggagaatcacttgaaccctggaggtggaggttgcagtgagctgagatcgtgccactacaccccagcatgggtgacagagtgagactatgtctcaaaaaacaaacaatttgtgaaccaatcctatctccgtattataattacatcattctcttatgtaccaattgcttacaagctattttacctggctaaatatgcactgtggcagatcagaatgtatttgttaaaagtaaaacagagtaatgaataagaagtacaacttgacttcacattttaggacactgaaaagaaatctcctttttaactcgtgactagctaaataaagcttactaaatttagcaatattactgctaaaaatcttatggaacaggaaggactataatttcaatcctttatttttatatgttgatcctttaacttgtatcctttcccctaagtagtttattctacagataccactagtcaaatcttcaaaacacaaggcttctgattttataagtcattttctcattccaaccctctgttcatagatgaaactcattaaacaaagaacttgtgcctgtcacaagaggttctaaacattatctgagaataaaacagaaataggccacataaggtataaatgttaactgtaacaccaaacaagtatggggagacgtgttagacttacaatcttccctctttttgtggcaggataagaaatggtttacttaagatgcaaaagactgaagcactggcaagtttgtgagcaaagaggcacaattctacactgctggtaaatgaactgacatgtacacaaaactacagttacaacagcactgcttataataatagaaatcttgaaacaatataaacatttaaatattggaaattgtggctgggtgcagcggttcacacctgtaatctcagccctttgggaggctgaggagggtggatcatgaggtcaggagtttgagaccagcctggccaacatggtgaaaccccatctctactaaaaatacaaaaaattagccaggtgtggtggcaggcacttgtaatcccagctactcgaaaggctgaggcaggagaatcacttgaaaccgggaagcagaagctgcagtgagctgagactgtgccactacactccagcctgggcaacagagcaagactctgtctcaaaaaaaaaaatggaaatgcattcaattgacatgttcctattaagggaagtattctgcagtcatcgaaaagtactatttaatgagccaaataggaaaatctgtcttaagaacatcaaacattccaaaattaatataaaaatataatgtaattccaatcaaaatgaactggatacaaccagttatcatgaaagaaaaaaatgtctaagaacaaccaagaaaagtatgaaaaacaaaagtgaaggggtctcagtaggtattaaaccttacaagagacactataatgcctggcataatataataaacacaggttttttgtttgtttgtttgtttcttgagacagagtcttgctctgttgcccaggctagagtgcagtgttgcgatttcagctcactgcaacccccgtctcccgggttcaagtgattctcctgcctcagcttcctgagtagctgggattacagacatacaccaccatgcctggctaatttttgtagttttagtagagacagttatattgcccaggctgctctcgaactcctgacctcaggtgatccacccgccttggcctcccaaagtgctgggatttacaggcgtgagccactgcgcctggccaacactggtacttttacatttggtgaaattaaatgactgtccagaaataaaacaaaagtatatatatgttaacttatttaacaaaaatggtatttcaattcagaaggaaagaggaaaggtatggttgccttaataaaggtgctgatactgttggctatgtatctaggaaacactcatttcaaacactctcatttcaaagtatatgtgcaaaaacaaatttcacatgtgttacatacataaatgtaaaaaaggaaataaagatattagaagaaagtgagaatatctgcataatcttaggacataagactttcctaagcaaaacaaaaaacccaaaagtcataaaaggaaaagaaagacatttttgccatcataaggaaattttaaagttatctggaaaacaatactacaaataaaggcaaagacaaaagacaatgaagatggacattttctcctcaaaacatgataaattgttaatatctctaatatacaaaaagctctaagaaaaagataactggcaattcacaacagataaaaatgcaaagtacactaatatatgaaaagatgctgtcagggaaaatgcaaattagaataacaatgagataccacatttttcagtatcagattgataacattttaaaattagtaacactgaatgctgggacaatgtcaaagtgcttcaattttggcggaagtaatctggcagctatatggtaaattaaaacttagagatacattaaaaagtataaaacagataaatattttctcttaccaatcccattattgagaatctatcctatagaaagaaataaatcagtacttaaaagatttatgtactagactatttaccacagtgagatgtggagtggcaagaaagcaaaaacaatcctgtaatttatccactggagaatggcagaagaatctgtggaagagccatactataaaatcttactcagctatctccaggaataaaattagtctatacaatattgattaatctagagtagtattagtgggctgagaaatgtgttggtatgatactgttttgtaaatataaaaaacacaaaaaaatcctctatacatgtgtgaatatgtttattacataaattggtacaggtatgaaaaaaagaaataatgcagacagttaacactggctattttaagtccataaaaataaagattagggagattaacattttctctatacattaaattaaatgtctatatttaaaatataatttttatggtcagaataaaaccacaaagtacttttcatttggagggaggatgtttctttctctgcttgcaggtgaaattatgaaggtgacagtttatagtctgctaaaaatcaacattgatgcaaatatcaggataattataaagagtgactgactactaaatgacagtttgatgaagtagatgtaaaaaaacagcaggactggttctgttagtaaaatgctgtcactgcacatggtaatgtatcacaacaaaagttaggctcattaaatctaaatgtgagcaatatgtgggtgggaaaatcactacaacctagtcctcttgccctttaaataagaacaaaagaataggacttctcacaatcatctcattcatagaatatacactgctaataaataacttcaaatgggtaacttcagttttatctctattaaaaatgttgctccttaaaacattttatacttacacaaggccagaaaagtgtgctttgaattcatcaagaccaagactcttcttagcaagtccttgttcataatatagttttttatgtgatatgtgtgatgttccacacaaaatgtgagtaactctaaaattaaggcaagtagctgtgctgtttgataattatctacaaaagaaagtaatctcatgaaaataaatattgaatatatctaaataaagaataaataaagcttacatcctatatgttataacaaaatctaaactgtatttcctccttttttttttttttttttttgagacaaagtctcactctgtcacccagtttggagtgtggtggtgtgatcatggcacattgcagcttccacctcccaggctcaactgatcctcccacctcagctgccagagtagctggaactacagatgtacgccaccatgctagctaattttttttttcaagtttttgtagagatggggcctcactatgttgtctggactggtctcaaactcctggactcaagcgatgctctcacctgagcctcccaaagtgctgggattacaagtgtaagcccctgcacctggcctatttcctccattttcatatccatttaaaaggctgtagatttttactttttcattaggcagactctccagaagcatattatcagttttacctactagataactaagacttatatttgcataaaatatgaaatacagaaagaaaggcaataaaaatatatgaacatgataataataccttgatggcactgaggagttcttggtaatgtttctgtaataaatgctatattattaatattaataaatctataaaagggcccattgttaaaaaatacttaaaactttttgcctaaagtggctcagtgcaaatttctcaagaaaaattatacgcttttagaaaagacattttaagaaaaggatatttttggctgtttgaatatcaagtaaaaaatattacatcaagattcttttttttttttttgatacagagtcttgctctgtcgcccaggctggagtgcagtggcgcgatcttggctcacagtaagctccatctcctgggttcacgacattctcctgccttagcctcccgagtagatgggactacaggcacccgccaccatgcccagctaatttttttgtatttttagtagagatgaggtttcaccgtgttagccaggatggtctcgatctcctgacctcgtgatccacccgcttcagccacccaaagtgctggcattacaggcgtaagccactgcgcccagcctgattcttaaacatgatttaatataatttcatatacaacttcttttttttttttttttttttgagacggagtctcactctgtagcccagactggagtgcagtggtgcgatctcggctcactgcaagctccgcctcccgggttcacgccattctcctgcctcagcctcccaagtagctgggactacaggcgcccgccacaacgcccggctaatttttttttgtgttttcagtagagatggggtttcaccgtgttagccaggatggtctcgatctcctgacctcatgatccgcccacctcggcctcccaaagtgctgggattacaggcgtgagccaccacgcccggcctatttacaacttttaaaatatcaactcacgatgtccatagagagggacctactgaataaacttgcattttttctttccctgaggctttggttgatacattcatgaaatgattttgaactgcatcctgaacatcaaattttaatttatgtcaagggctcacatggacaatcatgcaccacccatattataagtgctttagacaaagaaatattttcttgttgtttgagacagggtatcactatgtcacccaggctggagggcactggtgcaatttcggctcaatgcagcctcaacctcccagactcaagtgatcctgccacctcagcctccctagtagctgggaccacagggatataccaccatgcccagtatattttttgtagagacgaggtctcactatgttgcccaggctggtctctaactcctgggctcaaccaatcctcctgcctcggcctcccaaagtgctgagattacaggtgtgagccaccacgcttggctagacaaggaaatattaagctgtaaggaaattataaaatcacaggcttacggaatttttaaaaaaatgacatcatctagtacaactattttatttgagattatatacataaatattttggggaactacaatgctattggaaataaattagcattgtaataacagaatgaccatcacatataaatacacaaaataaaattctgatatttcaaggactgtttctactttaaatgcaagtaaagagtttcacttgctccagaccaattgctctaacagccagtaccacagccaaaatttgaactagtccctcatcattaaaaccaattcctggccaggtgcagtggctcatgcctgtaatcccagcactttgggaggccaaggtgggtggatcgcctgaggtcaggagtttgagaccattctggccaacatggtgaaaccccatctctaataaaaatacaaaaaaattagttgggcgtggtggtgcacacctgtgatcccagctacttgggaggctgaggcgggagatggtttgaacccagaaggtggaggttgcagtgagccgaaattgtgccactgcactctagcctgggtgacagagtgagactctgtctcaaacaaacgaaagcaattctttatttctcaattcccaaattttattacaaaatattttttaaccttgaccctcaatgctgtatgtggaaattaagtttaaaaaaacaaaaacaggccgggcgcggtggctcacgcctgtaatcccagcactttgggaggccgaggcgggtggatcacgaggtcaggagatcgagaccaccctggctaacacggtgaaactccgcctctactaaaaatacaaaaaatcgggaggctgaggcagaagaatcgcttgaactcaggaggcggagcttgcagtgagccgagattgtgccactgcactccagcctgggcgacagagtgagactccatctcaaaaaaaataaaaaagaaaaacaatgaactacagtgttaaacaaatgtcttgtcttcatctttataacggggacaagaaattacttgtatctctaaatagtccaatctctaaacagcctccttatttgaaactggctcccctttgagatttgatgaggctggcagaaaaggtatgggacggtaggtgcacacagcacatgtctttattagtatcaagcccatacctactatgcctattctaagtagaaacaactgcttttagactcagattcatgaacaataaccataaagtggtcatgaaaattagttgcaaagtaattggttttagtttactacatttcaaaaataagaactaaatcctcaaatttcagacaatgccttctcataacaacatcagaaaacaagctataaattttcagggaaaaacaacagaattccaactcgttttctatttttaatattggagatagtggaattacaaaagtaaatttcttcttggattttgtttttatgccaaaatatgcttttcttagccttatataagtgcattacacttagagtagaaaaaagtttataatttgcatgtattcataaagtatgaattcatacttaccgggacaaattgtgttgtttttgtttgatccaactatattatctaataaaaaaattaaaaattaaaataaaatacttcagtaataatatcccagatttccctagtactttataatatacaatgcatgtcttcaatcataatctccttttaccctcaaaataaccataaagacttggttgcttcagcaaaattataactatatctgcaatcttttacaaaagtggatgcagatgtggaattattaaaagacaacatagcataaatattctgataaaaagtaagattacaaccagagataaaactgacatatcttcttttaccttctcctattcatcattcaacaattagggtatttctcttcatctcatttttgttttactatttttaattttttaaaataacatttgcatttgattatccattatacatctaatttttaaaaacagaaaatgcaggaatttttaaaactccagaataatgaatgtgtttatgctttaaattaaaaaaaaaactcaattaagtaggccattataaataagttccaatttctaggaatacattctagagcacatcaaggcacatgtgcacagggaaacacaagaatgtaactggagcattatttgtaatagcaaaaagctagaaacaaatgcacattagaggcagaatggctgaattacagcatcctcataagagaggattatgtaggagttaaaaataaataagaactctatttcaatatgaattagatcaatatgaacaggtatcaatacgaatagatctcaaaaataacactggataaaaaatatgcagaataatatgtatgacagacattaaatttatagcaactttgaaaacaagaaaaataataccgtatatacacatcataacaacataagtaaatataggagtgatacactccaaattcagcataccttgagagatggaggaagagggggtagaatgggaatgggaatgtgaaggggtacatatgaaactccaactatatctgtaatgttttaaaaaaaaatctgaaaaaaaatatggcaagttagttttgataaagccaacagggagtatatgagtgtctgttatattattatctatatatttctgtaagctggaagtgttttattaaaatgaacataaaaaatgcattattttcatttatataaatggaaccattctgcaagaaaaccctctgcgatgtgcttttgtacccattcaccttgatattttggggaattattcagttgatacatcaaaattcaattattttaactgctatatagtattccattatatgaaaaaaacatattttattcattttcctaccacaaacaatgcagcaacattcttgtacctgtcatgcatatgcacaaacattccctagagtatatactcagaaatggaactgatagtattacatagggtgtgctcatgtttcaactttattagtttcataaacattctcctaacttccttttaagtgactcttcaggttaacaagtattctcagatagtggctaatgttctattatgccccacatatttctgatttcactaattaagttgtacgcttttcaaagtcctttgcttatgttagtatgtagtatggtcatatggtaacatatgagactgatgaaatctcagagaactgtaatatctacagttaagttgaatatagaaggactcaatttaaaaattgcctccaaattagatacatgcaactataattacctagagggatatactaaaaccaaaggattctgcactcagactccttcaaaaaatttttagattttcactccattttaataaactgaaaacagaaattgcagctgatgaattacgggtgccgattacataagaaagagaatatggaaatgcaattttaaaaatactaaggaaaaagccttgcccctatatattagcacatattggcatatgaatgtgcatttggaggctaagttaaaatatttatactatttgcttctactcattctagatatcgcacaaatttggcgacaatgctttcttttgataagtgtctacatatcaattccttagtgtgtaatactgtttgccacattttcttttttttctgccagtggtctacacgttcagagaaacttccgtagcaacaaactatagaaatggcccccgaaagaatagtcttgccacattttatcattcacttccataaccttaagaaacaagaaaatcataattttatattgcagtttaagtttttcagtcgtaatctccctgtcttataaagtctcaagtaaattgcctgttagtttaatatttatctcatccttctttaaaaacagaaatcacagcagataaataaagagaccctacccttttcacatttgtcttctgaagtattggtcaaaagtggtgctgtgagaacatgcatacaatggttgtagaaaaaatttagaaattcacttttttcggttttctgaaacatagaattttttaaacaatactgttacttatgtaaataaaaacatcttcaagattagcagtacataccttttccagaaccaaaccaaaacaaaaagaattagcagtacagatcatatataagcagatactttaaaatactgtgaaaaaaatcaaacacttggttatacgttgtcaaagaaccaaaaactaactatattcactttaatcttatttctgtggaactgaaaattaagtctacttcatattatgtactaagtaaaaatgaaggcaagataaagatcagagagcatcacaaaatgtttttctgaggaaaattattcaaaataattttttaaaaagatgcctgtgatacgaatatgaaacgcagtgaagaaccaatctattgtacaacatatataataacaacatattactaacaatgtattacacttgcaaactgctaagacagtagattttaagtgttctcaacacaaataaatacttgaggtaaaacagacacaaaataaacaacatgtaagtcagaacagcaagcaccataatcactattgatcccatttgtctctctctctctgcagtgtattgagtttttcccaagaaagtaacaaagaaagaaaattctctcaactttaaaaataacattcaaatgggggtaaaaggcacatttgaatctgttttggaagaataaaaatgtttagaaagaaaaagaaccaattaagcccatgtgatagcaacttaactacctaaaatttggaaccccagatttcaccaattctatctaaattttaaaaaccactgaatcactttatcaagccactggatgaaaagacaaaatttaaatcaacttttaacattttaatattttatactttgaaaatttggaaaataatgtctatggcttttgccactattttttacacaattgggtatacaaacttgtaatgatttaaaaacgatgtatatattctctaaatatgaaggaaattttataaagaaaaatatccctccatattgagagaatgactattaatattctggagtatctaatccttaagtattaaggacttaatccttaaatcttttaaaatgtcttaggtaattaagatcattcagtatatttaaatttttccttttttatggtgataaaatcacgcaacataaaacttgctatttaaaaatgtattggccgggcatggtgactcacacctgtaatcccagcactttgggaggctgaggcgggtggatcacctgaggtcaggggttcaagaccagcctgaccaacatgatgaaaccccatctctactaaaaatacaaaaattagccaggtgtggtggtgtgcgtctgtagtcccagctacttgggaggctgaggcaggagaatcgcttgaacccgagaggcggaggttgcagtgagctgagatcacgccactgcactccagcctggtgacagagcaagactctgtctcaaaaaaataataataattttatcatttttaagtgtacagtttagtagtgttaagtataatcacattgctgtgtattaaattttaagaaattaacacatagaggccaagggccataaatggaattcctaacattttactaagattttgacggattacaattttgtattttaccacaaatgaattgctataagaataccactgctacttaaataccaactggacaaatacttaaaatacttgtttctcaaaatcttattacaaagccacctaaaactgactaggccaaaacatttttatctcagagtaatttcttacattagttgtagccagcatgttctctggatcaattagagtacgaagaagtcccattaactgaacagcgcctcctagctcaggatcagtatcacagatcatttgttcaattaccacattaataagaagaatatcctggtggcaaaacaaaacaaaacaaaacatgtttccattagacctggtttagatctaagacaaaaacaccaactgaaagagcaaagtgagaattatatagagaaaaaacgaagaatggaatagcttatttaaacctctattcctaatgcttttgaaagttctataaaatactacacactagagtgaaaaaaaatcccactccgagaaaaaaaaaagaagaaggaggaaaaaaaacccacaaaagcagagcatgcttcaacttataggaagtggaaaacaaaattctttagcagtagttcttgttcagtagaggttctaacagaatctcattttgggtttcagactcaggcgtaaatttagaggttgactaaacaagcaagatcacatgaccctaagacataaattatctcagcctctaactagtaaatccttcctaacaaaaagaaaaaaaagaaaaaatgaccaaaaataacccagtacacaactcttcatgcaagtgaacactgtgttatataacaatctaatattaaatagatttgttacattagtaacatgctcttggattttatttatttatttattgaaacggagtctcgttctcttgcccaggctggagtgcagtggggcaatctgggctcactgccacctcattacaaaccagtctcctgcctcagcctctttagtagctgggattaaaggcatgagccaccatgcctgactaatttttgtatttttagtagagactgtcctgattctaagctggcatctctattttctgattgggaaatataaagaaaatcagatgttcaaatttgtttcattgattctaaaacagatttcttaaaaattttcacctcttaaaattaagatacattttgtaactgatggcatttgacagccactatcagccaagtggtaatcgtgacaaaattacataaaaatcttctactgacactgtctggtaagatcaagaaaacattagcatctgcatatcttaggtttgatggattcagtaaacgagaggagagcataaatctttaaaatataaggattcttttaaaataacacaaatgttaccatatctaaaaaattaacctaagattttattattaaatgagaaaacacctaacaaaataagtaattcagtaataactatattactcatccagtcaggttctgcaagttttactgaatgtttcaaaggccattaatataaaaatatgtgcaatctgtggcataaaaagatgacattattgctaaatttaccctttctgcttggatagaaacaatgactacagtaaaaaatgttaatatttcctttcatcttaatacatatttaaatattgtaatccatgttgccataaccaaatctgctccataatactttaccaaaaggaaatgtttgaatgctgagcatttattttaaaagggcactaaaatatcaactgccactgaatataaaaataagttactttctgtttccttcctaaaggtcaccaccagcccagtatggaattcagcatgtagaagacttaatttggattttttttggtaattaatttatcttctcttgtggactaaattattttgaggcaacacagttttaaaaatgtaaaattgttagctctcagaaaattcaggaaaatgaaacccctagaaggttgttataagaaaaaaaaacactgagaaaggatcttttcacagtgaaaaaatcaatcactgcttttctaagtcttaggtatcaattaaacaagaaatatttttaattaaaacaggaatcaaagcttgaagagttaagaattctgaaagttaacagtttactaagatcatggtctgagattgattcatggtcattttatgataaatgcctttaatcacacacatcactgaagatggagcaatgggagtgttaatttcaaagttatcttttgtaaagggtggcattaagataaaccaatgagattataaaatgattaataaagtaggcatttctctttaaagtcagaattagcatcatttgacattgcagcattagcccaagttgattctaaaataaaatcactttaaaaaacattgaaaataactaacaaacatagaaagtataaatctaaggacacattaaaagattaaatgcaaaacacataaaacaactataatttcattcagtggtaactgatgcaagcatcaaattaaaattgagaatcaaaaactttccttaacaagtggatcgcacatggtggctcatgcctttaatcccagcactttaggaggccgagatgggtggatcacctgaggtcaggagtttgagaccaccctgaacaacatggtgaaacctcttctctaccaaaaatacacagttagccaggcgtggtggcgcacagaggttacagtgagccgagaatgcgccattgcactccagcctgggcaacaagagtgaacctctgtctcaaaaaaaacaaaaaacaaaaaggaagacaattataattatctcctacttaaaactgaggcatttttaataataaaaaaagagtacttttaattatagctctctgttcattttgtccttaaaatagcttaaggggaaaatttaaatatatcagtagtgggaaaacacaatattggtctcattattaaactgtcttttttttaatgttttttatttccataggtggttggggaacaggtggtgtttggttacatgagtaagttctttgctggtgatttgtgagattttggggcacccatcacccaagcagtatacactgcaccctatttgtagtttttttatccttcacccccttcccaccctttccccaagtccccaaagtccattgtgtcattcttatgcctttgcatcctcatagcttagctctcacttatgagttgagaacatacgatgtttggttttctattcctgagttactgcacttagaaaaatagtctccaatctcacccagtcattattaaactttcattcctacttaaaacatattttttgaacaaataaaagcaactttttagttatcctaggtaagtacctgacctgtagatctcctaaggcttgaaattacatttcattaacacttgaaatttaagaccaatatttacaaatctgattctattataatctatttatctcaatattggtttgaatatctgggtttctttttttctaacaataaacaaaatcagtcgccacatattctaatttggccaaagtcacaacaagtcagaaatctattattttgctcccaagaaagattaagattatgttatgttttttctctcaatagtttgcaaacactactcactctacaggtaattcacatagaaccacagcattattacttacgtcatcactctgctgagcttcttgcattacaaactctcggaccatagatggactaaattctactagataagaaaatatatctgtagcagctgatctgacttgcaaatcatccatgccctgataaaaggaaaattaggttacttagagactgttaacaaaagttattctcacatttcttttttcttttccaaatccatacactagctctcaactttttggattaagatgttttactgcaatcaatgtgtataaccttgccagtatgttcttcctttctttttacaaatattaaaactttcaggcaattcaatgattagtttctgctgatttttaccactgcaaataaatatacagagaatttaaatataagaattggcacaggattataaggcaataccttacaaatgctgtaaaaaatatgggaaggggatttatttaaatatatgtaaaaatttgaataacgtctcctagctaagacttcaaagtcttccagaatctgccttttgtcctgattttgcaagagttactccttagtaactgtttctatttcctgtgactcacctaatagagcatgcttttgaaaactctttttgggcatttctacccttttctgcaacttagttttctaagatggtaatcctagatacttttcccctccaacacatgaagagtacatgacttataagttacaaaaccttgaggtgattctgaaaacactccccaacccagcagttctcaaagtgtggtccaggtaatcctggtgagaggggtctaacatccttttcaggaagtatacaagattaagactatttcataataataaataacactgagcctttgtcattttcactctcattcaatcacaagtacagtggggttttccagaggctgtgtgacatgatatcaccacaaattaaatgtagaagctgctttgtgaatctaaacaccttctataaagcaaggtactaaagggattagcaggaaaaaaaaagtaaaaaacggtactcttttcactaaattttttgttttgaaaaaattatttttcataaaagttatattgatttcaatctcaagaaaatgtggtgaaaaaagttctattatttatgttaacatataatgggttatcatttttaaatgaatgctttaaaaatttgttttaattttccataaagtaaataccaatagataaaactcatataaacaaaactctaagaaccatgccctaaccctgtgttgcagcatgaatccccttgttccactcactgatctaaaaacaaaagatattttactggcttctatgaaacacacttaatattgttacagaaaatataacagtcttgcaaaaacgtggggtttttttattcacttgaaagcacactatatgcaagtgattacatactgatattaaaaattaaataaaaatctgaaactgaagatattcttgtaattcaattaagatagctaaactatagaattgaatatacattattatatattttcccatccataacataagtgtattacaaatttacaatttcaaaaacatgaaaagaaacggcataattaccattacaatttcaagagcaggaagaattcccaattttgccaatgttttgaaaaatgcatccctgttttgaggttgtaatgtctgagaaaatgcacaaaactccttgaaaaaattaacctgtaatgtcagaaattttagtgagacattgataaacataaacttggggcacactatagtaatcatctaccatggtgtggtattcacccttctgaaggatctcatctttttggagtatgctggctcctcaaaactacattaaaaacaaattaaaaactagcaccccattaaaagtaaaccttgcattactgggtgctattaagcaaaaagagaaatccaccaatacaaggtaaatgtaagctggctttctgaaagacacatcataagctgcttttttccttttttttccagtgaatggaggtgtttgacaacacatctttctaagtgaacctttgaaatatgttattagaacattttccttactccaatgggaccttataggtcaacagagatatttggctataaaaggcaaatgaaagcatgcatgctttgtttacaatgctggatttgcctattggtctattagtatgcaaaaatgcaagatatacttttaatggggtgccagtttttaaaatgtttttaaatgtaggttttgaggtgccaggatactctgaaatgatgacatctggcggggcacagtggctcacgcctgtaatcccaacattttgggaggctgaggcaggcggatcacttgagtccaggaatttgagaccagcctgcccaacagggtgaaaccctgtctctactaaaaatacaaaaattagctgggcatggtggcacacgcctgtaatcacagctactcaggaggctgaggcacgagaagcgcttgaacccaggaggcggaggttgcagtgagttgaaatcatgccactgcactccagtctgggcaacagagcaagactctttttcgaaaagaaaaaataaaaaacgatgacatctttcagaaggctaacactgatcaattaactctttaaacacattcagtgcaaaaatgccaggtaataaatttgttttgaattatgaacacatagtttcacagaaaccatcctacaactcaactctagctgggtccccagtaatatctcaaaaacataatactggtttaaggactgaaatgtacatcaaaacttctctagtctaaaacaccaatattataattgagaaaacgaagtaggctactaataagtaactacaccaaagatgacttagaggttttaaattagccatctttcattattttgtgaaatccaaaataaataaataaaaatctgaaaccgaagatattcctgtagcaattcaatatcagatagctaaattatagaattgaatatgcattactataacatatactttcccttctcatctcattatgtttgaaaaaaatgtcaaacatctggcaaacggcaatcacaatcactattctcttcctcaaaatggtttatatctcaaagaaaatgcttacaataaaaaataaaaaatttccaaagaaccaaattatttatatcatttattcaggaagcattttccttatctcttgtttaaaaagaaaagcattgcggctaggcgcagtggctcacacctgtaatcccagcactttaggaggccaaggcggggggatcacctcaggttgggagttcgagaccagcctgaccaacatggagaaatcctgtctctactaaaaatacaaaattagccgggtgtggcagcgcatgcctgtaatcccagctacttgggaggctgaggcgggagaatcccttgaacctgggaggcagaggttgtggtgagccgagatcgcaccactgcactccagcctgggcaacaagagcgaaactccatctcagaaaaaaaaaaaaaaaagaaaaagaaaagcatggctataatgcgaatgtctgcaaccataaaaatgtatgaattttgtagttctgttctaacataaggcacttatctgatttggggatttataaggcatacaatggtggggggtgatacatcagaacatcctaagaagtttctaaaatacacaaattctagaaacaaattttagaaactctgaataatcatttcatagttcaatttaaatacatacttttcatctcttactaatctaattacaaaaaattgtctcaagttagcaaattcaagattaaaagctgtgcatgccaaaagaataagtgctctttaagagtttgaatttcataacttaccaattcacgccgtttatcatcatctgtagcctcatctgttaattgtgcaaaaacttcagacaaaaacttctcatcttcctgcatgagaaaaataattactatgaaatattaacaaaagaataaagttatactcatttatatgacttacacaaattataaaaaatagttgacaagtagtattttcatcatgaaacctaatattctggggtgtatttctgtgttacaattttctaaaatttgactacaccattcaattcttgttataaatacatcaatatctagtttaactaaaaacctcaactacaaataactctctggaaaacaaaaatatttgttctagaggtgttacgtgaaaactcacttaacttagattctctagccccctttcagggtctacttactcttaatttaaacataattcaaacaagcctaaggatcttattgtcagtttataacagattagaaaaacaagaattgtaagacaaggaacaaggaaaacagtaaaggaggctgaattccgacagtagataaagttacaaagctatttaaaatacaataactcataaaatacaacaacctacaaccaactggtgcacagttttacacgttcttgcggtccccaaggatataactaaatgacaaagcactacaataactgcttttcatactaatgactctggggtattaaaaagaaagacaagtgctaatttctacaggcgttgtctaaaaggacaaacagaaaaatatagtcaagtggccaggcgcggtggctcacgcccgtaatcccagcactttggaaggccgaggcgggcggatcacgaggtcatgagatcgagaccaccctggctaacatggtaaaaccctgtctctactaaaaatacaaaaaaattagccaggcatggtggtgggcgcctgtagtggcagctacctgggaggctgaggcaggagaatggcgtgaacccgggagggggagcttgcagtgagccgagattgtgccactgtattccagcctggacaaaagagcgagactccatctcaaaaaaaaaaaaaattatatatatataaaaaatatatataattatatatatatttatatatatatttaatatattatatatatataatatatatatagtcaagcacgcatttttaaaaaataaatttgtgggccaggtgtggtggctcatgcgtgtaatcccagcactttgggaggctgaggcggggggatcacctgaggtcggaagttccagaccagcttgaccaacatggagaaaccccgtctccactaaaaatacaaaactagccaggcatggtggcacatgcctgtaatcctagctactagggaggctgaggcaggagaatcgcttgaacctgggaggcggaggttgcagtgagccgagattgcgccattgcagtccagcctgggcaacaagagtgaaactccgtctcaacaacaacaaaataataataataaataaatttgtttgtctaaagtctaggagtaccggttagactgttaactgtggttactgcttgctgataggttatgagtgattttcttttttggttatctatattttctaattggtgataggttatgagtgattttctttttggttatctatattttctaattttctacaataagcacagactaaattacaaaggaaaaaatgggcaaaaatattaaaattcaccttagagatttcatcaaaatctgctaaaaaaactgatggaaattgttggtggttttaagcttcagttatcttcaaaattcatttttatgaaatgtaatttccattaatttaaagtaacatgttctaaaaaagtttgtaacaatagtatctgtagagttgatagtaaaataaaaccctaacatttaaaggatacaccccaactacctgtcctttttcttactgaggatcatccattaaatggtatcaatcccttaaatcctttttgaaataacgtggaacatgtatttttaaaaaatgaatagaaaccactaggtacaatcagagagtataacatgctcttctactaaaaatcaattggtgctactcaaagacaagacactgggagatgaatcacttaattagtctgactcagaatgtgtctgagtcatttaattagtctgactcaggtgtttcttttcgtatttcattgactccttttggaccttatgcactgcagcctgaacatccatcttttgagggagtttatatgcatatgtaatcttttatttagccctcaagttagtttttcctttttttttttttctagagtctcactctgttgcccaggctggagtgcagtggtacaaacgtggctcagtgtagcctcgacctcctggactcaagcaatcttcctccctcagactcccatgtaacagagactgcgggcacgtgccaccatacctggctattttttttttaattttttgtacagatgggggggtttcactttgttgcccaggctggtatcgaactcctggcctcaagcaatcctcccacctcagcctcccaaagtgctaggactacaggcatgagccaccatgcccagcctactttttccaaatacttttagtcttaatattttaggttagggtgagtaagtacatatttacctccattcacaccttttataaatttctattttcctgcatctgttgtagattacatcttcatcctttactacctgaaaatttaattttttcaaaatattttcataagaaaaaagttccaactccttgataaatgcaatttcccacttgaattcttcttatatgattcggtacttgtgagctgataagtagaactgcataaaatattacagatagaggcaatctcaattattacagtccattaagagaatatgtattcctagtattttttccctgatttccagcattactctggctattattcattaagctataaaagcactctgttccaatatatttatgaaggaagcaaataatcaataacttaaagcctatcatatagttgaaatacttactccaaaatctctggttctccaagtaatcaaactaatctcttttagtttttcttttctatttggttttaacagcttttgttttaataaaacctatatatttaagtcaaaacttgtgtggctgcttttctggacaacataaaaaaacactgtggggaaaaaaagaggttgcttctaaacagtctaaatcaaactcttctctttgcagtaatataaatacaggccaaacaaaagaaaaaacagaacccattcatttttagaaacatataaacacagaaatttagaattaaatcagattttgcaacattacagagactgtcaagtccaattttaaatttcaagagactgaggttcaaaaagtgaacctttctgagggtagctagtgacagatggatttagaatccaggcctcccaaataattaatgaggtttttgtcactcctactaagtaaaccacaagacaggtttccaagtatttcaaacttcaaacgtatgaatcaaaccaaagcaaaagatacacaaagctggaatgggccaaatctagtaagataaaatttaatatattaaatcctgtacttgaatccaaagaaaaatcctaaaaacaaaatgaaaagccctattactctaaacagttttttaaagagtatctgaagattttacatacttaatctgtaactgggatgggaagttagaaatttttctctttccgtgccaaaaccttagcatctgcaaaatatgttaaaaagagaactaaaccgctaatcctgctgggctaattttaagcttaactcttacctatggaatagcagaaatatgtatataatataatatatgtaaatgtgttaaaatgtcaacatttgagattcctatcctccatcatttctagtaaggagagaaattaaaactttgttctgaaaaggatcttattctataactgtttgtgcagaaataatctcattttacttgctttcaaaaatttaatttctggctgggggcagtggctcatgcctgtaatcccagcactttggtaggctgaggcgggtggatcacctgaggttgggagttcaagaccagcctggccaacatggtgaaactgtctatactaaaaatacaaaaattagccaggcatggtggctgctgcctgtaatcccagctcccaggaggctgaggcttgagaatcactttaacctgggaggcagaggctgcagtgagccaagatggcgccactgcactccagcctgggtgacagagcgagactctgtctcaaaataaataaataaataatttctaaaatattttaaaagaatgttgctcaattctgggcacaggggattttgatctgcaattagctagaacatttggagtcactaaagtcttatgtccctatcatgcttaagatattgtcaacatgtattagcacacatactaggagccactgactatgctaagtactctcatataatttctcagttaattaacctaatttaagctaggatttatgataaggaccttcgtactacctcacttcggcccagttacataaaattcttacatattcacttgccttctacaactcacacagcagcaagttaatgcgcatttaagaaaccacaggtaagtgtactagatacccagataggtatctagaaacacctactacctaaccaaaaatttctacatggaaatctcagagtgagactttaggaaataagtgcttagaggccactgtagggccaggtgtggtggttcacatctgtaatcccaacactttggaaggctgggcactaggattgcttgaggccaggtaagaacagtttaggcaacatagcaaaaccccacctctacaaaaaataaaataaaatagagaccactggccacaatcttatttctttccttttcacacatagttgaaaacacaattcatacccaaaggaaaaaaaagcattatattaaaaagacacctgcacttgtatattgatcgcagcactattcatgatagcaaagtcatggaacccacctaagtgtctaccaacagatgatcagacaaagaaaatggggtgtatatatacactgtggaatacaaatgaaatgttaaaaaataatgaaatcatgtcttttgtagcaacatgaatggagctggaggccattatcctaagtgaactcagaggcagaaaatcatatatcgcatgttctcacttacaagtgggtacacaaggacattaagatggaaataacagacactgggaactccaaaaaggggtaggatgggagaggactgaaggtttaaaaattatctactgggcactgtgttcaatatcacggtgatgggtacactagaagcccaatctccaccattactcatgcaatacccatgtaacaaataagcctatgtgccctctgaatctaaaataaaaaaaaaaaaaaaaaaattcaacatcattgctggcacataagagataattaagtagtaaatgttatgtaaataacagacagttcacagaatctggctatttcatgaaatgcatctcatgaagcagaaatgagtaaatcttttagaaaaataaaaagctgcacttgatttacgtaattatagccttcacaaataaacctattataaaatacataaaatgacaaagttttacaaatatttatagttcatataatttattttctgaatataaaaaagtatttacgatttactagtatgaatttggaaacccttctgaagacaaaaacagtcatttgaaagctacatatgagcttctgttcctggtcctctttttatcaactacagactgtgactctgtccaatctcctaagattattaaatgtttttctgtcaacaagtgaaatagcaccctgaattgtatactacagtttaaaaatacacaggtcctatatattataaaaagaacctgatatgtacatctaacctcccccacactcattattggtgaataacaaaaaattggtaggtgaataaatgacctgaaagaaaagtaaatcctatgcaaaaaattaaagtaaacaataataggtgactactggtgggaaacgtcgcaaaatgaagtcgattagctaggcactaagtcagagatagaatctcaattatttgtatcaggacccttttaaacttttttttttttttttttcagacagtctcgctctgtcaccctggctggagtacagtggcacaatctcagctcactgcaacctccgcctctcggttcaagcaattctcccacttcagcttcctgagtagctgggattacaggcacgtgccactgtgcctggctaatttttgtatttttagtagagatggagtttcgccatgttggtcaggctggtctcaaactcctgaccacaagtgatcctcctggccttggcctcccaaagtgctgggattacaggcatgagccaccacacccagcctaaactcttaagaattatgcagaggctgggtacagtggctcatatctataatctcagcactttgggagggtgaggagcatcacttgaggccaggagtttgagaccagcctgggcaacacagtgagatcctgtctctatataaaaaataaaataaatttttaaaaattacaattaaaaccaagactcgtgaaaatatttatgaattcattttaaaataagtcattttatgtttatgtaaatattttttaagagaaacagctatatgatccaaaatttaaacttttataaaaaagagtagccccttttacatttttgcaaatctcaatacctggcttaacaaatgacaaccagatactcatttatcttttctggcattcagtgtgttgcaatatgttctttaagcaaaagtacatgaaaaaaaaaaaaaaaacacagcctcacactgacatcaaactagaaaaaggaaaacctcataaatgcctgtaagaggggctcagggacttccagaggtccacaaaccacactctgagatccacaatactaagtatatagtagctgctcaataaacttagtgaatgatatggaaataacaaaagcagttatgcagaaagctgagtataggctactgttacaagtaagacaagtacttaaaaagcatgcttactatactgttagggtgtaaaggattaacatgataaatatagtataaaactcctatttcacaactcaaggagacagaataaaatcaccttcatatagcaaatagccacatactcgtatacaccccaataataacagtatctctcaaaatggaagaaaacatacttttaaccctttacccattgagaaaaaaaaagtacagcttgctgcaaggactcatttaattttacataaacacgctctttgaggccgaagcaaatctgactttcaaggtgaaaataaaatataaaaactgttcttggagttatttctaaatagaactaacatcagaattgtttgaatcatcagattcgtctatttcgaaaaaaaaaatcagattcaacaaacgaatcctcgggcaacaactgttcgagaatgacaataccatgtgcaggactgctatgttttctacgatttgacattttcagtgattaacaattactatagtttgtaaatgaaaatatcactattaaaaccagaatgctataaatagaatgatgtcttctgtttccaaagtcaatatgccacagcaatgcaaaaataataataaaagctaggtattttgtggcaaagttatctcaaggtaaacactgcagccaagcactactggcgagtattcacaggacagacaggaaaagggttaaatatagctgcattggccaggtgcagtggctcacgcctgtaatcccagcactttgggaggccaaggcgggcggatcacctgaggtcaggagtttgagaccagcctggccaacatggtgaaaccctgtttctactaaaaatacaaaaaattagtcgagtgtggtggcgtgtgcctgtaatcccagctactggggaggctgaggcaggagaatcgcttgaacccagaaggtggaggttgcaatgagccgaaatcacaccattgcactccagcttgggcaacaagagtgaaactccgtctcaaaataataataataaaaaatagctgcatcatcgatatatataataggcaaattcataaagagtagaatagtggttactaagagctggaaggagggaatatggggagttactgttcaatgggttcagagtttctgtttgggatgatgaaaaagttctggaaatggatagtggtaactgctgcataacactgcaaatatacttaatgccaatgaattgtacacttaaaaattgttgaaactggccgggcacagtgactcatgcctgtaatccaagcactttgggaggccggggcaggtggatcacctcaggttgggagttcgagaccagcctgaccaacatggagaaacccccctctactaaaaatacaaaaaattgggctgggcggggtggctcacgcctgtaatcccagcactttgggaggctgaggtgggtggatcacaaggtcaggagatcgagaccatcctggctaaaatggtgaaaccttgtctctactaaaaacacaaaaaattagctgggcgtgatggcgggcgcctgtagtcccagctacccgggaggctgaggcaggagaatggcgtgaacccgggaggcggagcttgcagtgagccaagattgcgccactgcacttcagcctgggcgaccgagcaagactccgtctcaaaaacaaacaaacaaacaaacaaacaaaactagctcggcgtggaggcacatgcctgtaatcccagctactcaggaggctgagacaggagaatcacttgaacccaggaggcagaggttgcggcgagctgagatcatgccattgcactccagcttgggcaacaagagcaaaactccatctcaaaaaataaataaataaataaatagtcaaaacggtgaattttatgttatgtatattctacctcaattttagaaacacaaatactaaattgtataaaaagctaaaacacaggctacttaaaaatataaaaggctgggctgggcgcggtggctcacgcctataatcccagcactttgggaggctgaggcgggcggactgcctgagctcaggagttcaacaccagtctgggcaacacagtgaaaccccttccctactaaaaatacaaaaaaatcagctgggcatggcagtgcacacctgtagtctcagctaatcgggaggctgaggaagaagaattgcttgaacccgggaagcgtaggttgcagtgagctgagattgcgccactgcattccagcctgggcgacagaacgagactccgactcaaaaaaataaataaaaggttgcactaaaaccacaagacataaagtcccaatttcttttgtttactttaaatgtacttaatagtacatttaaacaaaataaatctttcaaaaaatagagggtataaacacctgcttgaactattaagggaactaaatatctgaaaaatggaatcgtgaagagtatctttttacttacctgcaacatgctgactatctcaactttgttgaagaaaataaaagacgtaagagtagaaagaaaattctcttcaaaaacagatggtgtgggcaaaatgatgtcctgaatgtactgtaccctgtaagtctgatgtattttttgccttagttcagagtctgttattggtataacttccttgaactttgcagttttggtcaagaattctctatgtctttttggctgagccaaagcagggtcatattcaaggcatcccacgacatccatgatacactcatcagaaaacattacctcaaaaagagttgccttatttaggaataagattcctctaataatttcatacaaatggtgtaagccttcagtgttttctaggttctcgcaagcttggaacagctgcaatagttttttaatatagccttcattttccaaggcgagagccagcttttccctacggataggtgaggagagcactgaggtaactaagtcagcaatctcttcaagtttattgagttcacatgtgggcaggtcaatcagatgactagtttcaggcatttcttcaaatcgttcttcttcagattcatcaatgaggtcctgtgtgacttccactgatgggtctttaccttgaacctaaaaatatccaagtatacagctaattaccttaaaatacaaaataattcaaaattttggaaatcaaatcatttggaaatgcctggctagtcactactaattaaaagtgaagtctaggccaggcacggtggctcacgcctgtaatcccagcactttaggtggctgaggcaggcaggtctcttgaggtcaggagttcaaaaccagcctgggcaacatggtgaaaccccaactccactaaaaatacaaaaatcagccaggtgtggtggcatacgcctgtaatctcagctactcaggtggctgaggcaggagaatcgcttgaacctggaaggtggaggttgcagtgagctgagatcgcaccactgcactccagcctggaagacaaagcaagactctgtctcaaaaaataaaataaaaaattaaaataaaataaataaataaaataaaatgaattctcttccagcttggtccctgaatgactctcatgagtagggccccttcccctattggtcaaacagcattaaggagaaatcaacttttgttgtgacaagccattgaaattttaggattgtattactacaacacaatctgatcataacgtctcagagacagccaatgaactctgctgtatggattcacaataaatccacactatcaatagggtttttcaataaaaattctctagtctataatcctatcgtcatcccttacagctgctgctttaaatattttttcactttccaacttctcaaacattaccttcacctttaagtctcagaagataagaggcttcctttgaataaaaagcccatcagtactcaacttcctctaacatttctccatctcacaacttaccttcacacatttccttcattcatttcaaaggaaatgtctataccatttcctaaggttaacatttccatatgtacttctaaacttatgctttctcaaagctaaacatataaaaattatctttgctcttgtttttataatttatttctctccaatggttccttctatttcatcattctccaatccccttaagacactctgaactatctgaaccatcaaactttttcagggaagcttttttgttctattttctcattataaggggtggcggctcacgcctgtaatgccagcactttgggaggccaagttgggcggatcacctgaggtcaggagttcaagaccagcctgaccaacatggagaaaccctgtctctactaaaagcacaaaattagctgggcgtggtggcgcatgcctgtagtcccagctactcgagaggctgaggcagcagaactgcttgaacctgggaggcggaggttgcagtgagccgagatcacaccactgcactcttgcctgggcaacgagagtgaaactctgtctcaaaaaaaaaaaaaaaaaaaaaaaaaaaaaaggcgggcaggggtggttaagaaataattaagtaatatggcgcttactgaaattgaaattgtcctttcaaagatcagtaatgacttcccagaactgaaaaagtaaaacatgagatatgattttgtgaaatatcatgcagtagttaggagcaaaaaactaaatacatattcagcaacatgcacagattttaagaagtagagtgctgcgttgtacagtaaagagttaactttgctgggctatcagagtgctatctaatatcccttccaaaggtggaaaagtctgaataaaaatcaatgacaaagaaaaaaataaaatttaaaaaaacaatgacaaatggaaaggagaaacagtaaaagagggaaaaaaacatgaaaaaatgagtaatgtaacaaggaaaattcagtattaacattggtgcctaagctgggcgctgtggctcatgcctgtaatcccagcactttgggacgctgaggcaggcagatcacgagctcaggagttcaagaccagcctgtgcaaccttgtcactacaaaaaatacaaaaattagccaggcatggtggcgcacgcctgtagtcccagctattagggaggctgaagtgagaatcccttcagcctgggaggcagaggttgcagtgagcttagatcacaccactgcattctagcctggggagagccagaccatgtctcaaaaaaaaaaaaaaaaaaaaagcagtgatgcctcaagaaaggctgaaggcaagggatgacattgtctcttagctcagttataacagatgcctggaagggttaagcaataggtttgccaagaccacccctcctcttaaaacctgacaaggtcaaatgggagcctgtaagctttgaagagtgacactgctctgggagacgttttgtcatacaatatgatgatgaaccagaccaactgtctttttcttttttttttttttgagacagagtctcgctctgtagcccaggctggagtgcaatggcgcgatctcggctcactgcaagctccgcctcccaggttcatcccattctcctgcctcagcctcccaagtagctgggactacaggtgcccaccaccatgcccggctaattttttgtatttttagtagagacggggtttcactgtgttagccaggatggtcttgatttcctgaccttgtgatcctcctgcctcggcctcccaaagtgctgggattacaggcatgagccactgcgcccagacccagaccaactgttaatgactacgtgggattctagtaatgtgctagaatctaccaactcttacttttcaggttacatctactaccataatgtgatatggtataacactagtattgttgatccagctatcttatctatataaatcttataatactgatattgatgatcaaatgtattgggagactgagttaaagcttcctgaggatgtaatgctgatagaaaaaccactggcccatgctgcagttatttgaataattaaactaaactaaactaagaaaaatgaaagtcactggccctacagaatcatggtctggaacctaagaagaaaaaaaatcactggactgacaaaaagctggattttgctgactatcagtttctatggtacacagttctgtacaagtttatgataaggtacaatctgcagatcaaggagagaaataagaaatcaaagcagtacaaaaatacaaaaggtatgacatggttttataggaaaagttagttgtttctttaaacctagctctactccacactggccccaaatactaggtatattcatactgatattatttctctgtctgtgatataaatcctacgctaaatgtagatgctcacacaaatatgatcattttggtgtaagagagtcttggtcaaggagtggcctgtgcagtaaaggactgaccttgccaaaggaaaagtttggcccttatctagccccagagaggtaaactctaagcactcagaatatcctgcttcataataatgtttacctgggggacttcacctatgccagacatactatgctaacaatgtgctatgtggtgggggccttggaccacaagatattcttgacctctggaggtgctggaataaggtcagccacacaggcggtcagccatgcttacataaactctaatctccagtgaaaaccctggacacgaaggtttgggtaaacttaactagttggcaatactgaatgtatgctgccatatatcactgctgggagaagtaagtgctgtctgcgtgattccaccaggagagagaactggaagctcaagcctgaaactctcctagaccctgccctatgcaccttttcccactggttattggaatctgtatcattttgctataataaactgtaactgtgagtataacagctttgctgaattctgtgagtctttccagtgaattatggaaattgagagtgctcttggagacctcctgaactacctaagtgaaaacagtaataaacaaatttccacaaaaatttctaggacgaatactcttttttttttttttgagacagtcttactctgtcacccagactggagtgtagtggcattatcttggctcactgaaacctccctcagaggttccagctattctcctgcctcagccaccctagtggctgggactacaggcatgcgctaccacgcccagctaatttttgtactttgagtagagatgaggttccaccatgttagccagggtggtctcgaactcctgatgtcaggtgatccgcctgcctcggcctcccaaagcgctaggattacaggcgtgagtaaccgcgtccggatggacaaatacacttatatccaagaacatgtattaaaaagtaggtgttgacatataggggtggggtagtaggatgggacaaggtataatctaatacagtaatcactagaataaattatccaccatataaatttatgttctagcagatatgtaaatcaatatcctagttctaaataagaggagatgtttgtcttctgcattatagttatattttctgtaaatctaaaactgtcctaaaacaaaaggtttcttttaaaaaaattctagttacttaagagttaccacatattctatatatcctgctacactctaagttccacataaactgaagtcatgaatactgttgagcattagtgcctggtacagtatgcataaacattaggcaaacatatgaccaaatatttatgtttttaatctaaaagcttgatttaattacttaatcttcttttggtttgcttaaagtacttgccattttacaatataaggtattaattatgagcatatgctatcaaaatctaaagtggtaaaacaaaagtatgacaaagttgtttttaaaaaacttaaagtaaaataatttgccgtagaatataaaaaatttcaagttagattatcaagtctcacattaagacactatctcgccacatcctaatatgtttgaagtaaaaaggaaacaaaaattccagaaaagaagcaaacattaagttaaatattataaaaagaaacttacctgacaaattttttcccagatctcatcacagccagctttctcctgaaaactcagagccaaatcatagttctctgcttctgaccaaacaattaatgtatcctgtttaaaaataaatatttccatatcatcacactagaaaagaggtatctacaaagtacaaatagaaatcaagaggactggaaacaacacagcaatgacaaatgccccgatatgagtaatcaatgtatatctgattggcattattagtaatatattggcaatacaatagtagctttgatactaaaaatgactgagcaattttttaaaacaaaaaatattaaaacaggctagtaggctctgactcatgttactcaaataatatttataaaaaggctagccattcttggccaaaactataacaaagacattccaaccatctactttctgttgcttccagaaaatcagctgtcccattcactaaccacctatgtatttatccttccctttgagctggttaaaataagctaatacctgaaaataggttaaggcttaactctatttttgccttttttttttatatatctggaaaagacttcaggatcttaagaaatgtaacaccatggtgaaacaaagctatttgctcttatttacaagtgctaccaacagcacccagttcagtaccttagcttagggtgtagaaaaattagcccaaggtttaggtaagcagtctcctagaatgtcttcaattatatgcctaccaaagggttagttacatttttaggaaaaggttgtcaccccttgtattagaaaccaaggtttggatttaaaataaaacatagacacacacacacacacacacatacacacaaatatacatatatatattttgttgtttcctccttgagacagggtcttgctctgtgaccagactagagtgtaggggtacaatcacgactcactgcagcctcgacctcctaggccccagcaatcctcccacctcagcctcccaagtagctgggactacaggtgcacacaccacgccacactaatttttcgtagagacagggtttcaccattttgcccaggttggtctggaactccaactcctgggctcaagcgatccgcctgcctcgacctcccaaagtgctgggattacaggtgtgagccactgcacccagcctacacacacatttttaaacactaaaaacactatgcaatactaaaatgaacaatcttttaaggatatataataatgaaagtttaacgtggctaaaactttgattttcaaaaaaatacaaactaagtttatacgctaccaaaaatataatctacaaaacaccttatatgtaataacttgttcatttaagtagtacttataaatatcatgacctgacatgaatacaaaactaaaaatcatccccagatccaagacaaagtgttgaaaatgggaacatttcagtactttttggctttaaacagtaaatgaaaaatattatttaattaatccaggcctcagattaatacttcttattttctgtgtaatcaggtaaaaatagctagaaatctgtgttctaccttcttcctggctatgctttttgggagaaatttgctaccagagttagtctaaaattctctcaagtcactcctttgtctaaaatccttcagttctggccaggtgcgaaggctcacacctgtaatcccaacactttgggaggccaaggtaggcagatcacaaggtcaagagatgaagaccatcctggccaacatggtgaaaccccgtctctactaaaaatacaaaaattagctgggcgtggtggcgcgtgcctatagtcccagctactcagtaggctgaggcaaaagaatcgcttgaaccggggaggcagaggctgcagtgagccgagatcaagccattgcactccagcctggcaacagtgcgagactccgtctcaaaaaaaaaaaaaaaaaaaagaaatccttcagtttctctcatcatccacaaaagttttcaaacctttttttaaaaaaaccagaaacccttctacaaacaaaaattcagtaagaacctccatatataaaaaaaagaaataaatagagctactctggtcagtgctggttaaaacaccagggtacccactcaggctccctacattcccaagtcatcttagagccttcctcaaaatagcttcacaaacagtgatctccaaaacatttttgactgcagtttaattcgcttattatatacaaaaatatattagtatattaatacattataaaacacatgctaaaatagaaaagtcttaaaggaagataacataagcaaaatttttaaatgtttgaactgtaatggctccgtatcattagttagtattaagacccaatatacacttaaggcatagtatacccaaacataacagtggatataaatccatatttaaaattatcctttggtagaatgcaatggctcaagtctgtaatcttagcattttgggaggctaaggcaagtggatcacttgaggccaggagtttgagaccagcctgggcaatgcagtgagacttctatatttaattaaaaaaaaaattattggccaggcacagtggctcacacctgtaatcccagcactttgggaggccgaggcgggcggatcacctgaggtgaggagtttgagaccagtatggccaacatggttgaaaccccatctctactaaaaataccagaattagccgggtgtggtagcagccacctgtaatcccaactactcgggaggctgaggcaggagaatcgcttgaacccgggaggtggagatttcagtgagcgagattgcatcattgcactccagcctgggggacaaaagtgagactttgcctcaaaaaaaaaaaaaaaaaaaagtaaaaaaaattatctttttaataaccgaactttttgagaggggtaacttcttgtcagatctattacatcattgtttctgctttgtcccatggttgacagtttacactagcagtaaatgtaaatttaaccattatctagttcatttgtacttatatcatcatcaaccccttttaaggcacctatccattttgtttgagttaggatagtttaagttacaaaatatttgcagttatctccacatataggctacaataattcacaaaagttgggtatgagactatagaaataaaaaaacagtttctcatactacactatcacaacacaaatcactgctgtcaccttcatcaccaagaagtgtgaggatttctccccaccaataatcaatcagttccatattagacaccaggtgggtgttctccaattcaccttcgacactgtttacccggagacactgtcagataccacagttgagggctcagccctacaagactgccccctacttctaatgccaattgcaagcctgcgttgttttacctgtttccaaccaaacggctataaatcaggcttcccatgactccctccttggatttgattaatttgctaaagtagctcacaaaatgcagggaaacagttatatctaccagtttattataatataaaggatattttaaaggatacaaatgaagagaggtacagagcaaggtatggggtaagaggctcaaaggttgcattacctccctgggcacatcatcctccaggaacttccacttagttatctgggagctctccaaacccagtcctaatgggcttttatggaggcttcattaaacaggtataattaagtaaatcactggcgactggtgattaataaaccctcagcccctctccccttctggaggatggcggatggggttcaaagccgcaatcttctaaccatgccttggtccttctggtgactagatctatagatagtactatctacagtcaggtcaatggatattactaacagaatgaaatccaaaaccctttatccagccatccaatgccttttccattttggctacaatcaatgtttggtccaggtaaacattgaaagagaaggtccaggtaaacaacgaaatctgaattaaggtaactgagcaccttttcatcatcactttcttttgctcttcttttttttgatacagagtctcactctgttgcccaggttggaatgcagtggtgcaatcttggctcactgcaacctccacctctgggttcaagtgattctcctgcctcagcctcctgagtagctgggattacaggcgtgtgccaccacaccggattaatttttgtatttttagtagagacagggtttcaccatgttggccaggctggtcttgaacccccgacctcaggtgatctgccagccttgggctcccaaagtgctgggattacaggtgggagccactgcacccagcccctcattcttaactttaaattcttttctctgatcttgtcaaaataccagaaactaaatggggtttatatttagagttcttttccaatgctgaggactgaccctgggaaacagtcaacggttactgatctttcttcttcctgattaccaataactgatccatcacatgccctgtcaattctaccttcaataaagatcacaaaatccatccatctctgtccatctctatcacctcaatccaatccaacattatcttttgcttggactatgcagcaatctcccaatgagtttcccacttattgcttctcttcaattccacagattgatactattaagtattttggatcatgtcatcactttgcataaactcttcaaaagcttactttaaaaatcccaacttggctggatatggaggctcatgcctgtaatcccagcacttttggagcccaaagagggagaattgttaagcgcaggagtttgaaaccagcctgggcatcatagtgagacctcatctctactaaacattaaaaaaattagccaggtatggtggtatgcgcctgcagtcccagctactcagaaggctgaggtgggaggatcgcacctaggaggtcaaggctgcgtgagacttaatcatgccaccgtgcttttggctgggagacagtctcatctcaaaaccaccgccctgcctccaaaaaaattccaaacgaaaagatagtgaccagccagaagcagcactcgatgaggtatttctggatgaatgaatatatgtggtcagatcaacaagactcagtcttgagctctgttcttttctcaatttatagctattacctcaaaggaggttaccttgtagctaaaaattcataattcatctgatttttttttttaaaaggctggagtgcagttggctattcacaggtgtgatcatcacgaactatagcctcaaactcctggtctcaagtgatcctcctgcctcagccccgaaaagctgggactactactggcatgctaggccttttatgattcttaaattagaatctcctgccggaaagtctcaccctatctctattcccagatgttcattttaagaccttttcatgggctgggtgtgacgactcatgtctgtattcccagcactttggaaggccaagataggtgggctgcttgagctcaggagttcaagaccagcctgagcaacatggcataatcccatatctacaaaaaattagccaggcatggtgtgcacacctacagtcccagctactcaggaggctgaggtgggagcctgagcgcaggaagttaaagctgcagtaagccatgatcacgccactgcactccagcctcggcaacaaagcaagactgtgtctcaaaaaaaaaaaaaacaaaaaaaacaaaaaaactctttccatttattttactgtatgtaacttcaaagcccggatggaaaagaaaaaaaaagcaaagcacaaaacagtatacagtatgctaccagttataccaataaaagggaaaaaatacatacaattgtatgcatatttgcttacatatgcatacctccagcaagatatataagaaactggtgatgtcagtggcctctagcaagggaaactgtacggacagaatctggcgtgggaaagagacttcaataaataccttttgaatttttaactgggctaatatattacacactaaaaaaaattttttttaataagcctcaaaccaaaagattaatgtaaacctgcttaacttcccactttctggaaagaaccatcaccttcctggccagactcaaaaacactatcagtgacctttgattccttctctttaatatttaatcatttactaaattttccagcactttctggaaaatatactggagctctgttccttcaagtccatttaccgtggtggaatagactttcattttttgtatctgaattattgcaaaaggtcttgctactcaaagatcttctgctccaccctatccctcctccccaatttattattcatgacattgccacactcatttctttaaacacagtatcactttaggcccctactcaagaacctgtaatgtccccttctgaacctgtgtattatcatatttgggattggtggtaggagggggagaaaccactgctacaaataggcttaataccttttgtagcaagtgtatttcctttcctatcacagttccttccactaccaccaccaagaatgaagtttttcttaatgattccagcttatattaacctcttccttaattttctactgctctaagtctgtggaaaatgcaagtttactttttatattttgtgttggcacatacctgctgtataatctcagtcaagaatcttaccctttctgtacctttgttgcctcatgtgtgaaatgctttcacgggctttcagtgaagactgtggtaaaacactgttataagctatcttattatcattctttatctgtttcatctgttacatcctgcctccaaataaaactgcaatgaggattttcttaaacccaattaacacacaattgtgttaaataggtacacattcttatgactctggttttttttttttttttgagagagtcttcctctatcgcccaggctggagtgcggtagcacagtaacagctcactgaagcactgacctcctgggctcaagcaattctcccacctcagattcccaagcagctgggactacaggtgtgtgtcaccatgcccagctaatttatattttttgcagtgagagtctcagtatgttgcccaggctggtcttgaactcctggactaaagtgatcctcctgcctcagcctcccaaagtgttgagattacaagtgtgagccactgtgcctagtatgactcttgttttttattaagatatgttgcccaggctggggtgcaatggctacgcacaggcacaatcatagcaccctacagcctcaaactcctggccttaagtgatcctccagcctcagcctcccaaggagctgggaccacaagcacacgccaccacacctggctttgactctgcttttgatttagtcagtatcagtgggactgatttgaagtaacttaaaatttctgtcacacctatcaggtatgttatttcatgttgtatcatataatgattctcttctctttccaacatgtttaaatgcttaagtttattgggtaagtacatcttcttccattaacgacttcagtactatgcacagtaaggaagaaagtgatgtgaatcaataatgacttttcaatatccagtcatatgacattcagcttgactcattctaactccttttaggctcacaatttggtacttcatttatgaaagaaaagatgtatcttgagcacacaatttagtagttggctcattttaaaactataatgttaaaagaagaatgttaaacattcccctctgaatttactcaatttttttttttgagacagaaaaatcgctttgtctctccacctggagtgcagtggtacaatcatggcttactacagtctcgacctccgaagctcaaatgatcctcccgtctcacctccagaagtagctggcactatagctgcgcaccaccacacctggataatttttgaattttttttggtagagacagggatcttgctatgttgtgcaggctgttcccgaaatcctcagctcaagggatcctcctgccttggccttccaaagtgctgagattgcaggtgtgagccaccatgcctgccatagtcaacatattttaatacagcaaaatggcctataaacatctcattcacttactcattaagtttttaataaaaaacccgctaatggaaacaaaaaatttaacccattactgcagtcccagctactggagaagctgagatgggaggatcacttgagcctaggagttcaagctcagcctgggcatcatagcaagatcccatctctgaaaacaattttttaaattttaactccactactgaacaacagacttcatgtgatatttggaaattaataactttctagactaatttattgaataacctaaatgatgccttttacaaaggataattctaacaaacatagaaaaatgttactgtatttggaaatctcaatttgtgtaacttcaaataactacaaattaagctgaatacagccactgctcacacctgtaatcccagcaccatggaggtgctgaagcaaaaggatcacttgaggccaggaattcaaatcagcctgggccacacagtgagaccgtctctacaaacacaacaacaacaaagttttgtaataaattttttaaaggtgcaaatttagcctggacaacataacgagaccccatctttacaaattttttaaaaaattagtaaggttggccgggcttggtggctcacacctgtaatcccagcactttggggggccgaggcgggcggatcacgaggtcaggagatcgagaccattctggctaacacggtgaaaccccatctctactaaaaaatacaaaaaaattaactgggcgtggtggcgggcgcctgtagtcccaactacttgggaggctgaggcaggagaatggtgtgaacccgggaggcgaagcttgcagtgagcagaaatcgcaccaccacactgcagcatggacgacagagcgagactccatctcaaaaaaaaaaaaaaaattagtcaagcatggtggctcacatccataatcccatctactcagaaggctgaaattggaggatcgcttgagcccaggaggttgaggctgcagtgagctgtgatcaaaccactgtactccagcctaagggacagaagaagaccctctcaaaaaaattattttcaaaagtgcaaattgaagatttgggtgaaaatatgaaaaaccatgtctattacaaagaaactaagtttaacataacccctaaatggccctatgatttcaattagaaaagtgtactcaatttaaacaaaaataaacaggtaacatcattcacacaagtttttcactcttcttcagtgtttccatattcttctcattaccagagttctcttatacacctgaatgttatgttgccaaaaaaaaaaagcccaacgaaaaaataaactattacaaaaccccaaatagtatattatttaaatgtgattacagaaaacatttccaaatggtgtaatttttttaaataatgcattttttccaatactttatactaagtgtatacaaaaatgctaattatctagaactaattttctagtagagcaacattatacatgaaattacctacatatcctaatgattctaaagtattcacagaatcactatgtatttttaacttatgttgggtgactattttaaatacaaacctactccataatgtgatgtttccaaagtaacaacagctaaaagatcttatatacaatctgagaagaatccattattaaacctaaatttgtagggaactgtttatgacttagttacatttaagaacaaagttcctgataattatattcatgcagataagggaaatatggtaaaaaaaaaaaaaaaattagtatttctttccccacaaagaagcaagcaaacaaaaacaaactaaaagtgatcatctggtaaaaactcggtataaagacagagattaagagctgcctggctgactgagaaattaaatttacttaaatgtctaccttacaatgtctaaggtataggaaacatcttcaggttttcaattcaggacaaatgtttaatttgcttctccatcaaaaaagacacacaatattttctaaacagagaaaaaagctatgaattgaatattgaaaattttaaagtatttcaaataactgattaagaatgtgttatatacataattgttctaacagtaagactttgtaataataagctgcacaacagacagaattttattcctccaactacgaagtacttgtttctgggcatccaaattttcataaaccttgaagtgggcactgacgctgtaaatgtaatcctaaaataatttatcttccttcaaaaatctctgccatcgtgactttacataccacacacaaaaaagaatacctggaaataattcaaatgtataacaacaagtgtatgtcatacataagaatactatacagagtttaaaaagaaaactagatctacattgttaacatgaacgaatattcaaaatgaatgtgtgaaaaatgcaagctgcagaatacatgtaagagtatgacatccactgtgtaaagtttaaaaacacacaacagactacatattatttatggatacatacatatgcagaaaaggtataaaagcatgtacacaaagaatacacatcaacttcagaatagtggttacctatgtaggggatggagaatgtaaacaacgggatggatacaaacaagctttaactctatccataatgttcaatattacaaaaatatttgaaacaaatatggcgtaacattaacattgttaaatctggtggtgttacagtagacaccgattattctctgtacttttcaattttaatatatttcataataaaaacaaaaacattcacagaataaaaaagattgaatcactgctaccattttcagattaatcaggcgtgctaaaatacaatacacattttctttcccaaataagacaatattaacagaagatgttacatacttggtaatgtacatttttataaagtatccattgattactatattaaaaatacacaacaattaaagagcaggatttaatgcttctacttcaaaacctctacctttacttgagtcaaaggatttaatttcacaccacaaacaggctttccttgctttaagagtatccctttgaattttgttctatgtcatttcctttaaacgtgactcagaataaaaggtttcatgtacaaggtatagaagagacttggctaactacagttaaataatactaataaatacatcttagaataaaccgacagtggctcaatccaaaaatgataattatcaccagtacaaaaactttttttcagtctgaaacttttaacctgcaagagaaatacacatgatctttgtttaccaaacatgtttttttcttgtcaggaaagctttcccacctttgtcagattaatacttccttgatcacagatgaagtctttcaaattaaagataaacaactacttgcctgttgtttctgatatgcagtatttggatttatctttgattccaagagtagtgatcctgaaagataaaaaataatacatcataagtctcaaatgataaaaccctgaataaaaattagaatacacattaaagccgggcgcagtggctcacgtctgtaatcctagcactttgggaggcgggcagatcacgaggtcaagagatccagaccattccagccaacatggtgaaaccgtctctactaaaaatacaaaaattagctgggcgtggtggcgcatgcctgtagtcccaggtacacgggagggtggggcaggagaatcgcttgagagagagggagaggaggcagaggttgcagtagcccagatcgcgccattgaactccagcctggcaacagagcaagactctgtctccaaaaaaaaaaaaaaaaaaaaaaaaatacacatttaaaccccgccccccgcccccgcaaacttttcaagtctttttaccgagttggacatcttaataaaatgtattcgaattcacattttctctccaaatctaggcttcacatttaatctaaaatatttcaccctattcccatacacccttaaaggaaaaattaatctaaaaccaacaatcaaaccaaggaatgaggagactagatgactattaaaattttattgaaataaaaattttaaggtctaaatgaccacttcaagccattcgttttaacaaaagttgttttattgcattcccagtttaacaaataatgcaaattacaaaacaaaaacatcatgacagggattaaatacttagtatagaaattacagtgctgcatttatcctttcctcattaagaacaaaagaacaccttctgtagaagtgatgactatttaaaataaaagggaacaagcaagaatacaaaatatgtcaagactaaacctaagattatttttctaactgcctatatcagttgttcaaatcaagtccagattatactataaaaggcattttaattacggctctacattttgtaatttaaaatacttcacatgactacaataaaccaaagaacacagcagtttacaacctgctttggtgtcccaacttgcttagattgtaaggcattcactttctcatagcgccttctacaaaggcagcccgaagaaatgcagactacagatgtatgtgcttgtgtgtccatgtatcgtggcaacagtcagcaatacagccaggaaaacgtgcctttcggttttccccagcacctgtcgactgtggcacctggggcccgttggtacaattttttttttttaaaaacactcggaaagaaaagtttccctaaaccgtttgtactagacgtataatggataagtaaataaagggggaggaaggtgtcagctcctagggcgacatcagtacctagtctctcactacttcctcccttctctctcacactctcccctcttcaaaagaggagggactggaaaggaaggagtccaatccttaagagagatgggagaaggacagagagtctcggtctccgaggataagtccagtcaaaagtacagtactttgtttttgccgtacacaagagccagttcagaaccaacgcgctgtcccgaaggagtagcaacggtaacgggcccagggccctaaacccaagctgtgccccaaccagaggcactatcccctattctacagttccgataaccttaccgtcggactctgcccgaaccagcagcgacatccccttgagctcctccacgtaagtggaggagacgtgcccggtgcctcggtcgtcccattgccggtcttcgttcagggtatagaccttcactcgccgccgcgtatccgacatggtggctgctgtctccaccgctctagccgccgcctcctcgcttacctcgtccgcgctcctcactcttaggagacggtaaaggcagtagtggcggtggcggcggcggcggcttcggagaggcccgaattcaccatggctccaaaggttcagccgcgagaaggggtgacaagagccactgaggcctctccgcccggagccccgttacctctcacttcacccgcgcatacacccactctcccgtctctttgccccccagggctcgcttgctctcccgccgccgcggtaactactacagatccgccatcttgtaacccgactctctctgcctttctcttcctcctccagcaggctcgcacgggctgtcctagcaggggc

SEQ ID NO: 343 - DNA, 69283 bp, Homo sapiens; identical to SEQ ID NO: 342

SEQ ID NO: 344 - DNA, 86463 bp, Homo sapiens
agctgctacgccacagcccagcggcggccattcgcggaaaaagaggcagagcctgtgccagctacagcctcctccgagccaccgcgggcgggcgggaccggcctctcctcccgcctcgcccccacccccacccacctctatcccagtgtctccgtctgagggtttgtcctgttaatgcgggatgagcggtacgtattctccacccccctcagtctccttcgccgcctccctctctccctccctccccagaccctgctcggttctcccccctcccccggggccgctgagatgctttaaggggaggaggagagggcgggagggaatcggggagggaaggagggttgtgttttgtcttaatgtctgagagagaacaacctccttctgggtgttgctctggagccgatgggtcgggtttcaaaccacgttttgtgatatccccctcctcccttccctccttctcccccaccccctgccggtgtgcgtggatcgcgggtttatggagattaatgttcggggggaggggggagaagaggagaggaagaagacgaataataataatcctaataacctgttgtcgtgtgtgtgtggtgggggggtttgttgcagatcagaagaaggaggaggaggaggaggcggcagcggcagcggcgatggctacagaaggagggaaaacctctgagccagagaataacaataaaaaacccaaaacctcaggctcccaggtaaaagcaaacaaattaaaaaaattcatcacgacacattaggagagagagggagttatgccctttgaatgtccagaagtaacagaataaaatgtttatccactcaaagcatctttctgagagtgtggaacttaaattgtaaattcatcaagttttcacctctttgagggtataacgctgtttaaaattacatcaggaattcagactataagaaaacggtgtgtgtgttcccaagggcattttgagtttaggaacataacactttacaaagttgtaaagaaatttccttttatttaaacttgatattataggacttgcttccttattcatatagttcttatctacttttgttcgtatttctttttgatttctgctgcttcctaaattgttatgtagagctgtcaaaataagtaaccccctggcaactactggcctccactaaatccgcccactttttttcccccccccctctcctttaccgtcccattttgggtaggactctcagccctctcctctggctttactggcagctacttgcagcaaaatagggactcctggtgaaaatcaagcaactggacaacaacaaattattatagatccaagtcaaggattggtgcaacttcaaaatcaaccacaacagctagaactggtaacaacgcaacttgctggaaacgcttggcaacttgttgcctccactcctcctgcttcaaaagagaataacgtttctcaaccagcctctagttcgtctagttcttccagcagtaataacgggagtgcatctcctacaaaaactaaatcaggtaattcttccacccctggtcaatttcaagtcatacaagtacaaaatccaagtggtagtgtacagtaccaagtaattccacaacttcagacagtggaaggtcaacaaattcaaatcaatccaactagtagttcatctctacaggatttgcagggtcaaattcagctcatttctgcaggtaataatcaagctatactcacagctgctaacaggacagcttctgggaatattcttgctcaaaacctggcaaatcagacagttccggtccaaattagacctggtgtttcaataccactgcagttacagactcttcctggtactcaggctcaagttgtaacaaccctaccaattaacattggaggagtgactctagctttgccagtgataaacaacgtggctgccggaggagggactgggcaggttggccagcctgctgctactgctgatagtgggacttccaatgggaatcaattagtttccacacccaccaacaccactacttctgccagtactatgccagaatctccctcctcctccactacctgcacaaccactgcttcaacgtctttgacaagcagtgacacattagtgagctcagcagatactggccagtatgcaagcacatcagccagtagttctgaacgcaccattgaagaatctcaaacacctgctgctactgagtctgaagcccagagctccagtcagcttcagcctaatggaatgcagaatgcacaggatcaatcaaattctcttcagcaggtgcaaattgtaggccaacctatcttacagcagatccagatccaacagcctcagcaacagatcattcaggctattccaccacagtcgtttcaactccagtcagggcagacgattcagaccatccagcagcagcctttacagaatgttcaacttcaagcagtaaatccgactcaggtgcttatcagggctccaactttaacaccttcagggcaaatcagttggcaaactgtacaggttcagaatattcagagtctttcaaatttgcaagttcagaatgctgggttatcccaacaattaaccatcaccccagtgtcttcaagtggtggcacaactcttgctcagattgctcctgtggctgttgctggtgccccaataactttgaatactgcccagcttgcatcagtgcctaaccttcagacagtgagcgttgccaacctgggtgctgcaggtgttcaagtgcagggagttcccgttacaatcactagtgttgcaggtaagttctgacatctttttaagtaccttttaaatagtttttcataacaattattgcttttctctcctaattctaaggtttgacgtagacctctgaagtaaacacacaatcataaggaaccagaaatagcaatattatactaacaaacatagctctgtagtaatcaatgtgacatgttcacttttgtagattttataataatgtgttaaatttgttagttttttaaaaagtattgttttatgggacagagctttctgattagaatcataattgccttctgtaatttagtggtcttatttgagtacattccagctcttcagaaagaaccctagtcgaaatgatatttatctcttctttgagggaaagtagttttaaactgaattggtatatataattgtgagtctgttgaacttttaattctgtggtgtaataaggctaacttttttttagtggaagttatttctcaagcttcagcatcttgtcgcccatgcttttgtgttttattacactggttttaaactagatactgatgcagttgagagataattttaagttgtaaattgtttggttaacttttatgcctacttttatgctactatcaggatttgaatgaataatccttcatttataaaattatatttaattaaatcatggtcattgtgtgatttgtagatgtttaatgtaaggttggtggaaagcaatgaaaaatgttgacagtaaaatgtcactaatttgaattaattgtggtaaagttatttttaaacctattgtaaaagcagttgttatttgttatgcatataaatagctccttctgaagtacttgggaagtagttttaatcttttttggaccagtcttattgtacctaataacttttgttttctagtaattaaacccttttcattgattctgatttgatgaaaacctcgttgtgttttagtgcctttgatacttccagaccttgttagttaaatatttctattttgataatgtgggataaataagtttatcacttttgaatgatctttcttgaaacaagttgcagaaaaattacgctagggttcttcttttatggttaatacctgaagtaggcatatatatgtaaaattgtaaattgccagataaagccttctgattcaggagaaccgagattatattttttatctagataccagtgcttctaggccagcgctatccagcagaactgtctgtgatgttggaaatgtttatgttttctatctacctagctacatgtggctgttaagcagttaaatgtgtgtggggcaactgaggaactgaattttaaattttatttaattttaatttaagtagccacatgtggctagtggcaaggacagtcatctagttagtgtttccattgcggtactttttctcctaaaactattacagcgtaattacataaatgtttctctggattacaatccttaacttgctttatttctactcctttgctaaaaactttgacaataattgtagtatttcagaaaagtgtttttggtgggttgaatgacagtttgcattgtcaaagcagaagttacttcacttccatttcatcttgcttattaagcattagtgagttgtgattaattaagagaattaacttataatttaggttagaagtaatcaatttttctgctctctagttgataacttttgcaatccagaggtttttcccttagccattgtgagggtaaagaaatgttttggccaaccaaacttagattaacttgaatggtgcattaaaataaacacaggatccagtttttggtactgtaagttttgaattgtgggggtcaagggatttgcctttcaaacaaactttccaggtgattgtaaaactcactgaagtggctgggtgtggtggctcatccctgtaatcccaacactttgggaggccagggtgggaggattgcttgagcccactagttcaagaccagcctgggcaacatagggagaccccgtctctacaaaaaatttaaaaaaattagctgggtgtggtggcacacctgtggtctcagcgtcttgggaggctgaagtaggaggatcgcttgtacccgggggatccaggctgcggtgagctgtgattgcctcactgcactcccacctgagtgacagagcgagaccctctctcaaacaaacaaactcactgaagtttgagaatcaagtgtctggtcatcagcagtgaaccagaagacagaatatggaagcaagtgggggtgttgagctagttcgtttgtgcctcagagaacagattttggtggcaactacaactttttagtttttatttcacaagtgtgtattgagatggctactgtatgctgaacactgccaataggtgtggttattccttcattttcagggataattttttcacttaaaggatttacatgatttgggtggttctgttttaagtagaggaggaaatttgaactctacatagttggattcttttccccctgaaaccaaagatttaaaattttgtcgatgttgtttatgttctaataaatatgctcaatccttttaaaaagacagcagtctgacaaagaccagaagtgtaccttgcttgatgtctgcaagtcaatacagttaatctaggcctagtttgcagattttaccccattgcctagcttagtaggtgcttgacaaatgctctttgaactaaggtataaaagatgatggagaaaatagcactttgtaattaggagtaatgccttggaatggttttaatgaagctaatgaaacaactttgttttcattaatttcttttggctttgcatttgtaagacactaagagtgggccgggtgcagtggcacacgcctgtaatcccagtactttgggaggtcaaggcaggtggatcacctgaggttgggagttcgacaccagcctgaccaacatggagaaaccctgtctctactaaaaatacagaattagctgggcgtggtggcacatgcccgtagtcccagctactcaggaggctgaggcaggagaatcacttgaacccaggaggtggaggttgttgcagtgagccgagatcgcgccattgcacttcagcctgggcaacaagaacgaaactccatctcaaaaaaaaaagaaagaaaaaaaagacacaaagagtgagacaccaggaacttttctgtcttgacaagggggagaaggagcaataagtacccatatcgcccttttataaatgagccctgaaagttcagatcttttactttgtgtccccattcatctgtaagtactttcttggtcggttcatgttgttccccaggagaatggtattgtttaatttgtggggaaaattttgctcgaaatttttatgagaagccttgaaaaattagtagctttgacggaatgtaattgctagctcaaggacaatgagctaaaactctccaccatccactattctcattttactcttcaggagattaagggaagtctagatgacatgaacagaaaaaagtaaaatcatacaaggtaaatctaatgaaaccagtacttgaagctggggagcttcatacttcgttttatgaaatgagaatgttagcaacaacctagggggatcctcttcccattaacaacgtgttcagtataatgtgtttctgtgctttggtctcagctgtaaatcctgaccttcatgctaagcattagttagaattgtagtaggaactaaatatgtgtatgctctgcatactttttgttttgttattgggattctaaatttaacttaaaatttttttacttttacttttaaaaaaaatagatttagggggtacaagtgcggttgtgttacatggatatattgcatagtggagaagtctgggattttagtgtacccatcaccgaaatagtgaaccttgtacccaacaggtatttttttccaccctcaccctgccctccaccttttgtagtccgcagtgtctgttattccacctgtatgtccatgtgtaatcattttttttttttttttagctcccacttgtaagtgtgaacgtgctgagtttgacttcaaaggaaaagcagaaaccttactttaagctcaaagacaactaattgtacctctggcttaagctcctttattttaactaagtgaggagagttaactacctgttttcacaatgtcttctactagtcaaagagccctaaataaagtgaatttcaggtgttacatttccttaaagactttagagctatgtaggaacaattgatagctaaatctgtaattaacttggagtggtccacaatgtgacttatttttggcagtaatcatcatatgtagtaacagagatcatactgtaggccttttgattgatgaatgaatatttctttgtcaattttagtggaaattaacaatattatgctggttctcccacagaggaagttcagacttaataataagatactgctgacccttcaagaacttgactctcttacctaatttctttacttctccaaggaattaaaatatgaaacctggggatatagtatgaaaccagaaatgggaggaccaattcttcattattggtaaaaataggtaccaaagaaaataattaaaatttatatttaattttaaaactgaattcaatccagtaaaattaacttcttacactgatctttttttccagagctactaaaggtggaaaattggcttgaggtttaatgcaaatatggctttcctttgccatatatgttttattaatttggatttccctaatgggcatctgtatatatacatactcatgtactcctgtgtttggctagtcttttttcagaggagtcagatttactccagtaatcttatttctttaaaatcttctaatactgtttgttatagattggaattcattattagaaacttaaatcttgtattcaatacgaatgacttaggttctgaactaccaagctggctttacctattgaatgattttttcatggaagatgaaaagtactcaaagtagagccacattaattttgtaaaagggcattttttttttttttaagaaggacttcaggatagattagcaaaggaaaatagagttttttgtttgtttgcatttgagatggagtctcgttctgtcgcccaggctggagtgcagtggcacgatatctgttccaacctccacctcctgggttcaagtgattctccggcctcagctccccaagtagcagggactacaggcacatgtcaccacgcctggctaatttttgtatttttagtagaggtggagttttgccatgttggccaggctggtctcgaactcttgacctcaggtgatctccccacctcagcctcccaaagtgctgggattacaggcatgaggcactgtgtctggctgaaaatagagttttaatcatctgcttttcaaattctgaatcggaatatataatgagtaatacttagggaatattggggcaggcatgaaagcaggttgaggatattggggcaggcatgaaagcactcacagctctaaatttacttaatcaagaaggaagatagggaatggtgctacgcatagatcttgtagaaataacagacttacaaaatgatagaattgtaggtggaaagaatcttggagattatggctcagcagttgtaaccttttgatactgctgctaaagtctatttataaaggcattttgtgtttttactgtttgaagtgaaagcagaaatatgggtcgaagattctgcactgctacattaagtcaatccttacacagtaaggattgacagtaacgggggaacctggcctaatatcagagtgtacacatatatgtgctcttctgtacttttctgatgcggatttgagttaagattggctgttaagattggatgttcataatgcttgtcattttgctacctagtgaaggagcaaattgtggcaaaggaaacctgttgaaccacaaattgcttatttaagtgtgtggtgagatgagggcttaatgaaattgtagttactaaggtaacttaaaaataaatgagcctctttctcccaccttctttccttagccctattttagaaatgaagaaattgaagcccagaaaggttaaatgaccctcttatatttgatggcaaagtgagggctagaatcttgacttctcctccagttgtctttctactgcatttttgggtttgctttttggaagtcaagatgataaaaatggatgttatcctagggtcagaaggaactttcagattcagtttcaggctagtatcaataacttaaaatttatgctgcatggtaaaaagtgtcagaagatttggcatgaataacacctcaattttttaaaacattcttaacttcagacaaatgagcttgataaccgtccttagcaaagtccttgaatgaattattgagtagttggctcttgagcattttaaaaaagaaccgaggaatcactgggagccactatgggttcactaagaaactaggttcatatcttctttctttaggatttccagatgagtatccaaaggaaataatgttaacataatttatcttgattttagtattgatagttgtggcctctttgaaggctcatagctggttgcacaattgaatgaaaagtggtaattattattcacctccttacgaggtctcacactatggcatggggttctaattttgatgtagtttgacatttttttttcaaataccaggttgaaggatggctgaatttactgaattcaaatatgagacaaagctgggaggtggtgcttatatgatagaactgagattcagagtgatcttaataggctgaaatggtgggccagaattagtaagatacatttaacaggtaagatcctctccttaagatggagggaattacatacctacaaggtaaaaaacctggcttggcaggaggacctgtgaaaatgatttgggatgtattggcttaaaatgaactgagagtagaataaagcttctgtaccttgtgcttgtgagatacttctgcaatattgtgcgcagtaccgggtggcacattttaaatgggacattgacagactcgcaaatgtatcaagaaggattcccagaatgaagaatgtggaaaacatttcgtactagcaataatcaaagaacggagttttatctttaaaagaaaacaagaaattgtgacagctgtctttagatatatgaggggctttttttttttttctaacgtagttctataattttgtttggccctggaaaaacatatgtatatgcacacacaaagacagactagagttacacaacagtggaatggtttgtttcattaagtagtgatcattcattaaagattggatgttcatcggtcaaagattttgtagactgcagaagaatttcttgtaccatatagaaaatttgcttaaactataaactctgagtcttcttctaattctaaaatttaaggtctatgaaattagaatatatattttatttcgttctgggtacttccatccagcacatggccagagttctctgtaagtcttaaacttacatgattaagtctttagggatttttgtgagggagattgtgggtgatatttaccattttttttcatagaggctgtatgagggtgaattctattaagcaataaatgtagcactgtaattcataaattaatatatttctgttcattcttaaatttactgtgtacttaggtgctatttttctatgtcgtttcctcttttatttggtgaataccaaaacgttagtattttaaacatatgctttagttctgacactgaatttgtagttacgatatgttatctcggtatagtagtctcctcttatctgtgggttctgttacctgtggtcaactatggtccaaaaatgttaaatggaatattctagaaaaaaacaatttacaagttttaaattacatgcctttctgagtagtgtggtgaaatctcagtctgtccagggtgaatgggaatcttctctttgtccagttataccctctgtatatgctaacaagtcacttagtaaccttctcaactgctgtggtatcacagtgtgttcaagtatttttactttacatatttatggcctgaaagtgcaaaagtagtaatgctggcaatttggatatatccaagataagccaaatatatgccaaagagaagttgttatctcatactttgtgtaatttataaattaaactttatcacaggtatgtatgtatgtatgtatgaaaaaacaatatgtatagggttcaggccatggtttcagggatccagtgggggtcttggaacatattcccccctctgataaggggggactgctctagctctttaaccatagttgtgtttctgatactgtcactttagtgtgaacaatgtgattactttttcttgagtggaaattagagaacaattggaaaatctaggatcctaaaagagcccaaattgtgggaagcactcacagctgtaaatttgtcagttttccctacagagcaagcaaatctgtatgcctttttttttaagttatttatgctgatcttttatttgtataaatttgttgggtgcaagtacaattttgttacatcgatatgttgtatagtggcgaaggcagggcttttagtgtgtgcatcactgcaggaatgtacactgtacccattaagtaatttctcattccctactcccctcacaccctcctttcttttctttcctttttttttttttccatgaacagtcctgctgcagtagtccctttcttcatggctcagaatatctggtacaaaggtgttttttgaaaatgtttgaggccaagtgcaatggctcatcctggaatctcagtactttggaaggctgagggaggaggatcacgtgagcccaggagcttgagaccagcctgggcaacatagtgagactgtacctctacgaaaaaaggaaaaagtaaaaaatcagctggatgtggtggcccatgtttgtagtcccagccactcaggtggctgaggcaggaggattgcttgaactcaagagttctgtttaaggttatagtaagctatgattgtcactgcactccagtctgggtgagagagtgagaccttgtctcttaaaaatatgtctctctgtatgtaaaatgtttaagacgcaagaatctttcgaatagaaaaagtgataattcagatttatgaagcttctcttttcctcagggatgataataaagttaaggaggtaagaaatacctgtgcttgatcagaggtatggttcttatagtaggtttattattcgtgcagaccacatgtacttagaggcttcgtagagcacaacactaagaattaaaactcacatttttgcttgggtactccccgcccccaccaattagttgtaccactctgggcaaacatcataattgtagttccattcctttttttcatttgcaaaatagtgatattagttcctaccttctttacctcatagagtctcaaagattaggtaagttaatatgtatgaaaaggctttgaataatgtaaagaaaactgtatgcaggaggtggtaacttggtgacatctctacgtagtgacacccactagaagaatgtgaagtagtaaagtgggggaatgagatattttaggtatggatattagcttgagttatatgtcagaggtaaacgagaaatttgtataagaggaatttcagaaagctttggtaaagtgcaagcaagggtgaggtgaggtgtatggagagaggtgtattaacaggtggaaaagaagtggtgtggccaggcgtggtggttcacacctgtaatcccagcactttgggaggccgaggcaggcagatcacttgagctcaggagtttgagaccagcttgggaaacatggtgaaacctgtctctactaaaaatacaaaaattagctgggcatagtggtgcatgcctgtagtcccatctactctgggaggccgaggtgggagaattgcatgagcctgaaagtcgaaggttgcagtgagctgagatcgtgccactgcacttcagtctgggcaacagaacgggaccctgtctcaaaacaacaacaacaacaacaacaacaacaacaacaacagcagcaaacaggtggtgtatttcagtatagtaagaactaaatgtctgctgtctgattaacccttgttaggttctgaagatactaactaaacctgtcttaaaatgatgcttgtgttcaggagaaagatttacatacatgaaaccattatatggcagctgcaactacatatgagagtttatacgtaagtactgggttttgaggcatggaaaacaagtgtgagagctcagaagtcagtgaggttagtggggagtaaacaagaaaggctttttctggtggagataggacttgaaataggccttaaagattggtttggaaagtggacatttgagactttgggggtgacaggtgaagagtgaggatggcttgagtcaagctgctaaacttggaatgagcttgatggggaccaaagattggaaaagcacaaagctatcatgtggaagcttttaactaacacagggaatgatgggttctcttctgtgtgcttcctagaggcttagtggtctcacagagtagctcagggtttgccaaccaaacagccttccactcctgcatcagccacacaagtgtgttttttgaaccatttcctaacattttgtttcaagaagagattgtgccaaaataataataataaataaatttgaaaaacttgaatctagtggattggagatattgagtaaaaatatttgcaatgcaaatgatacttatgagagtgtttctttgtagataaaagtgtagaaaagttagaaagcaggagctcagataaaaggatgttgttgcagtaatttagttatgaattcacagtggtccctagaaaggctgtggtagtgaagtaaatggttactaaatataaaaaacagcttgttgaacttttctaggacctacactggtgacgtgaaagacatggtaagggattaggtaaaaacatcaggttggtttgttcttttcccctgctctgtatcaagcatggtaataggcattgagaaactaaagatgaagtgagacatgttttctgccctcataggatatattatctgttgtgggagacacactgtacttctctgcttctaggacatgctttttacattttatttttatttcattttatgtgtgtgtgtgtttgtgtgtgtgtgtgtgtgtgtgtgtgtgtgtattttttttttttttttttgaaacggagtcttgttctgtcacccaggctggagtgcagtgccacaatctcggctcgctgcagcctctgcctcccaggttcaagtgattctcctccctcagcctcccaagtagctgagattacaggcacccgccaccacgcccagccaatttttgtatttttagcagagaggggagtttcgccatgttggccaggctggtcttgaactcctgacctcaggtgatccacccgcctcagccttcctaaatgctgggattacaggcgtaagccaccacgcctgggcccattttaaatctataaaattaaaacacaccttgtaatcaaaggcatgtcatagtttaattagcagaacttttttctttcttatgatcatttgcatcttagactcaatagtacatgatagatatcatctaatatctatatatgtcatacatatagctaattaaattactttgtggtgtttggtttatacaagctgtgaatgaagtgttaatagaatcccagaagaaggaagaactagttctgcttgtagggttctgggaatgttttcatggaaagggtgataactggagctgagactcaaaggatgactaaaaagtttaccatatcagaaggaagaaaagggccacttcaggttatgttggatttcacatgcaatttttgaaattcaagtagttttttgttttgttttgtttttgagacggagtcccactctgtcgcctaggctagagtgcagtggcacgatcttggctcactgcagcctctgccttccgggttcaagtgattctcctgcctcagcctcctgagtagctgagattacaggcgcctgccatcacacccagctaatttttctatttttagtagagatggggtttcaccaggttggccaggctgttcttgaactcctgacctcaggtgatccacccaccttggcctcccaaagtgctgggattacaggtttaagccaccatgcctggctcaattagtattttgtaaacattacaaaattgagaattagctcaaggagtgttcatataaaagttgaattgtgagcctcatgtgagtagagtctgtgttatatatgtaagtatgtgtattaatttataattctattttttctcacaccttgatgagcattgcttagtatctgtcattctgatactgaaccagaagaaaggacacaggtggagaactttgatttcataggagaatgggatggacagatccttggaatagactcaagatatatattaaaggagtgagagagtttacgatcgtaaaaggaaaagtgatgagtaaacggaaataaagggaatttaaatctgattgcttcatatgttttggtagacagttgaaggtaagaatcttaccagttaggggatactttgagaagaaattgaaggtatgtaaaatttccaggttgattctgtccctctgatattattatgtagatgccttttaatgtggccagtcagaaggggtttagtacagttctgtaataatgagtcaagtcaccatagctttttgttcacagaagcggagctgcttttgcacaggcgtataggaacgagatagtgatctgtgctttggtaagtgggtatctgtgcctggtgtggggctgggaaaggggtggaaaatccttgctctggtctagttggggatatctatgccagggagttgaaggagaagagagaagaggaagagactaggtgaatatgatgacaagtactaacgggatttatataagagaaagaaatacttaaaagtggtttgtgaattctgcaggtttttccaaatatttaaatctacatatgaaccaggttgagacaaatctttgacagatgtcataaatactacaaactataacatgcttgttgaagcaaactttattatttctgattttgttagtataggtttttaaagttaaagcgtatttttattttcagaatttctctcacctgttgttgttattggtaggttgtcactgcctttactgattttaattatagggcaagtaaatggttttaatatccccttgttagactttcatctattacctgtactccctactggcagactgcatccatgaattcagtcagcaagtaaatactcagcatctgtattgtgcggcttgatatgttccttagatgattgaataacatgggactgaactcctgcttccataatattccagtggggagagaaattatgcagttttctttaatgaatgaaacaagaagtaaaagggtacttctttgaaccttatgtttgttttatattttggctgacatttactgcacgtttatagtataccagataatgcatgcagcacttgatctattaacttatttaatcttcagaatacactgtaaggtaagtattgctgacatctctcctttcaggtataaaaactgaggcctatagaggttaaataatttgctcatggccacatagtgaatgatggaaccagagtctaaacgtacttgtactattaccacttactgccctgaattgtgtactctctgtatactgtagtgtttgttttctgtgatcatttatggactcagtttattgtttgtctcttatatgccactgtttaagcactttatgtgtattaactgtttatttttcacaatcctatgaagaaggtggtggtggtgacctcaaattatagaacaggaaaccaaggctatcagaggttaatttacttggccaagatcatatagccagtaagttagggtgctagtaagtaaaaattctttataaaacaagtccgggtgaataggactgtaatctccctttacagctaaccactactactttaagtattttattgtaattactgtaatatgctcaataagaaacagattcctagatctttagctgagtgctccactccttgtgttcttttgggggtttgaggtacatatgccacaaagggaattagaaagaaagtttttattactttgatggactgtgttgattgggaatttgaggctagtaataacatctccctgactaaatatttgtgtatcacaaactaattttgaataaatgaaaaaacacagattctaagaatataagcgcaataagagtatgtattcttttttccctttcttttattttttgaagaaaagggcccaaaagagggagtcttgtattttgttttcattaatagttgtaaaaccccaaaaagaatataccttgtaaggcttaaatttcatgacttgcttcttgatgaggatgtgagatgtcattagataggaatttatgcccattttctgaaggaaataacattaagaaaacccagagaccctaagaattagtatatgtgtagaatttatgttctttagctaatcctgcatgtaatttttatgtagcattagcttagttgacagggttggtcctgcaactttattgttttctgctggataaataatatttagtatctgccattgtatacatcgcatattgttctaggtgctggggaaacaaaacagacatgttctttattcatggagactatactttgttctgggtgagttttgttttatcttgatcttagattattgctgtttttagtagatgagaaaatcaaggcttagaaagtttaaataatttgcctaaggttacagaattgatacatggcgggtgttgagaaaagaacccagagtttgtgtggcttcaaaattttttctgctgtttcatcacaaatccttgaggccaaggaaatcatggtttccctgaaaagttttaaaaggattttctctctttttttagtaacaagctaccaaagagaattgaagaccaatttacattttgcaagagtttgatacatcagagtgcattcacaatatacgaaaatagaatagttaatttagtccgtatttccaaaacatatgatcgagttcattttgtgtatcttatgtgtatgtgtgtgtgtgtgtgtgtgtgtgtgtgtgtgtgtgtgtgtgcacgcatatgtaggtagatatatatgtgtgtgtgtgtgtgtggtgtgtgcatacttagtgtatatgtttactcattataaacacattcagggaaaacttaaagggattatattctatacctattcatcaccttccttgttctcccgcaccttcactataattaaggataccagctcatatggggatatttctaaaaattagcccacctcttcatactcctatccttaccctaagccacaaagaaaacgtgattgttgaaatcaaagtacttagacagttttcagcactttaaaaatgattctttggcagctgtctgaactggtagtggtaactatgtataattttcaaactggaaagcaaacatgtttcattccataagtggtttgtgatgagcagagtgtaactatgacatatttaaaaaaaaaaagagctctgtgctaggtagcagtttgtctctgccattaaacaattttgtaacctttgggaatggaggtcttggtttttttcttttgtacagtgaatgtatgtgtgtgtagtgtgtttcgtaaaatgaaatacttgaggtactttcatttagtgttaggattctataggtactttcatttagtgttagaattctataaagcacaaatatgtaggtactaaatcagcttaattttatttcactgagccagtgggaaagctcaggaaaaatactatttactaatattgctagttttaaaatcaaattgatttctttttaaactgtgaatggagcatgttcatatacgggtttgtttgttttgacaaattcttttttttttttctttccccaagcctgggttccaaaaaatgttttgacagattcttgaagccaaatctaatattgactctaacgctattctccattaaagaagtttagtctctaggtttaagtcatttttaggattcacagaatgttttagaatatggttcattcactagcgcccttgtgactagccacatgtccagccttcagcaacagcaaagatgggggccaggtccctaaacccttgggcatgtagattgccatctgggacctcatctgactattcagaatgcccttgccagcggatacagaccttgaagatgcctagttagaaaccagctgccctttaaagccatagtgtgtgattgcttaggcctgagattctctagcttacaagcagtataaccctgtaatatagagctcttctgttcaatattacctcctaacctttccaaaacccaatactttataccaaagattttaccatagtccttgctgccttcttgccatctcactttgggtaaccatcctaacctacctaaccattttattaccttagcaccttatgacttggacttctggttagtgtgccccagggacagtagttgtaaaatctagaaatttagtagaagagttagatggatctttgtatttcagtttcaaaggagacaactttctaatattctagaaggtgaagaatatcataactgatttatagtccaagaggtctcattagaacagtggaaactatttgctggagctgttgaattttctgttagagtattaaggcagggagaataccattttcagcctcacaactactggcatgcatagagtttaatgttggattctagctgctgtcttgggaagaaagtactttttttgagacagagtcttgctctgtggtccaggctggaatgcagtggcgtgatctcagctcactgcaacctccacctcccaggttcaagcgattctcttgtgtcagcctcccaagtagctgggactgcaggcatgtgctaccacacccggctaatttttgtattgttactagagatggggtttcaccatcttggctagcctgggcttgaattcctgacctcaagtgatcctctcgcttcggcctcccaaagtgctgggattacaggcatgaaccactgtgcctggcctggaagaaagtacttctttacataataggattgcattaaagtcaaaggatgcatttacagaatgaccccccgtgaagaattttttgaattaaataacaataaaatacaggaatttaaaatataatatttgcttggatttcattttgtaggttaatctaaattttttgaaccactttaacaaatatttagttacccatgattactgagaaataaaagagctgttttggaagtaatgtcttagaaagtttagttgaggtctagctcactactattatacagaaattttttaaaaaagaaaattgtgctttctagtaccactggcaagtactcttagtaaagaatttgtgtttcattaattattaagaatcctactgttttttaatgtaatattaggccattcttattaaagatcattgagcagtcaatcctcagtggttaggaatagctatttgtttctacatgataattatatagatttaacttaaaatgaaggtgacattgtggtgctggtgaaaatagaaatggacaagaatgagacgtgggttcaattccctgttcttttagttactgtctgtgatgtgggaatctcctttagctttcacaagcctcagtaataaacacctataaaatgaagatagcctgcctactagacaggatttttctgaggattaaatggagtaatatgtgtgacaatgtattgtaaatgccagagtactgataggtgtaaagtattattacatcgttttgtttacctttactcttttcttctaaattattatgtgtgtatgtttaacattttacagtcttattttctattacattgtcgtttttacatctgtaacatataacaatgctggtatatagtgcatgttcagtaaatagccaatggaaatgagactcctctattacttggcttgattgagtatattaacccttttattttatgtattatgctttgacatctgaggtctgctgactttggaaggactacctcttccggggttaaccatttcctaaagacaattctcctgcaaatgcttttttcaaaacacacaccaaccaatccagagcctgcatcctaaccacctcctatattaggttctcatactttagaccacctgctctaatcaccccccagggcgaggtaccaaacaactagggacagcccctgtgccccacggtcttctaaagttattcaaactagccaaccctaagcctgtttaccctgctttgcctgttccttgtggtggaaaccacaataaaggatctcgccaacagtttctactcctgcttttgtctcctaactgacccgtatgctccacatcctatggcaggttgtgccgcctcctcttgggaactgtaacaaacttatcttttcagtggcaatcaattttctattaatacactatcttttaaaactttgggctactgattttttttcaatccttgtggcaaagaatcttattattaagaaagtattaaatactgttagatttaaagctttttttggaagtaacttgaagagattcagaatggtactgaaatacatatgcgtgtataggtaaatatgtacatatgtttaagtatacgtgtgtgtatatatacatgcatatgtataatgtatgtgtataaaaaaactttaaacttgatttggaagatgacaaattctcatctataagctccctttacagatcatctttggttctgctctctttgtttataaatggaaaaactaaggcccagtgtgaatatatggtttacccaaatcacacctttagttattggcaaaccaggataacctaggtctgattccttcaggcttaagtagacattcaaatgtaagcattttttattgggaaaaaaattataggcaagtcttttcttcttgcctttctcaagggaataaggtattaattttgttttctcctatcccaagtggcagtggttcggttgctaggtaattgttccaattgatacagtttctccatctagcaaaactaaaatttaaaatttaatatagttatttatattttattttataaaactatttttaataatagatcccagagacttattttatgtcccacatctacccatttgtatctcaacttgtttttatgtttttttcttactttgttttatttggcttttgctgttagatttgtaagcttggaaacttgcagcagcctttaagccaggtacttcattgtaaagattttccaggatttctgtttttatggtaaatttgactgggtcaaatagtcatattgtgaacagagccaacatgagaaattgctgactagggatatcaataatttatagtgaaacaaaaatgatttaggaaatttggtggattttttaaagtgatttttgtttttttaattttagggggcttttttggtgggcatagtaatattgaggtaaatatacatgctttggggtgcaataggtttctgttatattctctttcattgggccttcatataagtattggatccagtttggtgttccacattttaaggaagagggagatgaagcctgagaagtggcttaaaaatggtcctccatacagccacttgtgatagttctccatttcctcagaagattgaacaaattgtgatataattatggtggaagaagaaatttaggttaaggaaatacattcttaataatgcaagtgcttaaacaggatataacttagtaaggaagttaactctctgcccaggaaaatctttcatatactacatactagcttgttactagaattgcatgtcattttgttagtggtcgtgaatccatacaggtctgcagcaacctcagttcttgcctcctcagaagaaagaatttaaccaaggggcataaggcagagggagagactaaggcacgttttagagcaggagtgaaagtttattaaaaagttttagggcaggaatgaaaggaagtaaagtacatggaaatgggccaagcgggcgacatgagagtcaagtgtgtggtttgacctttgacttggggtcttatatgttggtgtgtttctgaggttgtgttacttcttgcatgattcttcccttgggttgggctgtccagatgtgcagtggcctgccagcacttgggaggggctgcacgtgcagtgtgtttgttgaagttttatgcatgctctcttgagctgttttttcccttaccagtctagtgctcatatatcagttaaactctgccgtttgcctcttagtgtgtatgcttgagctcactcgtccaactcctgagatcttatcaggaagctgctgattgccagcttcaggtgtttctagctactgagagactgcctttccctgttgctggctgtgaccaattactatattagagcgacagtttaacaactgcctgaccacctgatattcttggttgcggggttagggggtgctttctgtcctgctcacatctgactacctactgtaacatttcctcccttaagagtccaagaccccagttctttgaggaaaatggatggtcagtcttctgtaactgcttcttgctgacagggatgatggtggttgttctgtaggtcttggcctcttgctggctgtcagggcagggtggctctgtgggttgatgaaagctgaattcagccaggtccaagggagacaggggcaggattttgcctctgtcatgtcccactgatgggcagtctaggagtcccctatagaagggtgactcttggatattgagaggatggtattctttactgaggatcatctggagctggatggcctgaaggtgagaggagacaaatcagattattagatttagaagacagaggccaaaaacgacaagtagagatgttaagacaaaataaggggatgaggacagattaaagaattctgagaattctgagactcccaacatgccaggcaggtggctgcagtcatgccagctgtagtcatgccggctgagacctgggtgcgtggggttgctaaccaattccgatacatgcccagaattagaatattgacccagatttttacattacccatcccttttatttcttctgagctgtagccagagatcactggttggttcacaggaatgagcagagttattctaaatggcagaaaaaaacttaataacaactgatgagactaaaatttgataacagtagtaccatagttcttgaaacatgatttttctcttcagttctcatttttattaagaacaaattatgataggactgatttgtttgcaaaataagctttagttctgttatacttggcctaatgagttgcataaagcacagcaagaataattatttgccatataggctccttttaaaattggctttgatggaacttccttccataaggagtctcagataaggctttttaaaaccttaagcccagctatcagttggtgccatcaaatacctgtatgaattggacaaattccccttgtcttgcttggggctcctgggcctgtcaaaagtgacattctttacttgccacaggtcgggaatcctgtacagggactgtgttgacaatgtatgagttcagttttccagaggggcttttcttggctttataagtcaattttgattcttaaaggaaagcatgccattccagtcaaaaccttggtaaaataaccagtttctccaattgtgtcctgttgcaaaagaaaacagattttattgcacttatgcaaataactatattgccattagttaagaatactcacaagtagtttccaaattctgcagaaatctgagagaagtatgttccaaattttgtttataggagtatactttactcattatttttttttttttttttgagacagagtctcactctgtcacccaggctggagtgcagtggcacgatctgagctcactgcagtctccacctccgaggttcaagcgattctcctgcctcagcctccttagtagctgggtctacaggcacctgccaccgcactggctaatttttatatttttagtagagacggtttcaccacattggccaggctggtcttgaactcctgaccttgtgatctgcctgcctgggcctcccaaagagctgggattacaggtgtgagccaccgtgcccgacctactcaattgttaaaagctgtaaatagctcaaaagttttcttggcgttgaaaaacaaagaattagcaatgttttaagcaaaaagtcataaaaggattattttagtcttctattagttcagtccatgcagttaactcctgttctgctttatattcatgaacatttcagctttcatgagagtcctgaaaggtttttttctttatcctatgtcacaatctccagttatcagaaacctgcatttaagcctatcagtaattataaaaccaccttttaaagaggattaaaacaaggtaacaattatctgtggatgataaaaagtcttagggcagccacagccagacacaattgaaaaggaaatttgttagcctctgtggcatgcaataatttaacttaacaattataattattactgataatgtatgcctagtcatatcagaattgtaggagtttcacataattctggaacccataccaataacacacttacacaaatacagcccaaagaaagctggatttcacctttgcattggtgtactattgatgtcaaacccagttcttaataaaaccttatagacaaatctattcaatcttaatcagtttgccctcattttgtaagattgtcatagaccttttataaccctttacaatttttttgttaaagaccagaagaatgctctaagaaaactgtgttatgcttttattccaatgtttaatttatgaatagtctgaatagtacccctttaatgttagctaacgtgttcacacaggatttcttttacaagattaatatttcacacatctgccacgacttgctcaaacctttagctttatcctatctaacttaaaataattctttaactccctaaactaggccaaaaaaatctatattcccatgccttcttatgatattttaccaaaagtacattttactttacttacatgttttacatgtaaaactctttttttcagtagtctcaagtacatgttacatggttaactcttagcagcttttactttggatgaaaacctggtaagtaagaaattctaattatgtactaggtgtggagcctaggacaccagacagaagtgtagataaggtctgactctttccagcatagctagggggcatggctaactctgtgtgtcttcaggccttatgtagctttaaagcagacaagttgtccagttaagagtcatagtagaagtttaggaagcatttagtgggcttaataacctttacaattatataacatttctttataaattcccttttactaactttttttttttttacaacttacacagaccatctacaacatacttggactctctcacttggcttgaacatccctctttttatacaaccattttactttaggacaatagtttaccatacaagatcctttctcatataaaatatcttttctttttaaccttccttaccaaaaatacctctttacctttataacctttgaattagataaaagtcattttccttctattaggaagttatggtttgttgctgtgtgagtcctatgaagggggagcagatgaggttatctatatactgtagaagttatccaccctcaaaagactgcttggttagatttttactaaggcttttcccaatacatgtgggctctctctaaacctctgaggtaggactttccagttgaagttattggttaaagatttaggtagctttctgaagagaaatggggctattagacagatgaattcacaggttgggcacccatctttgaaagtaagtttttgccccaaaagggtgtgaatcttttctttttagggaaggggtgccatacgcccccattacctgacaggatttggaggagagttgatcagagcaggacattagcacagagtaggcagcttttgaacccaaaagggaaatttataatttttacttgccacatctagagtttcccttggctttgtactgttgatggcaacaatgtctgatttggaagccagccagagcagagagccccttcagctcaagagtgtcaggagttgagattttgtcttgggggtgggggcgtgcttcaaccctcaggaatgtcctgttccagtggctgagcttgtggcagaggggtcaagctgtgcagggatttttccctgattatcccattggggaagtttgacttccagtagcctggcttcccacaccacttgcaattaactgaaggagtaggcttttgtagtttttgtccagtttatttttaggccaaacagtattacaaaggaaaactagttttttgttttaaggtttgaaggatcaaacttttcccagttttttgaggatgcatccatggggcatgtcctggggtatggaaacatgattacccatctgtgaagagagatcagaggaggaaaaagaaaaagaaagcgtcccctcttactttcctatatcctgaataggacatcccccattcgtccttagggttccataatgaactggtcttaccatgtactcttaacctttgtagtgtcttgtcacaattacccatttgagaacattggagacaccaatatgaacagggccccccagttcatccttggggttacggaatgaacctgtcttactgtgtacctatcattgtgccttcaaccctgttctaatggtaatctgttagcctggaaccaaccttcatctctgtcttatgggtctcttttgtctgcagtcttgggccagcctatatctttgtcttcataaccttagagtgactctcacttgcagcattttagcaacaaaatgatgatctcttttctcagattcccattttccgtgttctttaagtagatgagaagcctgcttttccagctaactgccacaaggggctggacttccctcccttcaaatatgaccctgaagatcttggtgcatattgggaagggcatggaagtaattcgtgaaatggaggctacaggaggaagtgggaagaagctagaggaatactcatggaaagccttcatatgcttgcaaaaacagcagcccttggatttgagggggcaacatttattggccctcttgacctaaaggaggaacctctggagcacttggggcttggggtgagaactcacaaatggcaaaagaagaattttctctcctcccaaagggttgctaactccaaaaaagcaagtgggtaaggtctttaaagggcctcagagtgaagccctatgcaggcaggcaaactgcttcaaaagacactggaaaacttggccctggggcattaacaggaacaaaaggtgtatggtaagtcataaggagctcgcagagccagggttccgattagtgtttgtctcagcaatgtgccaacagacaggaagagttggaggtcatctgagctggtagggtaaaaacaagtataaatctcagggaatatccatccacaagggagcccctgtctgctgccaagcacacagcaagagctgcggacacatgaataacagggagtgtgtgtttaagaagtcaggtggcatgcaaagtgaaaacgaagaggcagatgtgcccctgaggcaggcagtctggcgggtgtgcaaggccatttcagattacccacagggaaaacaggagaaaaggtggtgtgagtttttgggaaagagccgattttagttgaaaaagcagaggaaatcctagacagcacacggtcttaggctttagccctaccattctcacaagccgcctgtcagtgatatgtctgggatttcctctgctttttcaaataaaatgtctcaggtctgcctgatgtagaccccaaggtctttcccatccccacaagctatctgtcagggtgaactgagagatcagcccagtggagggggagcagagccactgtggccaagaggaatagttctgggggttggttagtaagcaggagagtgaaaggaagaggaaaacttcctacaggggttgaatgcctccagcctaagaaggaaggcatagaggtatcttaccactgggaaacatatctgagtcacatgtcaccaaagtatgtatctgctccccagggagcctataacttcctaaataaaataagatttttttatatattgagtaaagcatttagcaactttattttataatataaccttttatcataggagaatgataaagaataatctggtccctgccagatttcctttttcttgccaactcttatacttggtctagcatgaggccctgagatgctcttattgccccaactttcagcttttgtaatggaaaacatacatagttatttagctaagtaatggttcgttatactacctctgacacttcaatagtgctatcatcttcgcttcctccagtgtatagattgtgccttgcatgtggttggtgcttaatgaatactttactgagtagatgaagctctgttgaaaaaaaacttgctttgtatttaattatttggttccattttttatacatttatagtttttactatatctagaaataagaacaattgcatgttcctttccttttcagaatcatctagagtaagcaggccaagagtgtttttgataattaacagaccattgtctgctaagatgatgaagcacattgagtttttcaaagaaaccaacaacatagcaatataaaataataattaaatcccccagtgtgacaaaggggtaagcggtatgaccatgacccactgttatttttttttcaataggggtgtgtgtgtgtgtatgcatgtgtgtgtttgtgtttaggagttggggtcttgctctgttggccaagacgggagtgcagtcgcacatatgtagaaataatcttgaactatcttagctatgagcaattaatgtaatgaaatacaattaatgtatttctaaaatgtactaattttagaaatagtaacataggtattgtaaattcatggtcttttgggggtttattgtgatgaaattaaaaggctaaattactcttaagagtttttataactttcgaagaagaaatgttggggtcatgtattaaaaggatttggctttgattatagctttacagtgaagttcatttcttgtctgaccacgtctttaaattatttaaataagtcttttccatcaagtgcagttttcctgtcaaggtttatgtctttttttggggggtggggtggggatggagtctcactctgttgcccaggctggagtgcaatggcacagtcttggctcactgcaaactccgcctcctgggttcaagcaattcttccgccccagcctcccgagtagctgggattacaggcaactgccatcatgcctggctaatttttgtaaagacaaggtttcaccatgttggccaggctggtcttgaactcctgacctcaggtgatccacctgcctcggcctcccaaagtgctgggagtacagccgtgagccactgcgtccggccagtttatgtctataaatgagtttttaaaaatcatactgtgaattcatcacataagtgaatgaaaccttttctttgcctgtgttctcatctcttctcccttcaccacagaaatgccaaaagtcatttgtgtccaagaaaattaatataataatttttttaaatcctccttttccccaaataagtgctcatactcttttcaccttaattggaggtgaaaagctgaattccctactactgaagatagatctggattgcttggtagaatatgcaagatggttcttaggtggcacccccttcccgctcccctccccccacacacgatattagagaaaaatctgtggccagttcatttacacttgaatgtagaaatctagtatttcctgattgctcaatttgctgtttagagatgcagcttaaaatagccatctatggagttagactgatccatgacagcttaacagtgttggaccaacctctcttggccctaaactatgcagctattttaagctatgaccctaacaactgacagggcatactgtaccctcttagcactgagcattagttctgtatttccagagctagactgatttaaacttctatagaattaaagctatcattgtaatgttttgggaattgttttgttttgttttgttttgagtgagagtctcactctgtcaccaggctggagtgcagtggcgcgatctcagctcactgcaacctccgcctcccggattcaagcgattctcctgcctcagcttcctgggtagctggtactacaggcatgtactaccacgcccggctaactttttgtatttttagtagagacagggtttcactgtgttagccaggctggtatcgatctcctgaccttgtgatccacctgcctcagcctcctaaagtgctgggattacaggtgtgagccaccgtgttttggaaattcttatacccacccacacaagctgccagcttgccatggtatatcagatttcattaaaataaatactatggcagaggggaaagatactaaccataaactctttgtgttttacccaggtaatatattttgagcattacttctttggatgaactgcctgtaaaacagaaaagtcccaagaatcgtttgatgatcactgtaataagattatactgtttttagatggttagtacactaatacctgattctgtgattgcctttgctcatattttctgctctcatggaagattgctttttaccgttatttcctgttttatccatttaattgttagtggtcctgtttactaactttgtcctcttaccacttctcaactgcatatccatttctttgggacttattccttaaattcctactaagtctaagcacaaggctaagttctgagagcataaaggtagaagcctttgccttccaaaaggttatgttccagttgaggagacagaatattcattaaaataaaaggtaatgcatagaagtaatacaagtggcatatgctaaaagagagatgaatggtaaaagatggtaatactaaaattaagagcaggatgaatcttctgagagccagggcagaaataaaagactccatgaaacctggtaggcttgaactaattctttgagaaaaggagagccctaacaggaataaagaaggaaggcattgtacaaaagatagtgtgtccggaattggtgggttcttggtctcaatgacttccaagaatgaagccacggacccttgcggtgagtgttaacagttcttaaaggcggcatgtccagagtttgttccttctgatgtggggatgtgttcgaagtttcttccttttggtgggtttatggtcttactggctcaggattgaagctgcagaccttcgcgatgagtgttacagctcttaaggcagtgagtctggagtcgttttttcctcccggtgggttcgtggtctcgctggcttcaggagtgaagctgcagaccttcgcggtgagtgttacagctcataaaggcagtgtggacccaaagagtgagcagcagcaagatttattgcgaagagcaaaagaacaaagcttccacagtatggaaggggacccgagcgggttgccactgctggctcgggcagcctgcttttattttcttatctggccccacccacatcctgctgattggcccattttacagagagccgattggtctgttttacagagcgctgattggtccattttgacacggtgctgattggtgcgtttacaatccctgagctagacacaaaagttctccacgtcaccactagattagctacatacagagtgtagattggtgtatttacaaaccctgagctagacacagaatgctgattggtgcatttacaaaccttgagctagacacagagtgctgattgctgcatttacaaaccttcagctagacacagagtgccgattggtgcattcacaatcccttagctagacataaagattctccaagtccccaccaagattagctagacacagctgattggtgcatttccaaaccttgagctagacacagagtgctgattggtgtgtttacaaaccttgagctagatacagagtgctgattggtgtatttacaatcccctagctagacgtaaaggttgtctaagtccccaccagactcaggagccctgctggcttcacccagtggatttcgcaccagggctgcaggtggagctgcctgccagtcccgtgccatgcgcccgcactcctcagcccttgggcagtcgatgggaccgggtgccatggagcagggggcggtgcttgttggggagactcaggccgtgcaggagcccacgggggttgggggagactcaggctgtgcaggagcccacggctgggtgggggtagactcaggcatggtggactgcagatcctgagccctgcctcgcggggaggcagctaaggcctggcgagaaatcgagcgcagcgccagtgggccagtactgctgggggacccggcgcatcctccgcagctgctgacccaggtgttaagcccctcactgccgggggccagcagggccggccggcaggccagccgctccaagtgcagggcccgccaagcccacacccacccggaactctagctggcctgcaaacaccgcgcgcagccccggttgccacccgtgcctctccctccacacctccccgcaagccgagggagccagctgcagcctcggccagcccggagaagggctcccacgatgcagcggtgggctgaagggctcctcaagcgcagccagaatgggcgccgaggccgaggaggcaccgagagtgagccagggctgccagcacgctgtcacctctcaataggaagttggaatatgctttgtataagaaagaatggatagacctttaaagttctagtggagactttgaggagaatgttagaaaatgaagttcacaaggttggtagaagtttggttgtagaatgacgatgtcagaccaaggacaggtgaaaagggtatgtgaatgtgtatatttttgaggggtaggggacaggaagtttcatttataaagcagtgttttagttttagttttttttttttttttttgaagacaggatctcactctgttacccaggcagtgcagtggtgtgatcttggcttgctgcaacctccacctcccaggctgaagcaatccgcccacctcagcctcccaagtagctgggactacaggtgtgctgccaccaggcccagctaatttttgtattttgtagagatggggttttgccatgttgcccaagctagttttgttttttaacagacgtaggagaaatggggaagccagtttcgggaccatagtattgactcagatatcagtgatgggaagtctgaacttgagtgtaaagtatgtggttctcaagagtcttaaaaaaataaaaataaaaaagaatttgatgtatgaatggagagaggaaaaatattttaagggtaattctgtagagtttgaatctggatgaccatgaaagtgcttgtgccattgaaagaaatgacttccagaaaatgaaagtgatgaacctgaattttgatatttgttaataagtctgagctaatagtatgttgaaagtgtctagtttgtatctggagattggtcctgagaagagatcagaatcagcagtctagatatgaaagtcttttgcatggagatggtgtagaaattatggcagtgtatgaaattgaggcagacagttttgagtttgaattgcagaattatgagaactgaacttagggttacacctggtctttgggggccaaaagcagaaagttaagaaaagtgagaaccatcagagaaatagaaagagaacagggtagtatgtcagcagctaagaggaatctcagatggtattgaatgttgacttgagagtattgagaaaagttcagcaggttttgtgtttgaatcatttgataagacctaagaactgtgctgttcaatatgaaagccgttggtcacatgtggcttataaacctaaaattaattaaaattaaaaacttatttcctcagttgcattaactacatttaaagtgctaattaccacatgtggcaagaggctatcatattggacagcactgataaataacttttctttttttttttttttgagacagggtctgtcacccaagtgaaagtgcttctaaaatgagattttaaaaaggtgagtcaatgtttggagaaccagtcagatgctgataatagaagggagaataaagatacttttgggtgacttctcagtaaattaggaggcaaaatcatctacagattgtaaggtgcaaggaaaggggaatgaggatttgaggacagagggaaaaaaattggaacagccaatgaagggctatgtacattgccagcataggatgaatgaaaggttaccaagcaacagtgatggctcaggtaatgtaaagtttagggctttattagccctcctgtaatctctttccttggtgtttagcagcctaagaacaccagaaagtggatgataagaattaccatcaggtgtggcagaagttcagcgagacacaagggattaccacggatgctaagcgaagccagaggagggttggattgagagtgtgtccacataactagggaacaaagtgaggatgaagattgagttcaaaaataaacggagtgaaagggacaggaagttaaatatcgtggttggagaagagatagtgccaagcctgacttcttggaggaagagcagttctagttgaagacagagtttgagctgggttgtgtctgtaggagacatctgaatgtagaactgattttttttccaaacctgcttcctctccggggttcccctatttctgttaatgggatcatcatcactcaaattagaatacttatagatttatttgatctttatcaattaattatcttaaaagtttatagttctaaggttcaagtcttagtttagccacttaaatcttgatcaagtgtttctctaggtctgactgtcctcatctgtaaaatggcagaaatcatgttactttagtgggataagatatgtaaagtactttgcacagtgcttagaacacagaaaagatttcactaagtgctagcaactatttattatgataattattatttattcttatatctgattcattcccttgtcagggcgctctcttttttttttttttttttttgagatggagtctagttctgtcacccaggctggagtgcatggcctcccgggttcatgccgttctcctgccttagcctcccgagtagctgggactacaggcacccaccaccacgcccagctaattttttgtatttttagtggagacagggtttcactgtgttagccaggatggtctcgatctcctgacctcatgatccgcccacctcggcctcccaaagtgctgggattacaggcgtgagccactgcgcccggccagtcagggctctctttcagagcctcgtgatctggaaggtaaaatagcttctttcctaactggtatctctgcctctacgttttcacatgtttattttgttcttgacatttcagagttttcctaaaactgagatctgatacacccctgctccgtttgtcacaatctttgtttaaaaatctattttctattttttttttttttttagagatggggtcttactgtgttgccctggctagactcaaactcctgggctcaggcagttctccagtctcagccttctgagtagctgggaccacaggtgtgcaccactgtgccaagcttcctcacaaccttcataggcttccaattgcagacttttcaagttataaaaactgtcaagaggtaatagagcccaatgtagaataaaagttggtgatagaggctatagcaatgcattactactatggtgactcattgtacatctaaaggaccggaagtagctttaaaactttttaagactatttacaatttcacatagaattagccagattttccttttttgatttatttttcaccatcaacttaggcaagtatggttcaacgtagaatgagggaaaattagaaaattttttttgttttgttttaaatatggcaaattctgtttaaagaaagtattcatatctttctagggttttccggctaggaaggatttcctcaacataaacagagttgagaatagttgacagttatctggagcaagattagaataaatagaaataactaggtaccaaagagggtgtatatctttgttttcctaagcttttctctccaacaccaaatgactagagttgcctttccttcctagctcagggagtttcaaaagagcaataccttcaagcatcagaattgatagacaggtgttactgtgtttacctctaactccctgttgcctgcaaagtccaaataatatcctagtgcttaaggagagaatatagccaaccagaaaagagtgtagggctctggattcaggctgacctaggttcacatcttagctttgccacttaatagcagctatgtaatcttgggaaatatgcataacctccccaaatcttagaagacagcattagacaaagtataggtgtaaaatagtttagttcgattatagccatttagtaaattgagtaagtgcgagtgattattgtgtggcaggtattctggattggggatgggaaggatgggcataataccttaacaaggattccctctctcctaccctagaaagtcccttctttaagaagttgacagcctggacaacatagcaagaccttgtcacaataaaaaatttagctgggtatggtggcacttgcctgttgtcctactggagagggctgaggcgggatgattgcttgagcctaggggtttgagattacagtgagctatgattgcactactgcactgcaggctgggcaacagagcaagaccctgtctcttaaaaaaaaaaggtttaattaaggcccttcctgatctatccttccaaccctatctttagccccctcacctccttgaactttaatctccagtggtatgctgtctcagggttatgtctttaaatatagccttcccactgccttcccatttgcctttattctttccacctgtcagtggattcatctcctctgtgaagccttcattgtttctttttgacagtaaatcactgtcctctctgttaagtaggcattttatgcacatttttgttattgtgcatattataattatttatttgagtgtgtcttccctacaggtgagggcttctggtcagatcttatttatcatttctccagcagcattaagcacatagcaggtactcagtagaagtttgctgtatgaataaatctcacttctatactaagtccacatccaaagtgctaggacttaaggaaatgtgaatggctgttaagtatttgtacttaatacatttgcagtttgttttactggagttaacattcctcttgagtgtttatcatattccagacattatgctaagacgtgtgctatatacactatttcagtcaactcccacagctcccaggtcctcaaaggaagaaactgcagggagaatcagaactcagaaacaggtctgcttgacccaaaagttctactttcggctctactaaactgttgcgcctgttcagtaactcaatattggttcacagattgtacataacccatagtatgttgatagtcctggaagtcattggctaatggggttcaccttcatttaagagatacagaaggtactcggttatttcttaatattttcatttatagttcatctacaggaaaacatgtcattgaagctcttccataaggcaaagaagtattttgtaattaataagcataattttcaaatctaggattttttttttttttaccaccagtgtaccatggaatctctctagtcatatgtctgtcaaaactgtcacagcctattcccaaatgtatgtagctctcttttcaaaggctttaattcagtcatatagtttctgtttttgtggagactcatgtagtttttatagggatcacacaaatgtaccatattttaatttttcatatgttttgttatagctgtttataatgatatgaatgagaggcataaatgttagttgagttattccagtgctgagtttcagtggatttcttaatctcagcattattgacattttaggccaggtaattctttgtttttggggtctgttttgtgcattgtaagatgtttagcagcatcccaggcctctactcactatataccagtaatctcacactttgtgacaaccaaaaatgtctccagacattgctgagtatctcctggaaggcaaaattaccttcatttgggaaccactggcttaaaggtacttagagccaacaaaagtagaattaaaaaaaaatttttttttaaatctagttacctttaaaaaaacaactttatttatatatatccataccatattatacaacaacttcaagtgtatattcaatggcttttggtatattgatagagttttgcagctatcaccacaatctagttttagaacatttatatgacctcataaagaaacccttattagcagtcattccccatttctcctttctatcctccccagccctaagcatatttggttatctttttatgtttaggaatatacatcctgcttgcttattttaagtcagatcattatgtaaaccaaatcctattttagagtgtgtttattgaaagttatttgcaatgttaggagacatattttttgagaggaccttagacattttcttaggcagattccaagtttaatctgtaaaggaagtcaatctaggtaggctcagttaagaatcattttagtattattcagaacagaaaaaatcccactgccccccatggcaagttttgtatcatagaaatcaacagcttttgtttttcctgatcagttatattagaaaaccttgttccctaggttatatgcacaaaacataattaagaaacacatgtactttgaacctgctgtatgattattattaaataggtcaatttcagtttattggttggtgagtttatttataggtagatagataaatagttttgtttttcaaatttgcggatctgtcttacttacagagtaatgttacttactatttactataagaaaaaaccttgcaaatcgtcttttccaaaagaagaaataaggcacagttggattattttgtgtacacacacgcatctgttttaaattgtgttcatttctgtccctattcctaagctaacagcaccttattttaattactgtagctacctacatatctttattctactattctgctttttcagacttttcttagctgatttttcacatgtcaaattagcagactttcatggaaaagtttcgaattaaatttgtgattgcattcacttcctagaataattttggaagaattgacacatttagtttaatgattcttcctatccaagaacatatatttctctcttttgaggtcttgttttatatcctttattaaatcttcctcaagatcttgcatattactaattagattgatttctcagatatttgtggttattgttgctattatgaatggaattttttttttttctttttcaattgtttgttgctgatatggttgggaactgttgcttttttatgttgctcttgtatttggccatctcgctgatgtacagatgtcatattataataatttgttgatttttctatagttttctaagtaatataattatatcttttgtaaatcatgacagtttcgttacttccttttaagtctttatttcttatatagatctgttatttcttgccttactacattggcttagaccttaaggaaatgtacagtattagaggtgagagcagtaatcacttctattagaaactacagtgagatatccaattttttgtttattaaatgattttatacattttactgaatttctcatgctccatgagatgaaacagcattctcccatacttctggtggaaatgtaaatgaatgcagctctttatatatactcctgtaattttataatctagatagtcttacaaatgtttcatgtcctttgatttagtaatctcacttctaggactatcccttggaaataataaacaatattttagttcaagttgctcattactttatgttacttataataagtatttggaaataaatatctaacagtacagtaatggctttgtaaattatggtatatgatgaaatattgcacaactattaaaataatttgtaatattaataacttagaagtacttatattactaaataagtaaaagaggataatacagaatttttatatagtaaagttgtatcagcatcaaaatacattgaacaaagattaaaacagaacttagatcatcacatcaaaatgataatagtggtaatctatgggtaattactttctggatgatttcatttcctcattcatagttttctatggtgagcatgctttgttcttaaaatcagaagaaaaagaaacttaaagtgtatgtgtttgtaatactaaactatttattttcatcaaaataggtagaaagggagaaatcttagcctattccctaaatggcaagtttagttataatttttttttttttttttttgagacggagtcttgctctgtcgcccaggctggagtgcagtggtgagatctccactcactgcaacctccgcctcccggatccaagtgattctcttgcctcagcctaccaagtagctgggactacaggtgcccgccaccacacccggctaatttttttgtatttttagtagagacaagatttcaccatattggccaggctaggactagttggtctcaaactcctgaccttgtgatccacctacctcggcctcccaaagtgctgcaattacagtcatgagccaccatgctgggcctataattttttagagttaatatttttataatactcttttcaaaaaaaaaacaccttgctgaatgtagatagcaaatgtcataggagaaatctgatacctgagagagtagtacatagtttcagaaccaaggttgagagttatgctctgggatctgcttctaaatgatctgactgccatatcagtgagtcagggaggaagtgtagcagatatccacttgatttggtttcttactgtcttgtcacccatgtgcatgtgtattgtaaactagctgtcatttagcagccctgtgatatactgctggccgagtttcgtaagaaagcttctatgtttgtatagattttagattatcattcgctttatttaagaaacattcattaagtactttcagtgtgtcaggaaccttggtagccaaaggacaaatgacataaaaaccacacagatggcctctttcttgagcagcttttgttggaaataatttatgactaatattatgatggagtgagatggtgtcttactagtaagaccagaaatacttaaattctaattcaaccaattcttgagatcccttagggagctaggtataccaaaattcaagttagaatttgttggcttaggcataggcccctgcctcacaatccagagaactaggttattctatatggaatatgcctttttcctttaccagctaaacctgactttcctttctacgtgttagcttaaattcaagtcgtctcaaattttactactctactaaggcaaaaaactactggtactaaaagaaaatgagcaagaaatgtccaacaagctagatcttgttgaatagttagcaattcagatgtcttactacctaccaacaaactgtccccctccattaccttggcccagtttctatatttggaaaaaaaaaaaaaaaaaaaagcagaacaaaaaaggaataagaaagatggcttggctgctccaagcagccttggaatgttttacctctggtaatgtggaagaaaaataaaagaacggccatcctcagtctgtttcaccataatgtgtagttacaataccaagaaattttgagttattaaaaaaattattttacaaagcagtttcattggtaagaaggattaaagactaaaatctgtaagatgaatagacttttgtcagaccaagggagatggaggtttggggtgggagaatgtgttggattccagctatattattcaaatgctcggagacacagaacattagagaagacaggagttcactgtaggtgatggtgagagtgggcatggagcaggagtgccaagagatgaagttataaaactaagcaggagttagatcatgaagaactttatgtactatgctaagaaatactgaccttattgtgaatgtatggagggcccattggctttttggggagctaggtctgcaatatgaatattagaaggggcaaaactggtgataagggcttgcactagtgtacaagcaataggtatggtgaaaatggagacatttgagatattttgaagaggtagacttaacagggacttatgatcaacatagataatgtatatggtggaaagagaatagctttttgagttggataagtgtgggttcaaatcccagctctgtcacttttccattttaggatcttggatgttttacatacccctgagaaccttagttttctcatcttaattgggacagtaagctgggtgccatggcttgtgcctatagtcccagctacttgggaggctgaggcaggaggatcacttgaggtcaggagtttgagtgtagcgtgggcaacatagtgagacataatctctaaaagaattttaaaaattaactaggtgtggtggcatgcatctgtagtcccaactactcaggaggctgaggcaggaggattgcttgagtccaagagttagaggctacagtaagccatgattgtgccgctgtactctagcctgggcaagagagcaagactccatttattaaaaataaaaatttgggacagtaatatttagcccatagggatgtgaaacaatatatggaaaacatccagtaaagtgccttaccacatagtagatataaaacaatagttgctcttgttgtcagggtgaaggagatagagaggaatcaagaatgacttccaaattttctatttgaatggtgaaaaagagctatattaggaaagtgggctaagctatctggttcttagattgcttgtgaggattcaggtggaagtgttcactggcagttgatagtaagagtatgacacttctgagtggaaggcacagatctgtgagttaatcagcttacacatagcagtaaaagttatgaaagtagatgaggtcccccaagaagagagttagaatgagaagtcagaaccctggagagtggcctaggaagagtagagggtgtattttgtttgattgtttgtttgtttgtttgtttttgagagggactttctctgtcacccaggctgaagttgaagtacagtggtgccatcacggctcactgaagtcttgatccccagggctcaagtgatcctctcacctcagcacctcattctcatgagtagccaggactacaggcacatgccaccatgcctggctaattttttaatttttttaagagatggcatctcactgcgttgcctaggttggtcttgaactcctgggctcaagcagtcctcctgcctcggcctcccaaagtgcggggattacaggtgtgagccactgcacctggctgataaatcttttcagaaagtgacataaatttagatttaagtgctgattttaaaaaattgctaaggccatgcatggtggtgcatgcctgtaatctcagctacttgggagaccaaggcaggagaattgcttgagccctggagttcaagactggtctgaacagcagagtgagacccccatctcttaaaaaaaaagaaaaaaaaaagcaaccaaacaaaaaggagctaacagagaagaaggggtttctgaaatgtaggaagttagctcacagagtcaaaattgaataaggatggagtggcgagtggtgtcaaatgcagcagagcagtcctgtaatggtcactgaaaaaatgcacaatagatttggtcattagaaggaagactgtgaaccaggagctgagtaagtccttgtggtagagtgctttgaatgccagactttggtcggtggaagaatgattaaatgttattgagcacgaaagtgagatgatcagaacactacttttttatttttctggcagcagtgtgaaggatgagaaaggagggaaagctcaatttaggttggtagaggcacagattgaacaagggcttggatcaagatgataatcttgcttggaaacaggttagcgtaagagctgttaggcagtagtgtcttcaaaatttggtcatcactggatgtaatgagtaaagaagtagcctaaaagatgacattttaaggttttcagtgtggataacaaggagaataggggtagcatttactgaaacagggacattagcagaagcaagactggaagatgaaatcattttttatttttaaactttgatttattaagcatatgctattgagtggcactgttattgagttattaggcactgttacggtactagagatacagcagtgaacataataggcaagatccctactttcatggcactttaccttcagaagtgaggtgaagaccaaattataaaaggacaaagtaatttaagacaaataagacaaaactaggtgatgatacagtgatatattgaggggagcttttagatgggatggtcaggaatggcatttctaaagaggagagatttgaactcagaccagaatattacaaaggaatcaactatgcaaagatctgggtgcaaaggcatccccacttagactggagagtatatgcaaagtccctaagaaggaaatgagcttgatttatttgagggccagaagagaggccagtatatcaggtgcagagtgagcaagggagagactaatagagatgagctctgagaagtcaatagaattaaacttaagtggggcctcggaggtcttgctctggagtttggtggcttactgatggcagtggaaataaagcagtatgttgaacttagctgtctgtgaaacatctagatgaagtcaattaacgggcttcaatatacaaactcaaatataatttgcctctgttattcattgaaataactttccaagttgtttaggcattgaacaaagaaatgctcacaatatggaggcttgaggagtgtgtcaaggacatggtcaggggaccagagggatcaggaatctctagcagttcttccccacccctcacccccagacttagctttgacttgaaactcatctagcagttctttaccaaaataaaggtcatcttaaatattattgcgacctttaaagtaatgactgttatataaatgttatgagaaaagtagtcagagaatcacggccaaaaatacctgtgtcttcaggggatgtaaagggtacttaccaacttaaaatacctgcagctccatagggaccatgctgtagattttgtatagtgcttgttcagacagtactctcatttctagaaatgcattttttgcagtaaacaaagtgtgtgtatcactgtgcttcttggtacacaagtagtttgaatagattttgtagccaaggtcatccttaagccatctagttttactgaatacatgttcaaaaacactgaaacaaaataattataccttttgtttatgtattgctttataatttatatagcctttacccctggaaaatcaacttgatcctcaggaacagctctttaaagtagatagggagcagaaattttatggaagtcagtgttactattttagagttgaggaaactgaggatctctgagtgcacagtcataaatttacaactctcacttcacttgcattgctttacttaccacaccatgctaattcaaaggtgtacaaaaatgtaaattttagtagagggtttgtatccttactaaaacagtgacaaaataaattttttaatgtgcatgttagttatgggtgctaccagaaggattaacggtgctgtggatacgcagaggagagtgagattgactttggctgggagagtcagaggtttaattttgtttagaaaatgtgtactgttttcttacttggtactttttattgcctcttcttggttgccccatacatttaaggtactacatgtgcagctttgaaataacctcccccaccctttttttgttttttgttttttgtttttttttttgagacagagtctcactcttgacgcccaggctggagtgcagtggcacaatttcggctcactgaaacctctgcctcccgggttcaagcgattctgctgcctcagcttcccaagtagctgggactacaggtgtgtgctaccacacctggctaattttttgtatttttaatagagatggggtttcaccgtgttagctaggatggtctccatctcctgacctcgtgttccacctgcctcagcctccaaaagtgctgggattacaggcctgagccaccacgcctggcctgaaagaaacccttttattttgtatgcaggaccggtatgtttgtttctgctagcatattttattgttattttgagacagagtctcgctctgtcgcccaggctgcacagtctcagctcactgcaagctctgcctcccaggttcatgccattctccttcctaagcctcctgagtagcgagtagctgggactacaggcgcccgccaccacgcccggctaattttttgtatttttagtagaggctgggtttcaccatgttagccaggatggtctcgatctcctgaccttgtgatctgacatctcagcctcccaaagtgacatattttattcttgtattgccactgaactcagcagagatgaattggtaacagtagctaccatgtaatgagcaattccgtgccagcactctggtagaggatttgtaaatttacttaatacttacatcaactttctgaggtagaaacattctttcataaattggtattttcttttcagtccattcacatacttgttattcccacacctgatggagagaatgtagaactgtgtgaaagaaaagataattataaggcattgtaggccgggcacggtggctcacacctgtaattccagcactttgggaggccaaagcaggtgaatcacctgaggtcaggagtttgagaccagcctggcaaacatggcaaaaccctgtctctactaaaaatacaaaaaaaattagctgggcatggtggcacacgcctgtcatcccagctactagggaggctgaagaagaagaattgcttgaacccaggaggtggaggttgcagtgagccgagatcgtgctactgcactccagcctgggcgacagagcaagactccatctcaaaaaaaaaaaaaaaaaaaaaaagcattgtatttcaggataatgttaagccatgccaatagatttttttattgttgttttattgtgcattatttattatatttttcccaaagtgaagaagccaagctggtatatatactaatctgagtgatgaagtctaagctatataacatgaatgaataaagtaataatatcttaaatgtctttttatgattacagtgacagtatgtagtaatcttgggtggttttgcatttcaaaaaccactttatgtatacactaaaaaaagtcgaatcaataaagagatgtttatttaaactatttaggaatgcaagatgtccataaaacttaatcctttgtttagtgacttttcactcctgtattttcttgttatgataagatatgttgcttaccgtggaaatggtaataaagctttgtgtttatataacatcttttaggatctcaaaatgcttttagactatctcatgtatcctcatagtattttagtgagtaggtaagtggcaagtattatcttcattttacagatggagagagaaattaagccacaaagtgagttaaatgatgtatgtatatagttccgttatctagatacataggcaacctgagccactaaagtaagaatactatattttagaaggattgacatagtataagccattaaccccttagtttttgtactttacacagattgttagaaaaaatttattatgcacatagatttttttttttaatcctttctttaggtgtagaaaacattacaatacttcttttttttcttcctttttaggtcagcagcaaggacaagatggagtaaaagtccagcaagctactatagctcctgtaactgtagcagttggaggaattgctaatgccacgataggtgctgttagtcctgaccaactcacacaagtgcatttgcagcaaggccagcagacttctgatcaagaggtacaacctggcaagaggcttcgaagagttgcctgttcctgtcctaattgtagggaaggagaaggaaggtaaatgctgtatttttcaactgtgtctatttggaaggcataaaacagcagttaaaaccaagtaattggctgggaatgatggtcactagaacttcattacctttgtagcctagaagttgatatataatattagaaagggaattaagttgggctattttaggaatgaaatttgagcggtcctccgccttgttccttacacttttaaaaaatattttttctttcttccccacccctcccccaccccaacaagatggagtgtcactctgctgcctaggctggagtgcagtggtgcaatctcagctcactgcaatctctgcctcccgggttcaagcgattctcctgcctcagccttccgagtagctgggattaagtacaggtgcccgccaccacacccggctagtttttgtatttttagtagaggcggggtttcaccatgtgggccaggctggtctcgaactcctgacctcaggtgatccacccacctcagccccccaagtgctgggattacaggtgtgagccccctcgcccagcccattttttttctttttcataaaatatttacgtaactttattgatataaaactcattcgtacaccatacagttcacgaatttaaagtgtacaattcagtggtttttaatatattcagagctgtgtagacatgactacaatcaattttagagtgttttcatcatccccagaataaattctgtatcttttttaagcatcacccccttatcccaatccttccatcctagacaactaatttctgtctttatagatttgccttttctggacaattcatataaatggaatcatggtcttttgtgactggtttcttttagcataatgttttcaaggttcaaccatattacagtatgatcaatacttcattcctttttagggacaaataatattccactctatggatatacaatatttttgtttatcctgtcaattgaaggacatttggttttatccacccactggccgttatgaataatactgcagtaaacatttgtgtagaactgtttgtgtgggcatatgttttcatttctcttgtatttatatgaaattacctagaaatggatttttgggtcatattgtaattctatgtttaaccatttgaggaacttaccgactgttttccaaagtggctgtaccatttaacatttccatcaatagggtatgaaggttccagtctctctagatcattgccagtacttgtcattatctgactttatgattaaagctatcctagtgaagtcatatgtcactgcagttttgtttttactgatactaatgatattgagcatcttttcttgttcttattggccatgtttgtatctttggagaaatgtttatttggatcttttgcccattttaaattatattatttatttttcattatggaattgtctctttatatattctacatacaaattccttatcagatatacaatttgaaaatattgtctcctggctgggcgcagtggctcacgcctgtaatcccagcacttcgggaggccaaggcaggtggatcacctgaggtcaggagttcaagaccagcctgaccggcatggagaaaccttgtctcactgaaaatacaaaattagccaagcatggtagcgcatgcttgtaatcccagcaactcgggaggctgagggaggagaattgcttgaacccaggaggcggaggttgcagtgagccgagatcgcgccactgcactccagcctgggtgaaagagcgaaactccatctcaaaaaaaaaaaaagaaagaaaaaagaaaaatattgtctcccattgtgtgaattgtctgtatactttcttgatagtgcctttgcaccaaagttttaattttgaagtctagagttttctattttcctttattgcttctgcttttggtattgtatctaagaattcattgccaaatccgaagtcattaagattcctagttgttttttttttttaagataattttatagtttttactcttacatttaggtctgtgattaatttggggttaatttttacgtatggtgttaggtaagggttcatcaagcaccagttgttgaaaagactgtcctttctccgttgaatgttcttggcacccatgtcaaaaattagttgaccatagaacatggatttatttctggactttcagttgtattccattgatctatatgactatctttatgtcagtaccacactatcttgagtactttggatttgtaataacttttgaaatcgagaaatgtgagtcctgcagctttgttattcttcaaaattgtactgactctttcgggacacttgcaattccatgtgaattttagaatcagtttgtcagtttctataaagaaaccagatggtattctgatggaaattgcattgaatctgtagatcactttggggacggttgccagcttaacaatattacatcttttggtctatgcacatgggaagtatttctggttgtttaatctttaacttctttcatcaatgttttatagttttcagagtatacattttgtacttttgttaaattccaattttatttctgatgctattataagttgaactgttttcttgattgttcaagtatgtagaaatacattttttaatgtattaatcttttatcctgcaacttttgctgaactttttgattagttataacagtttttttgtttgtttgtttgtttgtttgtttagtagagtctttaggatttctgtgtataaggtcatggaatctgtgaacagagatagtttttactttttcctttctactctgcaggagttctgtttctttttcttgcttagtttctctgtctggaacctctggtacaatgttgacagtgtgcttgtattttgttgaggatttttgcatccatattcataagagagatgtctgtggttttctttttgtattgtttttatctgattttggtaatgataatactggcttcatagaatgaattggaaagtattccctccaaactggtattaattctttaaatgttttgtggaatttaccagtgaagctgtctgttcttgggcttttcttatgggtagttttaattacgaattcagtctagttgcttgttgtaggtgtattctgattgattatttgttcttgagtcagttttagtattttggtccgtatttttctaggaatttgtccatctcctctgagttacccaagtaattgccgtagaattgttcatggtattcctttgtaatcctttttgtttctataaggttggtagtgatatctcctctttgatttctgattctaataatttgagtcctactttcttggtcagtctagctaaaagtttgttagttttgtttacttttcccaagaatctcaatatttgacattttttctgaccctaagaaggttcttcacagcctctttgctcacttctttctggcaaactagccaacctgtagttaagcctttatttccagtgaatctcttagtcttctcccaattaactgccttttgaaaccatctctactttttttgagagtacccttaggcttgaacttcttcacattgtcttgcaaatgaagtcaattcctttgggaagagatttggagctctttgttttatggtgtgtttctgacttatggcttttgaaccgggggttgagacagtggctttctttctgagttacaaccctgctttaagagctgagtgcctggttgctggggcagcaatagcctcaggtcttctcaactggcctctcctggcttagaactttgactttatgaactatgaatgggccaggtcaagggcaacctggaccccagtattttcatcatgccacatccaaggtagagtctatgtcccagggctaaggacttggttctgctacacttgcctggaacttagcaacaggcaaccaggggtaagataagaaatgcagacatcttgcccctcctggggccatactcctctgaccgggaggtgggaagagtaggaatcatattcttagctgcaccagtctctaatgttcctgtgtggaaacgggaggaagtagggaaggggagagtcttggttcaaataccacagactcttactgttcttaccaatttctgtgagattttcttgaataaatgtttctttatttgctgttatttgcttttagaaccatttccagagactttaaatggtattttttgctttttttagaattttcactgggaaacagatccatggaactcctcacactgccctgctagaaacgaaactctgcatcttacacttttaactggatttagccatccttttgaaattttagagaagtttcaagtgttttgaaaggcttagagagatttttttcccaagggaagagcccactatgaccaggaacgtgagtccataatagagcataaactctttgagattaacacattttcatagcaatttggtacacagacctgttttattttgtctttaactgaaaattttctgatttgaactacagttatggcatcatgatcaaacctattcagagaagcatcatttaattaccttgattctttttaatttttctataattgtaaacctactatttggcagtgtaattaatgttcggtttttgtttttgctagaggcagtaatgaaccaggaaaaaagaagcagcatatctgtcatattgaaggatgtggtaaagtttatggcaaaacatctcatttacgagcacatcttcgctggcatactggagaaagaccttttatatgcaactggatgttttgtggcaaaagattcacacggagtgatgagctccagagacatagaagaacccatacaggttagttgattttaggacttgtactttttacttatttcttcagtttttacatgaaaattttagtgatagtttagctatcaaattggaaatatgcaaatgaaggagaaggcatttactttagcaattatatggaagatgtttaagatgaacatttttaacctcatttctgagatacattttattctactttttgtaaactttatcagcatatttatgagacaagtggaatttattccatttgtttatattgtaatcttagcatgttgaaatcatacattgtttttcataagtgtttaaataggtgaaaagagagttgaattatcatcttaatggggactttcattagtgtgttttagtttttttttttcttaacaaatccagaaaattcaccaaagtatcaagaataattaaataataaacatctaacaaccctcagtcagaatggtcagttgttaatattatattttctgctttttttcaaatacagcaaagcagttataaagtgaacatcatgtttaccctttcacctttcaaagactgcagctgctataaatctaatgtgtctaagttttacgtacacttttaatactctgacatatatgattaatggatctacataaaaaatgttttgtgtgtgttatgaaatgttacaatgttgcagaattataaatttcacttgttttgagatctgtttgtacatatatgtatatttgcatatatgaatttccttgaactgctatataatattttatcacatgagtctaccacactatattaattcattcccatactgtttgaggttattgctagggtttgtgtgtgctatcacaaacttagttgatgagaacatgtgtgagaagtggaattattggatcatagagaatgtgtatgtttggttttgctaggtaatggctaaagagtctctacagtggctatttaactagcagtgattgatagtttccactttgtgctcaccagtacccagtagtgtcaggccttgaaagtttttttcaatctaaaattgtttcttattttaaaaatttgtgtttttcatggttatccatgagattaagcacctttcatatgtatattagtcatttatggctttgttttttaattctggttctcattttttctttcagaagttttccttatttatatgatttatatgttatacttttccctttcaataaaggactagtgctagtcttttatctttgtcataccttttgtcatatggaagtcttacatttttatttagtcaaatataaatcttttcttttgtcttttgctttttgtttataaatttttcttctgtcccaaggtcataaagtctcaaaaaacaatttcttctaatagctttaaagttttatttttgtaagtttgatcttttattcgctcaagattctttttgttgatggaatgaaatgagaatacaattttatttttctttcatatggaaagccctttcttaaacagcccattctgtctctattgattgtcctcttttacataatgtctcctttaagtgtggttcaatttctggtttctctgttttgaagtttttatctatttgccagttcctacaccaatgctcttactatattaatgactgtggttttatattaagccttgacttctttttgggcaattttccttctttctttatttttttttctttttttgcccagaacacctacccttttcagaatatttagaatttgggactcagtatttcattattgaataaattaatttcaataaattattgaattatactttatactttaaacctgtaccaagatacatgtgggacaaagggagaaataaaactgacatttctaaatcagctgctatattatagtcagatattttgaatatattacttcatttgattctaacaacagcaacaccggcatagaaattagctccattttaagattagaaagtagtatcagaaaagaaaaaattatgaaatctattaaaaatggtaaatataaagttatttaatttgatatacacataaagtagtaatacaaatgagtacagattgagtaccccttgtctgaaatgcttgggactagaaatgttctagatttcggattttttcagattttgcatgtgcacaatgcaatacttcggggattcatttttgtttcatatataccttatacataaagactgaaggtaatcttatacaatatttttaataattttatgtgtgaaagtttgtgttaagtacttatgtgtggaattttctacttgtgggatcgtgtcaacactcaaaaagtttcagattttggagcaatttggattttagatttttgtattagggatgctcaccctgtgttagtatagcgtcgcaatccctgaaaaagttagcattatagtaaagctctgaattttaattttaaaaaagataatttgaaatctttctgtatagtatatacaccattgacgttggcaaatatgattgattaaaagttaattccataccagttgttgatatctgttttagaaaaatactctgctatttaggtctgcatgaaaggatgcagtgtttccatcctggattagcagtgggataaattagggaagccaagaaaattttctactttgtttgatttggaacctcacattatgattgcttcattttgtctaagaaatgatgagttggtaaagtccctctctcttacacatccacacacttgcagatacacaaaacaaatttatttaagaatttatatatacatatacttcaaaaccaaatattatgatttggggcatatctttaaaaaaaagattcacaccattattatctactggattgacaattcataatccaatatactttaagcttactttcagtggttcaaacatcttaaatatatcacacataaaattgtttaattaaaacaggttgacactaaaaaatattaatatcagtatacttaaaattgttacttttaaagatttaacagagtaactcctgtttgttaaatttgtctaaaagaatatgaaaaaatatattttgaaataagtattgattaagcatttaatatgttaagttgaaagccttaaccattcgtagcaacaactatgctttatttgatgtctaaccactactacaaatagaaacttattgacttggctatgaatgaatggagttatttgtattcactgctgaaaatagtgatctgtttgctttttaaaaaaatttgtaaaggttttcaaaacaatatatgcatatggtatttaaaaatgaaatcacagaaaagtttactgtaataaggaggctctttgccccaccccatcctgctttccagagaatatcatagctaactattttaactatttttgcatttttgttctttctaggatgactgtcatgtatctaaatcatatacttaaacactgttatttattgatctatcaatattttatactatctattgagttcttgcatttagaattaaggatttacttcactttgcaccatctgaagacattaagattcttttgaaaaactgtatgcaggccaggcattctctcttaactcaccactctatttccaataaagttagacaatgccttttcttttttcttgtattgtttgactttacctgaaataatctttagttatttcaagtttttaagaacaatgtgaattccagtcacattttccttttttctggagccttccatctttctaatgaacatgaacagtttcttctgtagacctgttccaggggtattatcttgagatttcttcccttctctgttcgttttagatctcatattggttctcaagatctcgtgttttcatttttcttggtctactctcttcgttgctggaaaacgtgctgaaatgcttcctaacgaaaagcttggggaaataaatttgtctaaaggattctttattttctctttctgcttaatttggttgtttggctaatacagtattctagattgaaaattacattctcttaaaacattgtcacagctctattttctttcatctgttttatcaacaagaggtttgttattttttcttgttttttttttctgtaggtgacctgatttcttccctgcagctttatttttattttgaaataattttatacttagagaagagttgcaaagctagcatagagttcgcatatcattcaccaagcttcccttattgtaaacttcttgtataaccacagtaccttatgagaattaagaaattaacattgttgcaatactattaattacactttccaccaatataccttttcttttccaggattcagtctggaataacacactgcatttgtttgtcatgtttccttagtctcctgcaatctgtgacttttcctagtcctttccttgtcttttatcacctggacacatttgaaagtggttttggtatttttagaatgtctgtcacattgggtttgtctaatgttttctaatgattagagtaagattgtgaattgtcatgagaagaatagcacattagtgtctttctcttatcatataagaggaagtatgtaatgtgattatctcattattggtgatgttaaccctgatgtattggttaatgtagggtgtgccacatttcttcactgtaaagttacagtttctctctttccatattgtttgttagaagcaagtcactaagttcagtcgacattcagggggaagagaactaagcttcacctcctgaagggagaagtatcgaagaatttgtggacatatgttaaaaccaccacaataattactattttagaggagtttggggggcttttttacaaataaaatactaaagcttcacttttagcattcctcagtggatcttgcctgcagcagttattactgtgatgtttgaaaggtcattttcaattttccttgttctttgtaccacttatactttcttctccaattatttatgcaatcatttatttacattggtatggtctcatgagtagttcttttgttctttgggttataattcaatactatcattttcttgctcaaattgtttcacctttggccattggaaggtctttcacattagttcctgtgtcttcttgaagtgcccctgttttgtttttaacgctaagggcgccttttaatctgtggtgtgctgctaatttcataatgctgtatctgagaatagatttttatttgttgtgctaatgacttgtactctgggtcacctctctccctctctctctctttctctgtctctctctctctgtctctctgggctcttagtagacatattttggaatctctagggttttttttttttttttggtcttacagtttttctcttatatcttttgtctcattaccattttattttccatgaaattttttaagtttactttcagatatttctattgaattgcattttaatttccaatagtgtattccatcattgttggtgggttttgttttgttttactgcattttgttctcattgtatggatgcaggtgcttgctgaaattatctcagttttttaatctagaattttatgtttcctccaggatgatttttttgtctgtatctttttccagtgttgtaggcgttcctgaattgtccagtgattctttgtttttgttcaagttgatgatgatgatgatgatgatggtggtggtggtggtggtggtggtggtggtggtggtcatggtggtgatttgatgaaatcttaagtgaaagattttgaaaactttatgagctagtggcgttttgttttggtttttttgagacagggtctctgtctgtcaccaggctggagttcactggcacgatcacagctcactgcaacctcctccacctcccaggctcaagtgatcctcacacctcagcctcccgagtagctgggaccacaggtgcatgccaccacacctggctaatttttctattttttgcagagacagatttttctcagtgttgcccaggctggtgttgaactcctgagctcaagcaatccatcctcctcagcctcctggagtgttgggattataggtgtgagccactgcctctgccaagctagtggcttttattttaggtaactgggtggaacactgtgttacactggaagatgcctaattaccaaaatacaataatatgctgtgcaaccatgtttttttaagatacaaatctttaatattaacattttgccccaattttttgatagtagttatagtctatgtatggactttaattttgttttatgttccatgtctccctcccagcagaagacattgactgtcttctagaacatattctcttccttgacaatttattttctagtttgcagacatttgatataatcattgttttgctgatggacttcctttcctttttttttttttttgttattgtagatttaacccttttatgcctttactattattttaatgggtgtctcagtggggagaataaacaaacacatgtaatcatgctgctctcttaaactttaaagggttacatttagccaggtgcagtagtgcacacctatagtcccagctactcaggaggctgaggcgggagaactgcttgtgctaggagttcgaggctatagtgcctatgatcccgtgaatagccactgcactccagcctgggcaatataacaagaccccgtctcttaaaaaaaaaatactgataacttggaaatactataatgatacaactaaatggataatgtctataataacgatgtcatatagatatgcacacttttatgttacatgtgttaatatagtgtactttgtgaatattttattgtagatactttgcctacttactggactgttttatttgccattcataatccacttagaagtaaggcaatctagggatgatttttagcaactagtgttatagggatctttaaccagatctcaaattctttttcaccagctaagaaaaaatccttttcaaaagagcccctaaaaagtcttgtgcaactgcagtataggttctttataatatatgacgacttagtgttttagccaagatacaattttatataaagttaaatgtatttataattgtatcaataattataagcttaagtggaaatgaaacagattctgtaaaattcatttgggaatgaaacttcaatttttttaacaaaataaggaatatttgatcaaaacagatgaaacagaaaactccatcaatttcgttgaagttttctcacagaattttgttgttgttgttgttgctgagaccatgtcacccaggccagaacgcagtgatgtgatcatagctcacggcagccttgacctcctgggctcaagcagtcctcccacctcagctgcctgagtagctgggacttgcaggcctacaccactacacctagctaatttttttttttttttaaaggtgggtttttgctatgttgcccaggctggtctttttttcttttttcttttttttttttttttttttttttgagatggagtctcgctctgtcacccaggctggagtgcagtggcatgatcttggctcactgcaagctccgcctcctgggttcatgccattctcctgcctcagcctcccgagtagctgggactacaggcgcccgccaccacacccggctaattttttgtatttttagtagagatggggtttcactgtgttagccaggatgatctcaatctcctgaccttggatccacccgcctcggcctcccaaagtgctgggattacaggcgtgagccactgtgcccagccccaggctggcgttaaactcctatcctcaagtgatcctcccacctcagcctctcaaagtgctgggattataggtgtgagccacagtgcccagccccagaattttcttatataaatgttttaattagtatgtgaaacatcaaaactgttgccctttgtgtccactgttggccagaatggaccaagttatctacaacttgtctgttccattgactacactaaaaactctggacaagtttacttatttgttttcttaagtatctaaatgaggacaatgaaaagcaaactatagcaggcaattgagaaatgaagtgaaaacttgaatttgaataacagtgtatcatatgtgttcatttcatagagatctttttccctcctttgtctcccaggtttaaccctgcgggcactgcatagcaggtgcaggtagcaaacaatctaagagaaacctcttgtatctaaccagaaaagcaagaaaaggggccttttgctccaaaaccagttccatttgcagattacactgaaatagtagcagcttaggcaccaaaaaatctctagaaaatacccatatctctggctaggggaactagaaaatagagtctgttttccaagaaatctgaggtaaatcaacatcatttttctgtcttgccacttctactctgaaggtggtcccagtcgtggtgtaagtgcagaacattatgggagcccccagtaacttggcttttctagccggaggaactagaaggtgagacaactggaggttggaaaggcataggggaaattttgagagcgatataaaagatgcttcctaattctgtgtgtagatcaaaagaagtcctgggttcaaccttgcactgggctcaaccttgagcattgcatgcacagcacagacacaaagaaccacagcaaaggcctcaagaactaaacatcttaaaaaccaccatccaattcccagcatgtgctgagcagagacaaaaagcataacaaagcctttgaaaagtgaattaatgttggaactgctgctcaaagagggcaagatggaacttttagtctgaacctaaacgggttgagtgcctgctaaaacaaaaacattttccagagaatttttaacagggcctaaagtctctgcaatataatgtccaaaatgtccgggatacagtccaaaattactcaacatactatgagccacgtaaagctgactttttattaagagagaagataacagatgtcaagatgatctagatttcggaattatcagataagacctttaaagcagctcttatagccatgatccatggactaaagataagcgtgactgaaatcaatggaaaggcagaagtttttagcagagaaatctgctataaaaactataaaaaagaactaaatagaaattttagatttagaaaaatacaatattaaaagtaagtttatcagatgctcagtagctaagtggagataatagaggaaagagtcagtgagattgaagatagaccactggaaattataaaatctgaagaattgaaaggaagaagattggggagtcagaaaaaactggattgcagggatctgtgggacaataataaaaggtcttaaatttgtgtcattggtctcccagaaggaaaggaaaaatactgctgtaagacaaaatttgaagaaataatggctgggacttcccatgttaggtataataggttcaggaagttcgttgaatcccaagcagaaactaaaagaaaacaatatcatattgtaatcaatctgctgtaaatcaaagataaaaaatcttgaaagaagccagaagagaaggacacattatataccggggaacaaaaattcaaattatggcggatttcttcttagaaactatggaggacagagaaagaaaagaactatcaactatcaactcaccattttatgtccaaggaaaatatcctcaaaacagtatagtaacaagagcaaagtaaagatacttccaaaggaaaactaagagaatttgctgctatcagatctgcctcaatagaaatgccaaggaagttcttcaaggtaaaattaattataccagagagaaatttgaaattgaataatgaaggaagggcaaaaaataaaaataaatcgtcttttctgttttctcagccacttgccaaaagaaatgctaaatacctgggtaaatagagcagactgtttttcctctgctgaaattctttaacatatgtctatttacagttaaaaaaaattaacattgtcttgtagatagtcattgtatgttgatgtaatacatatggccaatataacagaaagggagggtaaggaagccaatagttaaaaagctgctttgttttactctgataatatagaagttgttatatatattttgaaaagttagatatataccaaccactacagagagggtgggtggagatactcccctaaatgtctcctatatataggactgataattattatagactttaataattttgtaaattaaatgagaatactaaacaacattcaaatataggttgataatctctaattcacagcgctccaaaatctgaaactttttcagcaccagcaggacgctcaaaagaaatagtcattggagtgtgttgtttttcagtttaggatgctcagtcagtatgtattctgcaaatattcaaaaatctgggaaaaaaatccaaaatctgaaacacttataggcccaagcatttcagataagggatacttgactgtcatctgaaaaaaatggagaaaagggaaaatagaagcatgaaaaacagacaatttaaaaacagatgataaaatgatagacttaaaatctaatcaaatcaatcattacactaaatgcaagtggtataaattatactaatccaaagggagatactgtccaatgacattttttaaaaaggatccagctgtatactctggataaagagagtatctgaataacactccactttaaagaatatcccagcagaatgtgtattttattcaagagcacatggaacattcacagaggtagaccatattctggaccatgaaacactccttaacaaatttgaaataagaatcagactggcatggtggctcatgcctgtaatcccagcactttgggaggccaagacaggtggatcacctgagatcaggagtttgagaccagcctggccaacatggtgaaaccccacctctactaaaaatacaaaaattagctaggcatggtggcatgtgcctgtagttccagctaattggaaggctgagacaggagaatttctggaaccctggaggtggaggttgcggtgagctgagattgcaccattgcactccagcctggacgacagagtgagattccatgtgaaaaaaaaaaaaatcatacgaagtatgttctcacatcattaagctagaaatcaaataacaaaaatatctaggaaatccctaaatatctagaaatcaaacaacacatgggccaagaaaaagtttcaagggaaattagaaaatatttccaattaaatgaaaatacaccataaaatttgtgggatgcaggtaaagcagtgcttagaggaaattcgtagcattaaatgcttttactggtaaaaaaagaaaggtcctcagtcaatagtctaaacttccaccttaggaaactacaaaatgaagagccaattaaattcaaaataagaagttgggaaataataaagagtagaaataaaaagaatgctatgcataactctacaacctaaatttgaggacttagataaaatggaacaactccttgaaagatacaagctaccaacactggctcaagaagagatagatagcatgaatgctcctatatctgttaaagaaattggatttgtaattttaaacttttgacaaaagaaaactctgggcccgtatggtttcattgacaaattctaccatttaaggaataaataataccaaattctacaatttctttcagaaaataaggaacacttctcaacttattctatgaggctcacattatcatgataccaaagaaaaaaacttagaccaatatcgtaagtatagttgtcaaaattttcaacaaaatactagcaaatccagcaatatataaaaaggataatgcattgttacgtagtacagtttattccaagaatgaaaagctgtttgaatatttgaaaaagtcaatgtaattcactaataatgacaaaagaaaaaaaatcacatgacagcaaacacacaataaatatttggcaaaattctgcatatatttctgtaaaaattctcagcaaactgagttgaaggaaacatcattaactgggtaaagggcatttgctagaaatctgcagttaacatcattcttaatgatgaaggaccttttgcttccctgtggaatcaggaacaaggtaaagacatctgattttaccattcttattcaccatagtactggaatttctacccagtgcagtaaagcaggaaaatgtcataaaagacatacagattctaatagaagaaataaaactatctttatttgcagacaccaggttgtctgtatagcaaatccgtggtgcctaccaaaaagctttttgaactagtgagtttggcaaggttgccagatacaggataaatgtacaacagtgaattgtatttctacatcctagcagtgaataacgggatataagtagtttataaaaagagtgccatttgtaatatgatgaaaacagtgaaacattttgccataaatctaacaaaatatatgcaagacatgtaagctaaaaactaaaacattgatgaaagaatgcaatgaagaactacattaatgcagagatacacattgtattcaaggattggatggcccaatattgtttccatgtaatttctccccaaacatatctgcagattcagtataatccttctcataattccagcagcatttttatagataacaagctgattctaaaattatatgaaaggcaaagcaattagaatagccaaaacagtttcaaaaataacataattggctgatttacactgcataattttaggtgttcctgtaaagctacactaatcaacactgtgtagttttgaaggacacatggataagtaagacagaatatagagtccagaaattcccctccacacacagggtgcaaaaacagttcagtaaagaaaaagtagcgttttcaataaattgtatagaagaattagccatatgcaaaacctttaacctacatatctcaagtcttttacaaaaactaactccaagtgattcagagacttaaatccaaaacctaaaacaacaaagctttttgaataaaatataggacaaaatctttgcagccttgagataggctacgagtgctttaacacaactccgaaagtgtaatccataaaagaaaaaatcagtaaataggacttgatgaaaactaaaaacttttgctctgtgatggatcctgttaagagaatgaaaactcttaacagatacagatacagactgggagaaagtgtttgaaaatcacatacctgacaaagtgcttttatgctgaacaccttaagaagttttaaactcagtgtaaacaaatttaacagttttttttttttaaatgagcaaaggatttgacacttcaccagagaacatatgtatgtgacggaaaagtgcatgaaaagatgtctgatatcatctattagggaaatggaaaataaaaccataatgcaatactactgtacacctattagaatggctaaaatcaaaagcaagaaccatgagaacatggtaactgcaagtactggtgaggatgcagagcaattggaattctcatatattgctggtgggaatgcaaaatgacacactgcctttggaaactagtttggcattttcttataaacatgcaattaccatatgatctagcaaatctacttctgagtatttacccaagagaagtaagaactgtgttcacacaaaaaaagctgtgagtgtgcatgtgtgtgtgtgtggcagatttatttatttattactcaaaattggaagtaacccaaatgtccttcagctggtgaatggataaaaatatccatacattggagtactactccccaacataaaggaatgaattattaataaacagccacatggatgaaactcagatgcattatgctaagtgaaagatttcagaatcaaaagactgcataatatatgatatcatttatgtgatattctggaaaaatcaaaactataaggacagagaacagatttgtgttttctagggcataagcaaggaggagggagagttcaactacaaagagacactacaaaggaatttttggaagtgatagcaactcttctgtgtgtttattttggtggcgattatgtgactgaatgcatttgtcaaaactcatagaactctataccaaaaaaatgaattttactgtatataaattaaaacataaatgttaaaaaagtggagacaaactcattttgagagactacagtgtaaaaagggagagagatttactattttatattttaagaattcagaacagttttctgttaagcctcatgtgcatgcctcagtatcaggcaaacacttctgttaactctgccaaggataataggatttagagccaaagggactcctgaaaattattttgtgcaaccccatcatttcataaataagtaaactgaaggctcaagaggctaattgtcttccaaggctctaaatgtagttactcttgctgctttctagattttctctttgtctttgtctttcagcagtttgattataatgtgactcgatgtgactctctgcatttaacctactcggagttcattgagcttcttggatatgcagattattatttatttatttttttttcaaattggggaagtttttacctatttttcaaatattctttctttaaacaccttggaactaatgagtctctcagcctgtgctgaaaggttctgtgtgcatgttgcagcttgccttcagcactcagccagtcatttgacatctctgccttagccttcactttctgcttacctagagcctcaggattaggcacagattagttagggccttctcatgctattctgagcaggctcacagcactaaacgtgtgtgaccttctaaacatgtatgaccttctagattcctgtgtatatgtcacaggtttttaaagctcttctgaatctcttagctctcagctagcttttcctttaaagccttttggttagtctattgtttgtcccaattattatcccctgtcttgggcatccatgaagttaaaatacttgcttctaattgttttagacaaacacatgccctgccttacatctgggagaaggcatttctcatggggctacttcacagagtcagattaaatatgacagttttataagtggagtcttcagggaatgattatttgggaattaggctttgaaagagcctcagctgtgttccaccccctctagtggctgccagatggtgccaagaattcaggctgttatttttcaaggctgccacagaggtggggagtggaaaatgagactagtaagttaaaatactacaaagcttgctgttcttacagaaattcagccatttttcttgaataaacacttccatggattgctgcaagccttgattaattgccagaatctgaaatggttgcttttgacagtttttttcccataggtttttgttgcttttatggaagagcaaagttttggaggttcttcaccatggtcagtgacatcatttcttggttttgctcttgccccctctttctttctgaagcatcataaggattagaatgatccttgtgttgatgagttctctttgtgacatgttgaatgatgctgtctgtggcacatccaggaaatgtctaattcacagctgagtttcggaatctggatcttgatgtagtcatctatttatagatgatagttaaaacaaagtggattaaatagcctaaataaagcatttataatgaaataaccaaagagcttctatatttgagttgataattgctacaggaaaaaatgaaaaatcactcattatgcagattggtgtccctataaattcatggtctcaaatctcaaccagtttctcagaactgcctatcaatcttagtcgtctttgtcagttttctcattaacttaattattatctaaacctccttaagtcttcttatatcccttgtcactccccttcaacctcgccttactctcagttttctacttaaagaaaattaaagcatgacttctctcaaattatcatctttccccccttattacaaccagccctccttatatgtggattcctcatcctcagattcagccaactagagattgaaaatttttgaaaaaataaaaactgtaaaaaataatacaaattaaaaataatataacaactatttatattagtcataaaagtaatctagagatgatttaaagtatatgggaggatgtgtgtaggttatatgcaaatactgtatgcaccattttatataagagacttgagcatcaaatgatttggggatctacggggtcctgggaccaatcctagtgtataccaagggcaactatctacttttacccccaggtaaatgatactggaaaatgtagggtactcatgaaaagactttagatattctaggccgcgtaggtaagaaagagtgtaggagggactgatagactgggagtaaggtaggggtgtttcaggaactacatggctctcagtttgaataacttgagtccttacattcaaaaatgattacagttaacccttgaacaacacagaggtgaggcaagtcaaccctcaagcatttgaaaatttgcgtgtaacttttgactcccctaaaacttaactactaatagcctgctgttgactagaagccttaatgatcatagtcaattaacacgtattttgcatgttatatgtataataaaccagattcttaaagtaaactagagaaaagaaatcgttaggccgggtgcggtggctcacgcctgtaatcccagcactatgggaggccgaggcaggcggatcatgaggtcaggagatcgagaccatcctggctaacacggtgaaaccctgtctaaaaaaaaatacaaaaattagctgggcacagtggcggcctgtagtcccagctattcgggaggctgaggcaggagaatggcaggaacctgaggggcagagcttacagtgagccgagatcacgccactgcactccagcctgggcgatggagcaagactctgtctcaaaaaaaaaaaaaaaaaaaactgttaagaaaatcataaggaagaaagaatatatttactattcattatgtggaagtgggttttcataaaggtcttcatctttgtattcaaattacgtaggaatttgaggaggaagagaaaggatcggtcttacggtctctaaatgccacacatttaaaaatgtccctttagtgggttgaattgtttcttccaaaaagatatgtttaaatcctaatcctagtatctgtgaatgtgaccttatttggaaatagggtctttgcagatgaaatgaagttaaaatgaagccatactggattagggtgggccctaaactcaatagctgatgtccttataagaggagaagacacaggggaaaagtccaggcaaagacaaaggcagggattgaagcagtgcagctacaaaccaaggaatgccaaggattgccagcagtcagcagaagctagggtgaggcaagaaaggactcttctctagagtccttggagggagcaaggctgggctgagatcttaattttggacttctggcctccagaactgtgagaaaataaatttatgttgttttaagccacccagtttgtggtattttcttatagaagcccgaggaaactaatatattaccttaatttgctcttgaaattaattttaatttataaatatggaggtatattatcaaatgacaaacttagaaatagcattagtaatttaaaaagtatgtttcatacattgtcatagcttagttttgagagtagcaatttgaaaaacagattataggcagaactctgacagttagataactgactcttgataggtgcttcagatacagaaagcttaaaagatctggtttattccactcatccattccaatctatcattccatttgaaatctcagcaaattttttccaagggaaattactgttaagaatattaaaatagtaagtagtcgaatgtagtttctggaacattgtatttaaatccttttaaaagactacattttcttaatgtgataaagcatggtattctcttagataatctaggcaaaaggagcattttttttcctatactcagtttattaaaaatttcttgggatacattgagattttcatgaagaaatgaaatttgaaatttgttcttgacgtactttggatatttgtaatgaagatgttttacatatcttgagccatatattaggtcagctataatttattgggctttaaattttttataaggttatatcatatgtaactagattagttttctattgctgccacaacaaattaccacaaatttagccgcttaaaataacacacacttattacctcatagtttctctaggtcaggagttcaaggggcctcagctgggtgctctgctcagtttctcacagagccaaaatcaaggctttggcaggactgcattccttactgaagaccctggggagaaacctgcttccaaagtcgtttgaattgtcagctaaattcagttcctttctgttgtagaatgtaggtccttgtttccttgccagctggcagttgggagcctccagtgtttacacttggaggctgcccacactccttctcatactgtccatgtggccccctccagcaacagcagggcacgtttcccctcactattctaatctccctgattctagctaaagaaagctcttcgcttttaagaattcatgtgattacattacgcactactggataattcagaataatatccctatattaagctccataactttagttagatctgcacagtcccttttaccatgttacttaatgtgggaaacacacattcgcctgtctgaacccaaagactgcacttggagacacaaagaacagcaaaagcgagacttttaatggtggtcttgcaagatggggcgtatggtaggcaggcacacccagggcagttacagcagttaatttacctcctagcatgcaaatccctcccctagttcctcataggtcgagtattacagggttacaatcttcccggacatcatccaagtttcattatccccctaataagggtgtaatcttcccttccctgcttaagtttcgatttcccaataatgaaactttcttcgcttttatgggctgaccccttctctacattctgtttgctcattgtgaccttctaggtgcgtgagccgtgcagtttgttacatccgcaggctggttgccagtatatttagatttatcatgccttgaaaatagatcatttaaaacattttctcacaaagtccctcctcttttctgtttacttccttcggtctcattttcatctaaatcctttttgtccttgaattgctctagaagtcttttactttctccataggagattgagtttaattttgtttctaatagtaccaggttattttgctggttaagtcatgggcatttgtttattaatagctgttttaatctctgtgctagtccccccacacaagggttaatacaaaaatcccactgctgttaagacttctgccacaattatgagagatgtaaggattgagggctaccatgtctttccattttccaaaccaatcttctagccaacccataaatgggtcatcaattccagcattttctgccagttcattggctagagttgttggtcttcgtaaagcttttctgatggtcccatctggggcagtattgttgggaatgaaagtacaacatttcccacccagcataacacatacgccccctttttctgctagtatcatgtctagcgcaagcctgttttcccaggccatttggctgatggcatttagctggctagccacccctttgaggatgtcccgagtataatcgatgaatctctgttgattataatagatgtagttaatctagtccacattcttaatagttgaccaccagaagagtgctgacttaaaccgagctgctatttggtttcgggccttaaattcattaggcacccccccccccccggaactcctatagagttaacatatatattgggatcaaaagatacgtcaaatctctccggttttggtagccgtgtgtattttcgggtatcttatggaataccaggatgaagggaatggccaactggactaaagcacaagtcccagtccaattggacggtaacaacttatcatccttttttcccacagtaccaccagacatcagccgtggtgtatggagagctgagtaattgccattgcctgactcaacctgtgatgcttaggatgtgggtacaagttgagagttctcccatgggcttattgaactctgccccctgcctggagaggcaagaggagtagttcatattccctgtagagaatgaggggttctgacctctctccacaatgcgggaaagagcaatgacagactcttacaagtctcattttcccatgcatccttgtctcggtatagagccaacatgcaacacattacttcaggatcagtattccatcctaggggaaatggaaccacccatgcctgaggtcctcccgcagcacatgcatagtagttactcttgttgagggcttgtaccaaaaatgtgacccactcaacccaggcattcacatccccataccctcagtttttaaggtttgctttacatcctttacctcaattatttttagccttttaggatcattatttggtggactaaagtgtttactagggcctgggcttggagtagtaccagacacttggggggttgagtttttgatgagtttgagaataaatcgccctacagggtctttccctgtgatgtctgcccctaacccatataaccaagagtcttccagaactggggccagcccatgttttctttttagatttttctcagagttaactttaagggttccttaggtgacccatgcactttccactggtcttttcccctcctttccagggtctcctttaccagtcccttgactcgagtatagtgagtccacctcatgcagctgttcgcatggctgtctcagtggtcaggagcacttgatagggaccttcccagcttgggtggagcttgtcttctttccaagtcttaatcagcaccaagttaccaggctgaaagtggtgagccatgaactcaagaggtgaagtttgagttagaagtcgttttaacctaagggatgacagggtggagtatatggccactatataatttctttaaaaattgatccttggtttccatagccggaagatctgtagctctgcgcaaatataggagcccatataatgactcgtagaggggcaatcccaagtcttttattggtgcttgttctaatctaaggaatgctattgggggacatttggttcaaggcattttagtttttaagattagtttggtgatatgctttgtgagagtttgagtcattctttctactttccagaggaagggagatgccaaggggtgagataatcccatttaatttgtaaaccttccataattcaccttaacacccttgaggtaaagtggcttccattgtctgaattaatattttccatcagtccaaagctaggtgaatctgttttaatattattttgaccacattcccagcagtggctgttggaaggggaaaggcttctacccagcctgaaaggtaatctaccatcaccagtaaatactttagtcttcctactttgggcatttctgtgaaatctacttgaatgctttgaagtggtcttactccggaggtcttcctgttttctaatcacctttttgtttatcttttgacaagttaacacaatttccacatgcttgtttagcaagggtataaatccctatacacccataattcctaagtattgtatcacacaaagcctggggtccccattgactccatttgtgtaatgtagatactagttttctcattaggggtttacttatttcaggaagtacccatttgccatcttcagtctgagtgacccctgtcctgtctaattcttcctcctcctctctggtaaactggggccttaatactagcttagggatgtttgggagcaggctacatagtctaatttcttcgtccagggaggcttgcttagcagcttcatctgcaagcctgtttcctgtagcttctatagtgttccctttctgatgaccatttacatgaactatggctacctctgctggaaggaggaggctttctaaaacctgtttgaccagttccccaggtaccaattattttcccctgctatttattagaccctgctctgtccagattttttcaaaagtgtgttccaacccattaagcatatttagaatcagtatatatagtgccttctttggctttaaggagctttatggccgggttaagaccatataatttacagatttgggctgaccagccattaggtaatctacctttctcacatagggagtgtttatctccatcagtgacagcattgccatctctcgttcgtcacaactcatccacaaagagccttatcccatcatgtagtggagcttccctaaggtttggtcctactttggtttgttattctatgatatctaagcagttctggtctgatgtctttgatctcctctcctttccataggaaactggctgcatttaggcaaatatttgttgttacaagcaaataattttttttcttaataatatggcttcatattttatgaagaacgtgttcaaactatctcccggcttttggtttaatatattcctgacctggtgtggagcgcttactattagggccccaacaaaggttagctttctactctcctaccagcagggctgtggcagcactgcttgcacgtatttgggccacccctgagagacaggatcgagaagcttggaggcaaaagcaacagattccctcttccctccccaggtttgagtgagcaccccaagggtgatccactgttaccaacagatggaatggtttctctaaagatgagaggaccaggaccggggctgtaatgagggcccgctttagctcttttaccacctgaatttcctttgaggacaattgcaagggattgggttcttcttttagtaacttgatatatagagtctttgtcttttgatcatatgagtcaatccataacctatagtagccagttaaatctaaaaatttttggagttctctttttgtcttaggcaaaggcagacccactattcccagtattctctctgggtttattcttcacatcccttcactaatcaggtgtcctaaatatttaacttctttttctgcaaactgcagtttgttcttagatactcgcaatcccctttctcctaggaaattaagcttgtggtggtttctgatacctcggtcctcctctccccagaaattaaaagattatctatgtattgtaacaactgggttcccctggaaggttgaaattcctccaggactttttctaagatttgaccaaatacgtttggggcttctgtgaaaccttgtggcagcacagtccaggggtactgttgttttctcctagttatagcatcttcccattcaaaggcaaagaggttccctaatcctaaagtctaggggacatgcccagaatgcatcatttggatccaccacattgaaccacttacgttcatagggtatcttactaaagagggtgtagtgtttagtcaccacagggtggtaggtctggacagtttgatttatagcccttagatcttgtagcaatctatacaacccatcaggctctttgggagaattggagtattgtaacatgcagggttttaattgtccatcgttaatcaatccctctattaccagttggagaccttttctcccttcagtggaaatgggatattgttctctgcaaactacttctggttgttttaggttaatctgtaagggtgtgatttttaaccctctgttgccttccctaaccctcacaaggggatttaatttttctttcctcctcctctgtcaggaggcccatcattacttttatttgtccttcctctattcctaatcctaaacccaatctcacaatcaggtctcgacacaggaggttagttcctacttcaggaacaagtgacgcctcaatttgttttgctcctgatgtaattaaaattttcttaaatattggaacctgaaatccctccccttttacccctgatactttcaatttttccttagagagttctgtagcccttggttggtgaattagggaggagtgagctgccccagtatcaaccaaaaatgtcacttctccctcaggtcccaccttcaaatttattaagggttcctggtgggatctactcagaaggtgctcctgcccccgactagtcttcatcaatagtcatgaggggtatcaccttttcttttttccatttaggacatcctctcttcaaatgccctgtctttccacacttgtaacatccactcatagtcttaggaccttttccctgcatttcccttctttctttgtgttgaaatctataattcccttgtctcctaagtgggggatcttgatgtaagtcttttctgactacctcttccacagtggaaaccatgatttttgctttttgtttctgcttctcttcctttctccttacaaagaccctctgagtttgcctcagtaaatcctcagttggtttctctttccatccatcaatcttttgtaattttttggtaatgtcaggccagctcttaattacaaagttaaccttcaaaaggcattgccctactgggtcctctagatctaatccggagcattttctcatctgatctctgagcctatataggaatgcagaaggagtttcctctttttcttgttgaatcgtgaatgtgtcctatgtcctacgagtggactccttgatccctttaattattagttcctggagatcctacatttgggcgcagtccctgggatcattattatcccattcaggattaacatttggaaatttttgtttggctggtgagacttcttgcctgggagggtgttgcctctcccagatggtcatgtccactctcctgatcattcccctttctcttcctatgaataggatattcttgatggacatcatttcagcccaggtgtaagagctgtatcctaggaattggtccagatggtctgctaaaccgagtggatcttctaggagtggtttcatttttttcctgaaattcctaatttcaatacttgcaagaggagcatttacaaagccagtctctccctgtcccatgggaactcccctaagagggaacatgctaggtgcctgctgtgtggaaggaatagggaagttctcaatatccctcttacagtgttcttttcttaaatttggataaggatttagaggagcagttggtttggctccgccatggtgtccaggtctttcctcctctaaccctcctgctgccccttgattttcctgtcccctattttgtgagatgtatggaggggcatggatgatagggtcccagggcttttccctgggtgagggatttttactaggctctttttcttcttctttaagtgggaatatggggctaattccttgatccagcagagagcataacctgtctcttgtgaggttggggttttattattcacatagagaattaaagcttggcacacctaatttttatctgagccaaacttaggccataggactatgctggtaaatgtcagagggagtctctttggctccctctttcccttgtcccctaggcctagaatttctgtttcccatttttggtcagtctgtgtctgagcttttccctgtgttctcagcaccccctactggaggtttcttgcacacccatggaatcacttcatccattctctggccattctttgtccattctcctcacgggagaacggaaccatggattgggactctgcacttgcttcatatctagggtacatctcagtcacacacactcaacctctgaaaatgcccaaccaccaagacagtacttacagtccaattttcctcccttggcttctgcacgaggttgcctggttgctgcagtgcctgcttttctccctgtgtcgcctctgctgcctcctgaataacagtctcaggtttgtctgtggcttctgtggggagccaggatgcccggacagagtgggccacccaaatcgggtgggacacctctgccctctcggctggagtcccactccatgcaggcacagagatcccagacaggcccccaggtttgtgagaaacacagattcacctgtccaaacccaaagaatggacttggagacacaaacaatggaagcgagacttttaatggtggtcttgcaagatggagtgtctggtaggcaggcacacccggggcagttacagcaggtaatttatttcctagcatccaaatctcactgcaacctccaccccgcctggttcaagcgattctcctgcctcagcctcccaagtagctgggattacaggcgtgcatcaccacgcccagctactttttttgtatttttagtagagacagggtttcaccatgttggccaggctggtctcaaactcctgacctcagggtccacccacctcagcctcctaaagtgctgggattacaggtgtgagccaccgcgcccagcctaaatacagtttgtttgtttttttaagtaggccactgcctccacctttgtacagagaaatcccaggttcctcctgtcagaacctagctagaccctggaataagataccaagaccaggcttgccaactgtggcttggcatagagtttgtgtttgacctggggtcagggccttgtctacacactttttttttttttttttttttttgagacaaggccgtgctctgtcatccaggctagagtgcagtggctcactgtagcctcaacatttgcattacatgttgatttatataattaatggatggtgttgcttattatcgattgattgtgaatctggccacgacaaatttattctaattgtttattttctcagattatttatgtaaatagtaataactgtaaataataatctatttcaatttttttcttccagtgattgtacctcagttcattttactgtcttatatgttggcttcgtcagaatgtttcatattatgttgaaaatagtaatgatatatataatagcattcttatcttgttcctgatgtataaagtaatagttcagaagtttctccattaattatatgtaggggtatagcaggtaaaagaaataaatttttattcctggtttgccaagagctcttatcaaaatgtgttaaattttatcacactgtttttatgcttctgttgaccttttttttctctcctttaactttatggaatcttaagtcatacaaagtattttatttttgtgtagtcagatttgtctattctctcttttatagtttctaaataacctgttgtactttttaaagtaccttcaaactctaggttatagaaatattttcctttttttttaatacttggttttaaatctttgtagcatgtatcttggtgtgtggtatgacatggaggtgcatcttctttgtgttacttcagatggatgtttaatacaatattgtattgagtgcagtgctcctgtaagttttaatatttgtttgtaacaataataaggaagactaatggttttttcaaagtttactcaaaagtaaaagcacacacgtaaagaaaaagagaatgtaaagaaaaagagagaatatctgacgtggaccaacttgagcctatagattttttttattggtaagtcaaaagcagggccaagaaaagaaattatccaaattgaattttctcattatattagtctgttttcatgctgctgataaagacatacctagactgggcaatttacaaaagaaagaggtttaattggacttacagttccacatggctggggaggcctcacaatcatggtggagggcaaagaggagcaaatcacatctcgtgtggatggtggcaggcaaagagagaataaggaagacacaaaagcagaaatccctgataaaactatcgtatcttgtgaggcttattctcaagaacagtatggggaacccacccccattattcagttatctcccactgggtccctcccacaacatgtgggaattatgggagcacaattcaagatgagatttggatgaggacacagagccaaaccctatcacttattacccaagttttatcagactgggaaaacaacatttcagtcccttaagtaacaattttagagggaagatctacggctaacagttattcattgtgcacatcaggataaaccagttaaccaaattttgatatgcctcatttattatacacaaaaacaaaaaggcctttttgtttttagttaacattaaactagcttttattccaaaacaaagaagtcggtccagtaaaactatcttatattttgaagaaaacatatttaagaattgctttggacaacagaaactgttatcttatgaaacctaaaaactttattaaattctgaatgtagcatgtgcctgcctcccatttttgccttgtaaagaactcagtatgctattaaattattaacttagtttatttgaaatagttccaagatatttcatgcctccaagattaaaactaaaacccaggttagcagttttgaagaagagtggacatgagccttgaacattatatatatttgttacatctgatagagatattttaaattgtctgctaaaaaccctcttgctttgtagatgggaaaactgagagttccagtggctatttacttgctccagcttttatttccagttcatagcagaagcaggacttaaacttcaggtcttttcgtctcaatcacatggtctttctctttgcattgtgtatttgataacgtttttaaataaaacaaagcattttgcaactagtgaaactgtacaaaaagtcatataatgtgaccagaagggagattattaaaaattataatttcacttaagcaaaatgtgtataacgccatttactgtttttctatgtaggtgaaaagagatttgaatgcccggaatgttctaaaaggtttatgcggagtgatcatctctccaaacatgtcaaaacgcaccagaataaaaaaggtggtgggacagctcttgccattgttacctcgggagaactggactcatctgttacagaggtgcttggctccccaagaattgtcacagttgcagccatttctcaagattcgaatccagcaactcccaatgtttcaaccaacatggaagaattctgaaaagttatttataacagagacctctagtgctgcacttgtttacacacctttgaaaatctggaaatgggctggtcaagtggattacagagtaggaaattatgttttcattcttggcttctttaagtattccagggtttggggtcaacacgtgaagtgttgaattttaaaaaatacaaaaagcagactgatgtactggaaacagaaaagtatttcctccatactataagttgtagttgtttggaaatatatcacataacctttatacagaatcttcccatctcttaatatcatgtgttaacatgtttaaaaagaccttagtagtttgcaggctggaccttaattggacttattttctttgaaagtactttgttataaattcagtcagtaataatttacgtgtattctttttctctatagcacagaaaacagatagttaactgatgatagggataatactgtatttccttagcttgatttttggaaaatcaaccgaaaatagtttggccgtcttttctaaatgttagaaattcttcaacagttgaattaggtaagttccaaaacagtaatctgagatgcatctcagatctttattaccactacattatagtagtgtgtatgcagacaatcagtgaagtccaattactttctccatttggagacacaagaggaacatagagttaaatcttaggttaaattttaggttgacaccttaggaaaatgctgggaaaaaaatggttaaaacaaaactcatcatagcttcagaaaaataaaatgaggcatcttaacatgcaatgttctaaagttaggattgattatattcctaaccctaggttgaaccacaaaatttcatttaaaatgtttatatttggaaatatttgcatagagtgtaaattgttctgtagtttcatattttgtaaatatgagttatgttgacaatgtgcagaattctttatgctttgatgtggtagccaaagaaagaattacacttttttccaaggccagcagaaaattctcttttaactacattgtaattcttgttttcctctactaaaaattggccagtcccattttatttctagtgctatgtaagaaggtaattaggaattataacacagtaatgtttttatgttacatcaataactgaattttccctaaaaattagcctaatatataatagatatattatgaagcaaaacttttatttttgaaaaggcagaataattttcagtgaagtaagtgactaaagaaaaaaactatattattgtttatgcaagggtcttacaggaaagggtctttttttttttttttttgagatggagtctcgctctcttgcccaggctggagtgcaatggcacgatctcagcttactgcaaccgccgcctcccaggttcaagcgattctcctgtcttagcctcctgagtagctgggattaacaggcgcctgccaccatgcctggctaatttttgtatttttagtagagacagggtttcgccatgttggccaggctggtttcaaactcctgacctcaggtgatctgcccacctcggcctcccagagtgctgggattacaggcatgagccaccatgcccggctaggaaagggtcttactaggaaagatggccaaaagtttcatatgaaaaaaattggattataaaccagtaacttaaatattaataaggatattttatgttttaaaaaagtatttacacagaatcataatcagtgaaattgaccatttgaaaactaaaagtttttacctacctgctcaatttattaacatcattgctttggggactgtttgaatataggtacgtgttttcttgtgcattctctataatttcaggaaaagtactaatgcgaattctcttccaaaattgtgatgtttcttgtatttttgatgaaggagaaatactgtaatgatcactgtttacactatgtacactttaggccagccctttgtagcgttatataaaactgaaggtcttttgtgctttcagtttgtataaaaaagctttgagattaaaggaaaaaaaaaatttttacactgtggttataaatttcaagtttcttaaagcttttgtagacttgtaacagagtctttaaatttaagttggattttgtaaattgttttgtatattttatttaatgtactcttaacaactgatgtatctggctttaaaacatcagaattggtttgttgttttgtttggtacagaggagcatttggtagtgttcattttaattttattatataggagctgaaacatcaaatatatattttatctatcattatgctacacaatcagtgctataaatttttttatgcaaagaaactttcttaatgttttaatcatgtttcctcagagtgacactttttgttgttgttaataccaagtatgaacactctgcatcattattccatgaaccagttctaatgcaaacctatgtatgtccattagaaatggaagttattttttaatcaacaatgaggcctattataaatttatcagatgaatctagatagctttatagcatataaaatatgttaatttgtgttagcaggtgcacatttcaccactgaaattagaaatattttgacagtctgttctgcataccattctgagtctacttttctgtctttagaagaatcgtaaatttcagtgtcctttatttgactcagtgggatatagctgttataagtaatagggcacagatgtgcagtagagtcttgtttaatggcatttcactgttcattccctttaccaccgttataaaacttttctttattgtaattatcagtgcaaagctatgtatttatcatggtaaaactccagtgttagaatagttttttcttacagtatactttctttggttaggtttgtgtatgtgttgctgattacattagaacttgatgttaagtcatttatcacactctcatgagagcagtaataaaagtgtgtaatctaggagaaaaagttaatttgtcaaacttagataagcatgatgtttaggtcctatttttcaattttataactgttttattgcaacaatatttgtatttaagtctccattttaatgccttgtggtgtttttttatgcatgtcactaagttgtcatcccacataaattgatgtgcagcatagggtattaaatctacataatgattttaaaacagaaatagttgatggtaaaatgtaaatgttttgcaaaaattccttataaaaagttttgtagtaacatttcacttgtaaattttttttgtaa

SEQ ID NO: 345 - DNA, 358354 bp, Homo sapiens
ccggcctcgcgttccctcggacggttgcccaatggcagcccaggtggcagcccgggaggcgcgagacttcagagaagccccgacccttcgcctaacctcgggggccggcctggaggcagtgggcgctgtggagctcgaggaggaggaggagaacgaggaggaggcggcggccaggagagcgcggagtttcgcccaagacgcgcgggtgcgcttcctcggcggccgcctggcgatgatgctggggttcacggaggagaaatggagccagtatttggaaagcgaggacaaccggcaggttcttggggagtttctggaaagcaccagcccggcttgccttgtgtttagcttcgccgcctcggggcgccttgcggcttcccaggaggtaagaggcgacgggcaaggggacctgcccatccaacaaaactacccaggggagacagcccagtcgctcccctttggattcccgcggggcgctcactcgggcactttaacaaacttggcttgaagtccccatcctgaggcccgcaggactcctccccacgtgcacccactctgcagttcagcagctgcaggttagtttcctaagtcagcagtttgtatctgaccgagaatcccgcgttgagcctgttcgaccaggataacccaagaacaccagcgctttctttagctgcttgggtgttaggcgccaggtgggctttctgtgccaaaaaacttgcgtttcagttgctcttgggtcactctggagtcacatcctttaaaaaatggggtgtttggcagagcgcatgtaactcgtcacgtattttgattacgtgccaacaacacttcaccccaggcaaaaacattaagtccttaaaaaggaaggcccctgcaatctccgcacacatgggtgtttactgaacatttagagggaacagttccctcctttcttctttttcttccttttctttttgaatttcgatgatttgtccactaaaaggttaacgtatcacctaacgtacagcacttgtatttagtatttttcaagtatgatgagtttggagcaagattcacaatttttaagtagcgcaatgctcagtttaacatgttatgtcgttttatcactaggtgtggtcattgtaatagttgggaaataggatctcagagaagaaagagtaataggaaggctgccttatggtattgtgaattttgaattcttttgttttaggactctcctaattgtaactttaaaaaaaataagtttgtcagtagacaaggcgatagaacacaactctagtattacctaagttaaatagttattataatgttcaatggaatgactcagtagttgtggaaatgttagcatgttttggttatacggttctattctttgatagaaatacaaattaacctcttgggcttgtctttatctcagtttggcttatttccaaaccagagaagagtataaaaaataaccctttaggattgaaacatttctacatgcctacgtgctccttatttgtttttagttataagattttttttttggtgtataatgaactggtataattggcatgcctttaaaaggtgatatttccacaccagtaatgctgtgaaattagcattataaaagaacaaagaaaactgtatactcgctgcatactagggaagagccgtagaaggaccttgtttatagggcaggcaagatgccaggttttgtttcttctgctagcaatacagctacaagttggatatagtaaatcctgcttgttaacaagaaaactacttgaactaattatcttgctcttgttttagattccaagagatgcaaaccataaacttgtttttatttccaagaagattactgaaagcattggagtaaatgacttttctcaagtggttttatttggagagttacctgcgttgtctcttggacatgtatctgctttccttgatgaggtactggtctgtctttaatatttaaagctttcacttatctccatgacatttgaaattatttaggacaactccgataattaaaaaaagaagagctaggaggggaagggaaggggatgggggtggttaaaaaaaaaaaaaaaaaaaaaagcttgtagaagccaggagtctctagccaggtggatggagtcataacatctagactgttcctgaaaggagctcatgcttactgatgctaatattcaacaggtggcaattgcagggatcattctctccctttcttccttccaacacaatagaagcaaataaaaagcaacttgaataggttcttgcaccttagcagcaggttttaagcttcacattcagagtagagacaaatttacactttgaaaatgagtattatcagttcctttttatacttgttagaaactaacagttaaagactaagattcactcatggcagataatgggaaaaggtgatgaaagtgttagaaatggttcttaaactttctttttctcctcttaaaatagagaaatagtcttcaaccaatgttactgacactttaatgtgcataagaactgcctggggattttgtgaaagaggttggttcattcagtctagagtggagcccgaggttctgcatttctaacctgttgctgatgctctttgtttgtggactagctttgaagaacaactgccaaataaccaggttccatggaactagaacctggctctcaaacttcgctgaacattaggatcacctgggggaacttgtaacacaatgccccaggtcacacccataccagttaatttagaacgtcctgaatgggagccaagtagcagcagttgttcaagattcccaggtgattctaatgtacagtgagctttgggagccactgggttagatatctgtctacaaggccaatttctaaatcagacctctgtaatcagtgtagtcctgccaaggccgatatttaaggtaggaaaaatgctgacatatttattgctagttatttaccagtctctcatgatcacacctcttctactttttgagtctcttcttctgtctttttgaagggaggtattttcctgctggactaaccaaagtctctcacccctaactcctgtaccctgcctgggtttcccttcgctcctgttgaatttaattggctttagctgatttcagggaggtgctaggaagacaatcttttaacttcagtaccaggaacaatttttggtatgcagcaggtgctcagattttaattgaactgaatctgatgactttggttcaatatgagaatctagaccactatcaactggaacttggaggggcagggctacactgtgaaattcttgctctactatctgtgtctggcaacagaagatacaagcctttttcaaatttctctactctttctctcagtaccaggatctgcttaatattctgaaaaaggtatgcctgctcctcaacattatgatgtgtttccataccagagtgtattatatatttatacttagccaaagtatataaaatgtcatatggttatttctttatgtatcacgttggcccacatttcaaaagaaacaataattgtgaatgcttaccaagacataaagaaaatgtcatttggttcttctcagtcaatatctgggccccatccttggaaattccaatttaaaaaatctagaggggcctgggcttctgtattttaaaagtgtttcctcagtaattgtattgaatggtttaagaactgtcataaagagaaaccccacagtttgaaaagagaaacagaaggtaagtaaagagatccacagcaaaggcacacttgctcttttatctataggtgtatatgtccttggtgaaccttactttggttcatagagaaagtttatttttcttacaaatgcaaaaactacacaaactgacaactaaaataagacaaaacctcaaattaattgacttactttgtatatatttaataaaatttattgtaattaataagtacatcccaggtctatttgttttaaacgatatttctagagatgctttagctgtttgagttacgaattgctttccagagcatgtggctcagaatttcgtagtgttttatccacagctcatgacacagacattaagttttaaaagaagttggctttgtcatggaataatgtgagaaacacatttatccttccaaacccaaaggatggactcggagacacgcagtacagcagaagcaagacttttaatggcagtcttgcaagatcgggtgtttagtaggcaggcacacccggggcagttacagcaggtaatttacttcctagcatgtaagcccctctcccagttcctcagtggttgagtactatggggttacaatattcctggacattgcctaagtttgcctggacatatgccccttataatgttataccctggcccccttcctcacttaatttttgatttcccaataacgaaactttcttcccttttatgggctgactcctcgtctacattctgttcctttatcatgactttctacatgcatgagccatgaggtttgtcatatcctcaggctggctgccagtacttagatttatcatgccttgaaaattgaccgtataaaatgttttctcacaagttccctcctcttttctatttactttctttggttttatttttatctaaacccttttggttcttgaatcactctaaaagttgtttacttttttccttataggagagcaactttaatttggtctctaatagtagcagattattttgctagtaagttatgcacatttgtttattaatagctatttttgtgctagtccccttacacaggaggaatacgacatcccattgctgttaagactcctgccacaattatgagagatgtaaggattgaacctatcataccttttcattttttaaagcaaccttctacccaacccattaatgggttattaatttcagcattttttgctagtttgttggctagggttgttcttgtaaagcttttgtgatggtgccatctggggcggtattcttgggaatgacaacacttcccacccagcataacacatacaccccctttttctgctagtgtcatgtctagtgcaagcctgttttctcaggctatttggctggtggcatttaactggctagccacccctttgagggcgttcttagtataactgatgaatttttgttgaatataatagatatagttaatttaatccatgtttgtattaatagttgaccaccaaaagagtgctaacttaaacccagagctctttggttttgggccttaaatttattaggcatccccctagggacacctacggagttaacatatatattgggattaaaagaatttgtcaaatatctccaattttggtggccatatgtattttcgggtgtcttaggaaatgccagagtgaaggcaattggactaaagcacaagtcctgatccaactggaaggtaacaggttacagaggttccttttcccacaataccaccagacattagcctggggcacatggaaagctgggtaattgccattgcctgactcactcgtgatgtttaggaagtggatacaagttgagagttctcctatgggcttattgaactctgccccctgcctagagaggcaagaggagtagttcatattccctatggagaatgagggaattgctctgggatctgacctccgcaatgtgggaaagagcaatgacagacttttttttttttttgagacggagttttgctcttattgcccaggctggagtgcaatggcgcaatctcagctcactgcaacctctgcctccccagttcaagcaattctcctacctcagcctcctgggtagctgggattacaggcaccactgtgcctgtctaattttttgtatttttagtagagacagggtttcgccatgttggccaggctggtctcgaactcctgacctcaggtgatacactcaccttggcctcccaaagtcctgggaatacaggcatgagccaccgtacctggccaatgacagacttttataagtcttatttccccatgcatccttgtcccggtatagagccaacacagtgcatttctttaggattggtattccatcctagaggaaacagaaccacctgtgcctgaagttgttccacagcacatgcataacacttactcttgttgagggcttgtactgaaaatttgacccaggcattcatattcccatactctaaggtttgctttaaatcctttaccttaattatttttacccttttacggtcattatttggtgaactaaagcgtttattatggtttggggttggagtagtcccaggcaaatgggggggttgagttttttattagtttgagaacaaattgccctaggggggtttttccctgtggtgtttgcaccaacccatataaccgagatgctacttttggttcttggtttagaagagctggattctcaatggtgatgagtataggattgcgttttaaattctggcagttacttggtggggagcccttggacagatgtaatttattctttaagggtctccaggctggagttacccaccccatgtttactgtccaaccctgcaattgggtagtccaccatatagtatcccagctggggcagggtgatattctactataacctgtatttggttcagggaaaagatatgtatccacttgagagagctgtttctgattttccacattcccacaaggtaaaacctggcaggcattaaatcttatagtttggggtgctaccgtcttggttacattaataagcaacctgattgagtaggggggagtcccctgcccgtttccattttgacctgctctttgtatagtagcccatcccagccatattaacttccaaaatggagccagcccatgttttgttgttagatttttctgggttaacttgaagggttccttaggtgacctgtgcactttacattcgtctttttttctcccttccatttttttttaaaccactcccttgacttgagtatagtgagttcaccccagtttagctgtttgcacagccagctcagtggtcgggagcacttgatagggacctttccagcttaggtggagcttgtcttctttccaagtctggctcagcaccaagttgccaggctggaagtagtgagccgtgaactcaagaggtgaagtttgagtcagaagtccttttaacctaagggatgacagggtggagtatatggccagtatataatgtcttaagaattgatccttggtttccatagtagggagatgtctagctgtgcccaaatataggatctcatataataacttgtagagggataatcccaagtcttttcttggggctgttctaatcctaaggagtgctactgggagacatttggttcaaggcattttaaagattagtttggtgatatacttttggagagtttgattcattctttctacctttccagaggaagggggatgccaaggggtgagataatcccatttaatttgaaaccttccataattccccttaacacccttgaggtaaagtggctcccattgtcaggattaatattttccatgaggccaaatctaggtacaacctgttttaatattattttgaccacattcccagtggtggctatggaaggggaaaggcttccacccagccagaaaggtgatttacgattatcagtaaattctttagtctttctactttgggcatttctgtgaaatctgcttgaatgctttcaaataatcttagtcctggaggtctttctcccatggcctgttttataatcacctttttgtttgtcttttgacaagttacacaacttccacatacttatttagtgagggtataaatccctatacacacccataattcctaagtattgcatcacacagagcctggggtccccgaagactccctttgtataatatagatattagttttctcatggagtttacttatttctctcccatcaagaagtacccatttgccatcttcagtttgacccctatcctgtctaattcttccttcttctctctggtaaactagggccttaatactaccttagggacgtctgggatcaggcttgtcttctaatttcctcgtccagggaggcttgctcagcagcgccatctgcaagcttgtttcctgtaggttctatagtgttccctttttgatgaccatttacatgagctatggttacctctgctggaagcaggaggctttctaaaacctgtttgaccagttccccatgtaccaattcctttccgctgctatttattaggccccactctgtccagatttttccaaaagtgtgtaccaccccacaggcatatttagaatcagtatatacagtgtcttcttgggctttaaggagctttagggcctggttaagaccatataattcacaggtttgggctgaccagctattaggtaatctacctttctcacacaagaagtgtttattcccataaatgacagcatggccattatgtctcttgccatctatcacatgggacgacctatccacaaatagccttatcccatcatgtagtggagcttccctaaggtttggtctaacttttctttggtattctatgatatctaagcagttctggtctgatgtctctctttttctcctctcctttccataggaaaccagctggatttaggcaaatatttgttgttatgagcaaataatttttttaactactatggcttcatattttagagtctgagaatctgttaactatctcctggcttttgacttaatatattcctgacccagtgtgggttgcttactgttagggccccaccaaaggttagctttccactctcctagcagcagggctgtggcagcactgcttgtacacattcgggccacccctgagagacagaatcaagaagcttggaggcaaaagcaacaggttccctcttccctccccaggtttgaatgagcaccccaagggccgcgccctggtccattgtcacatacacatggaatggtttctctaaagaagggagggccaggaccagggctgtaatgaaggcctgctttagctgttttactgcctgaatttcctttgggaccattgcaaggggtcgggtttctcttctagtaacttgagatacagaatctttttttgagcatgagttaatttattacatacagtagccagttaaacctaaaaatttttggagttctctctttgtcttaggcaaaggcagacccactattcccaatattctttccgggtttattcttcgcttccctttactaattaggtgtcctaaatatttaacttctttttctacaaactgcaatttgttcttagagacttgcaatctccattcgtctatgaaattaagtaagcttatggtggtttctgatacctcggccctcttctccccagaaattaaaagattatctgtgtattataacaactgggttcccctggaaggttggaatttctccaggaccttttctaagatttgacgaaatacatttggggcttccatgaaaccttgtggcagcacagtccagcggtaccattattttctcccagttaataggattttcctatttaaagacaaagaggtctctgctcctgaagtctagggacatgcccagaatacatcttttagatccaccacactgaaccacttatgttcatagggtatcttactgaggagggtgtaggggttaggcaccacagggtggtaggtctggacaagttgatacataccccttagatattgcaccaatctgaacgacccattaggctttttgactgagagaattggagtgttgtacgggtgacatgcagggttttaatagtccatttttcattaatccctttattactagctggtgatattttctcccttcagtataaatgggattttttttttttttttttttttttgcaaactacttctcttggttgttttagtttaatttgtaagggtgtgatttttaaccctcccctgttgccttttctaacccaaacaaggtgattaattttctttcctcctcctcttttgggaggcccattattacttttatttgtccttcctttattcctaatcctaaacccaatcccacaatcatgttttgacccaggatgttagtttctgctttaggaacatataagagtgaccagtttgttttggtcccaatctaattaacattttcttgaatatcagaacctgaaatccctccccttttacccgacactatcaatttttccttagagagttctgtaccccttggttggtgacttagggaggagggatccacaccagtatcaaccaaaaatgtcacttcttctccctcgggtcccaccttcagatttattcaggattcctggtgggtgggacctactcagaaggaactccccccacagtcttcatcaacggtcatgaggtggatcaccatttcttttttccatttagggcattcttttttaaaatgccctggctttacatacttgtaacatcccctcatagtcttaggagcttttccatgtatttcacctctttctttgtgtcgaaatctgtcattcgccttgtctccttcaaggaggatcttgatctaacctttttttgattacctcttccacagtggaaccatgagtttcatttttatttatgcttttcttcctctctccctacaaagaccttctgagcctcccttagtaatttcttaattggtttctcattccatccattaatcctttgtaatttttttttaatgtcaggccagctctttcttacaaagttaaccttcaaaaggccttgccctactgggtcctctggatctaatctggagtattttcttaactagtctctgaccctgtgcaggaatgcggaggaagtttcctcttttggtttttgttgaatctccaatgcctttgagaccttttgtgtcccagtagtggactttttgatcctttttattattagttccctgaggttctgcatttgtgtctgttctctgggattttttttttttttttttttttaggggaagtctcactctgttgcgcaagctggagtgcagtggtgcaatcttggctcactgcaacctccacctcccaggtttaagtgattctcctgccgcagcctcctgagtagctgagattacaggtgcgtaccaccatgcccagctaatttttgtattttttagtagagatgaggttttgccatgttggctaggctggtcttgaggccctgacctcaggtgatctacccatctcggcctcccagcatgctgggattataggcatgagccctgcacctggccccttgggatcattattatctcgtttgggattgacatttggaaatttttgttcagctggcaagacgtcttgcccagcaggttgttacctctcccagatggttatggcccctctcctaatcattcccctttcttttcctgtgaaaaggatacttgtgatagatatcatttcagcccaggtataaaaactggattctaggaattggttcagctggtttgctaaacccaggggatgttttagaagtggtttcatttccttcttgaaattcctaacttcagtacttgtaagaggagcatttacaaagccagtctctccctgtctatgggagcttccctaagagggaatatgctagatgtctgctgtgtggaagggatagggaagttctcaatatccctcttacactgttctaattattttctcaaatttggataaggatttaaaggagcaattggttcgactctgccatggtctgcaggtctttcttcctctaaccctcctgctgccccttgattttcctgtcccctattttgtgagacacatggagggggtatggatgatagggggtcccagggcttttcactgggcaggaactttttactaggcttcttttcttctttgaaggggaacatgggggctaattccttgatccagcagagagtgtagcccatctcctcttgtgaggatggggttttatcattcacatagagaattaaagcttggtacacccaatttttatctgagccaaacttaggccacaagaccaaaggcttacgaatggggtctttaggctagataaacagcaacgctttatcatcttttgcctttccttgtccctgattcaagggttgtcactccaaacctcattcttcccaaaggactatctgggggaatgtcagagggagtctctttggctccctctttcctttggcccataggcctagaatttctgtctcccatttttggtcagtctttgtgtccaagcttttccctgtgtactcaacccccaactactggaggtttcttgcacaccccaattgctttgcctgtctctggacatttccctcatgggagaacagaactatggattgggattcgaactccgcacttgcttcatatctatgttatatctcagttacacacacttgacctctgaaaatgcccaaccaccaaggcagtacctatagtccaattttcctcccttggcttgtgcatgacgttgcctggttgccatggtgcctgcttttctccctgtgttgcctccactgcctcctgaataagtcttgggtttgtttatggcctctgcagggatccaggacgcctggatagagtgggccacttaaattttgtgggacgtgtttctgctctcgactggagtccttctctgcacaggcacagagatcccagacgggcccccaagtttgtgagaaacacatttacccatccgaacccaaagaatggacttggagacatgaagaacagtggaagcaagacttttaatggcggtcttgcaagattgggtgtctggtaggcaggcacacccgaggcagctacagcaggtcatttatctcctagcatgcaagttcttcccccatttcctcattagttgagtactatggggttacaattctcacagacggtgcctaagtttcattatcccccttataaggttataccctggtccctttctctgcttaagtttcgattttccaacagtgaaactttcctcccttttaggggctgacccattctctacattctgttcactttttgtgactttctaggtgcatgagctgtgcgatttgtcacatctgcaggctggctgccagtatttagatttactatgcctcaaaaatggaccctttaaaatgttttctcagaatagtaaatagagtgaagtctgaaacagtacccagtacgttagaaatgttgaataactttaattttctttgagcctgacttttagaaaaagctgttgatatcaaggatttaatctagaaaacagtctcccagtaggtaatgcatgttcagcccaacaaatctaaacttttttctttccaatttttatcttagattcaaggggtgcatgtactggtttgttacctgggtaaattgtgcatcatgggagtttggtatacagagagtttgttacccaggtaatcagcatagtatccgataggcagttctttagtcctcaccctccttccaccctccaccctcaagaaggccacagtgtctgttgttcgtttctttgtgcccatgtgtactcaatgtttagctcctagttattaatataagtgagaacatgcatggccaggtgcggtggctcgcacctgtagtcctaccactttgggaggccaatgtgggcagataacttgaggccaggagtttgaaaccagcctgaccaacattgcaaaatctcgtctctactaaaatacgaaaactagctgggcatggtggcacatgcttgtaatcctggctactcgggaggctgaggcaggagaatcgcttgaacccaggagacatggaggatggagtgacccgagatcttgccactgcacttcagcctcagtgacaaagtgagactctgtctcaaaaaaaaaaaaagtgagaacatacagtatttggtttttctgttcctgtgttaatttgcttaaacctaaactcttcagcctgtttgcagagttcttcacaaactacccgtgccgtcctcacagcccaagtattgccatttctctcaggggtactggctctatttccaggatggtcaaactggcagtttcctacaagcaccatactccctgagtccccatgatttttatcagtgttctaatttctggaatgcttgttgtcttactctgttcaggttgctatcacaaaataccacagacttgatggtgtatcaatactggacatttatttctcacagttctggagctggaagttcaaaatcaagccagtagtgaattcgggtatctgaaggctgcttcatggtttgtagacggccccttctagctatgtcttcacatggtggaaggggcgaacaagctccgttggtcctattttatggagacactaatcccattcatgaggactcagccgtcatgacaaatacacctcccaaacactccacctcctaataccatcattttgggggttaggatttcaatatatgaattttcagaggacacatattcacaccataacacctgccttgccctgttctttcatcttaaagattcaaaccaagtaacaacttttctggcaagtctttcttaataccattctctcccagaggcagatatttctcccgtgttttcatatgcatcctggacatacctctaatcatggcagttcttatcttgactgtcatagttccaggatctcacctactgagctcactgagggcagggactatcttgtactaatctctgtattactagcttgacatgtaatgggtgctaagtaggaaaaggtaataataatatttggagacatttgtttgaacaccattcaaaaatgaaagtgaattttcagctttttgtttaactagaagattgtattgtcaaactaaactctaaaaaggtagaataaacattttctgagcattttggctaattcaagttttatagtaaaatgtttataaactggacagattatatatagattatatcagaaaaatgaaaaaatgtttaaaatgagtagatacttgaagggaaagcaagaagagaccaacttcattaatgcagcattctcttattaattacataatatatgccaggctctagaaataggaaaaatactttttcagagttttcacatagtttcattgatgtttcccgtttcatggtagaaggagttctgaataaggtccatgtggctgaataaacatctttctgactacccaaactttaatcctctgggatgccacctagggcttgagaagattaatttacttctagcttccatatgattcagaaagattgttttcattaatgtgcctgccagtgtgctcagtttgcatcatgagggcagtttacctacttgacatagctgcttatttcatgcagtgtttgagttattgggaacctccacaaatgtttgataaatgggtaaatgaatgaacaagcagtatgctaattccactttgacagaatttatgtctaattgattaaatctaaatgggtcactgactttatcctctctttgtagatttgatatcattggatatttatgaaattggacagttttgttgccaattttgtacgacaagaaaatctttgaaggaatgcattgtctgtaaattaatttaactatgtttctctttctctagattttagtgccagttctttctaataagaacaaccataagtcctggtcctgttttacttcacaagatatggaatatcacatagaagtcatgaaaaagaagatgtatatttttaggggcaaaatgtctagaagaactcttctaccaattcccactgttgcaggaaagatggatctggatcagaattgttcagagaacaagtacgtaacagtacaatatatacaggatattaaagtagagagccaggccagcacggtggctcatgcctataatcccagcaatttggaggctgaggtgggagggttgcttgatcccaggagttcaagactagcctgggcagcatagtgagatctcatctccacaaataaaataaaatggaaagtgagcatacccatttaatatcacacctctagcaaacccattagcaaacagagaattacagctacatcatatttttaaaataagtgcagaaacaccatgtgaattatttccttttaaagtatgcttttaaaaagcaaattatacaaaaagcaaactgtagtaattgccatgccagtaacattattcctttagtaaaatagtttttgaggatataattctttaacagtgttttttgaggttagagatatgtcactgacagaataacgtaaccccacaactcaaatcaagaccataaaaataatggattttcaagaatttatttttaggaaactagtttatggatgcctaaaataactattaaagtctatgtctttggataaaatgattcatctttgaattattttattatcttaatgtttgtaggccaccgtcaaacgaaaggataatacttcatgcaattgaatctgtggttattgaatggtcacatcaaatccaagaaattatagaaagagattcagtgcagcgtttgttgaatggtcttcacttgtctcctcaagcagaactagatttctggatgatgaggagagaaaatctgtcatgcatttatgatcaagtaagtagatagccctagaaattataaattaaattagcaaagtgtcctgagctgcaatgaccaatagttttaaagatttaacacactgtctttgtataatttactggtctgccctcttttcttaatccagagttctgtgtgtgtggtgtgcacttttgacattaatttaaagtaactttgcctttctgagaatattttgacagcatttgagatgattggaaatattgtgctaccttggaagagcagtacttacccagggaagcgttgaagactggaaaatttaattagtcaacttaattgatttgggaaggagtgaggtcttgcttggtagagagacacagctttggaaagactaactttggttcctctgctgggtgcttgccatacaaattacttacttaaggttctaaaagttaagacatccattcacatgtcttttggagattttctgaaacagaaattttatatggaaaaattaatattttacatatataatatattaggttctctagatggatcaactaataggatatatgtatatatgaaagggagttgattaaggagaattgactcacaggatcacaaggtaaaattctacaataggctgtctgtagttgaggagcaagggagccagttgtgaatcagtctgagtcccaaaacctcaaaagtagtgaagccaacagtacagccttcagtctgtggccaaaggcccaagagcccctggcaaaccactggtgtaagtctaagagtccaaaagctgaagaacttggattctgatgttcaagggcaggaagcgtccagcatgggagaaggatgaaggccagaagactcaggaagtctgcttttccatcttctcctgcctgctctattcttgctgctctggcagctgattagatggtgcccacccagattgagggtgagtctgcctctcccagtccattgactcaaaatgttagtctcctttggcaacaccctcacagacacacccaggaacaatactttgcatccttcaatccaatcaagttgacactcaattataactatcacatataataatatatatccaaatttaaaaacctaaatgcaaaataaaatacaaggctaagaaaaaaatgtatttttaaaattattttcaactggaaaccagatataactttgagtgttaaatactgtatcacttgtgagtgaaatggaatttaaatattttattacagaatgcatgtatttagtaatcgagtttatatttattaaagttcttctttttttcctttaacttagcttcaggcacctgttgtcctcaaaatggttaagatcctgacaactaaacaaagcagctattttcctactctgaaggacatttttctggctgtggaaaatggtaagactcttgttcctcagcctggcatcaatatcaccatctgctcatgatccagcccctgcctgctcggccttgatatttacccttccgccatgtttgtggagtgattgctcatggctcttctaatgataaattcatctcaccctttgtactatattctccacccatactaaactacttttagtttatctggtatatagtagtacctgccaaaatggctccagattgaaattttaattagaatgtttgtggaggagtgaggccttcattcggagttaaaaaaaaaaaataagtctggatagaggttttccaatcaacagattgggctatggtgagtctagttattcatcagttcagttctctgagtgtgcttggtaaccagttatttagcttgcaaacactcaaagccatcattgaagttttggtgaagattaaatgtacagagtggagggtttgttgaactttgaatagacaatgcatgcatcttgttacaaaccaggaatcataaaatgatatccagtcgaaagtcttctcaccatccttgtccttccactctctagtttcagccccacccaaagatgacaaccctgctcagttccttgatttctgttcatgtttctttgcacatgtataagcatttagttatggatatacatgatactgtggttttaaataataaaatagataatatggacaagtaactttttttgtttctaatattaaaaagtttattttttcccacgtgacatttggaaagttaggaaatactgaaaattcacttcaaaaatgttttaatacatctttagggttttctgcatgaattctgtttaaaaagagggcataagataaggaggaatatatacagcaggggctctgtaagatctgaattcctgtcccaaccctgcttactgagcattttaaatttgctaagcctctggtttttcattggccaaattggcctattaacaccttccttgaagagttgctatgtggatttagtatttcttaatcttgtcatgatcaacattttgggttagataatttttttgttgtggggggccatcttacatattgtaggatatttagcagtatctctggcctttacctgctggctccatccctgttgtgatgatcataaatgtctccagacatggccaaatgtcccctgggggcaagatttctcctggttgagaatcactgggttaaggatagcatattatacactatgcaaggtactagacatgtagtaagtatgcttcaataaatagaagctgttggcatttttttttctgtgttagcataagatgaaaattttctctggctacagattctgcaggaatgaatcccagggttcctctgagccttatgcatgtgtggcctggagattcaggaagaaaacacttctcaatagaacaagtggctcaaactcatggtcaagttgaaggaagaaagctcttctcaaagacacacttcaggcattgtggagtcaccacacatgctgatcacattttaaggacacttaatatttaagggcacttacctactagatacgattatataattttgacataaacattgataaaaatagtaattttgaaacatgagtacatctgggaaagaaaataattcctgaacattctttttattctcagggctttattgttacatagacagatgaactggttacacagacagattaattggttacacatcaagtgtctgggttcatccttgactcctggtgacaaaattcagcagggttttttttgttcttgacacaagtcttttgggttaacaacaaaaactagaatttacttgactttgttccctactttcataataaaatttgttctcagttcctcaagggtatttgtagccttgggagcaaaatggaatctcatggagatccatttagggtatattaaaaggatcagtgctaagcaagagaaaactttggattcaattaagcagtcattaatgagagttaaatatttaaattttttttcatatctatagcatttttttgtttgatttttttcttcctttttcttttttggagacagggtcttgctctgttgcccaggctggagtgcagtggtatgatcatggctcactgcagcctcgacctcccaggctcaagtgatccttccacctcagcctcctgaggagctgggaccacaggcaactgctaccatgcccagctaatttttaagttttttgtagagatggggtcttgctatctttcccaggctggtttcgaattcctagactcaactaatccttccgaagtgctgggattacaaacatgaaccactgcacctggcccgctgtagcatttaaaaaaaatatttaccatgcttaacatttgttctattgaaataaacttcacataacataaaattaacaattttaaagtatgtaattcattccagttttagtacattcatgatgttgtacaacctcacctctgtcgagtttcaaaatcctttcatcactgtacttaacaattttaagttaaacctttattaatgatataatttttctcaatcattgcatgagttactgtcataggaaactggaatgagagagtaaacaattcaattgtgctcataccaagttcctagaaggaattaacattctagtgatgaagtttgtaatccaagccataaagtgacaacattgcagagaggttttattccgacagtttccacagggttgagtaaatttctttagactccaggggtattttccccttgggttttccatcacaatttatttatgctatgtgggtaactagatcagtgctctcccagatgactcagttacagatggacagcgtataagtcttccaaattgctcgtgtgtagattgtaggataagtaatataaaaggaactatgacaacatttaagtgtggccatgttgttttacgtggctctcttctacatgtaaagtgaatttagaaaaaaaaaaaaaacaaaccagaatcacgttaatggtggttctttgctttcagctcttctcgaagcccaagatgtggaactttacctgagacctctgaggagacacatccagtgtctccaggagacggaattcccacagacacgcatattaatcgctccattatttcataccatctgtctgatctggagtcattccaagttttataacaccccagctcgggttatagttttattgcaagagttttgtaatctcttcattaaccaggtatgaagcatcaaaaaacaggaacaataagaattgttgctgtgaggtaggttttacgagactagtgaagaataatctagtatacagtaagaacaccatctttctttttcttttttcagaaaggacatttttggtaacaaaggccaggtaaccttttaatcctaaatggcaggaagctatgaaaataagtcagacataatcaaaggacaagttgttgcttggttttgtttaacatctgtacctttcttcaaaaggctttaaggcagcttccagcaaaagacagacatgtgtagtaccttctttgtagccttcccttcggttttcacagaaacactggctgataaaagccttttggaaagtgtggtaagttaagagcatctggcaaaaagaaaatcctaaaaaagtagtagaattgtattgaaaaaattctgattcattgctgatcttttaaaatctcttttgtaattgtgtctctattccttactcaacctgcaaaatgttaaaaaaaaaaaaatttaaaaaaaggaccaccttcctctgtgtcctcatcctgtctgtgtgaatgtggattcttccatgttcacagtaccagagggtattacataatttgagaggtaaaagatacttggatgctacataatccagtggttcttatttggaaccacttagtcttaatcttctcaggctgccatagcaaagtactatggattgggtaggttaaacatcagaaatttattttctcacagttctagaggctgaaagtctcagatgagggtgccagcgtgctcagattctggtgggggccctcttcctggcttgctgatggctggctgccttctcactgtgtcctcacttggccatcttcctcttgtaagaccacaggtcctgtcggattaaggccccatctttacaacctcatttaatcacagttacctcctaaagaccctatatccagatacagtcacattgggagttaggctttcaatatttatcaatttgaatggacacaattcagatatttttcaaatgaattaaccaagacttgaaaaatgatgttatttgctcaatttccctgagcagttaggaggaaagccagaccaaagaacaggtctgcagacttgcagcttagaatttttggagtatgaggttgcattgttaatatttttcatctctcttccctctctgattctgaaaagatagagtggtgtgtgggaaaggctttggacctagaccaacctggattgaaatctaattttctcacttaagggaagttcaattactcctcagttcccacatctatcagtggggataatgcctagtccatggctattgcgaggattcaaagataacctaagtgaaatgcccagcgtagtgctcggtgtttaatcgaggctcagtaaatgttagttgccttctgttcttttgcccaaactattgacttacaggctagttgcagctggtggtagcagataacaacaggtcgattccttgctatattttaccatcatctcctctggttttgttcaatatctgttactctgttgggcaaactcagttttgcccttttgttaaacaggttccctgggtcctaatggcgcgggtctctatgtaaaacaccacaatccctgttgcagggccaaaaactacgaccaccacttcccccaaacccctttttagggacctatttctcattttgagaataattgaaactgtttcactgcaaatccttgttaacgtatgaatcacagaggagaccatttgttggcataggtgacttattttaagtcctagttacccgtaagcctgtaaacttctcatccctggcttctagtctttcaacagccagagtctgccaagctcctgataaaataatgtggcttctcttgttccttagttctggcttctatccaaaggtttcattgacccgattcctttgattctatgaacggcagatttcagactttgtggtaaatatgcccaacatgttaggagtcaaaagttaacaattagccaatgtccatagctggttccctgaagcactaaccaccctgccaccaattttactacttttatatagttatttaacaaatattatatagtacttattttgttcaggagcttttccaagccctttacaaaaattcaaaagttacaccctcatagcaacactatgacgtaggtattattagtagcttcattttataatgaaaaaaaaaaaaacactgaagcctaagaagataagtaactctccaacccagcaagtcagtaatagagttctcacccgttataccatgctccatattttaaaataagtttttttaatgtctgaatgtgacctaatacatggtatgctaacgataattgtaaaatattctcattgcataatgttggaacattggaaatggttctggagttttatcactctattattaaagcatttttatttttctgtcctcctaaacttatatatatttatacattttatcatgcatacaattttgtactaacttcttgaaagattattttgttattgctgtatatgtaagttgcttccagcctccttgattgtaaacagtatgcagaaaaaaactatacaaagatcccctcttttgactggaatgattggcttactataaattcctgatgttggtcaaagggtacaatcttttcatggctcttgagcaatatttaatactttcaaattattttctaaaaggttatatcaattacattgttattatcaatgtgtaaaagctttcactatgacctgtcaacttggagcattgccatctttaaaaaaatttggggtcatttattgggtatctagtggtaacatgtttttaaatttgtaccttgcatgatatatgtgtgattacacattttatgttttctataattgtatttcctcttgtcacctacatgttctttgcgttcatgaatttattgataaagtttttgtgaaaattcaagcccttcctatgttacatattagaggtcataagctgacatgctgtcagctcattcggcccaaggatcaatgcagtgtttttattttgtataatatttttaacttaaaattgttaatacttaaattggatagatctcatttaaatgccagcatttcagcctccactgaaaactcagagatcttgctacagtgcttgcaccatccccacaggcgcagccagtgactgtaacttcaaatgccccttaaggtggaacaggtgctgtgtagatgaccatgaccttcactgttcactgtcctttctgatctactttactcagtttcattacatgcttgaccctatgacgggaatgccagtcagagtcggaaactctttgttactttaaaagcaaatgtatttcttttctcttgttttctagcagtgaacattaacatcattatctaggccagacacataaaaggcatcacctgttcaccttgcgtgctagcacaggctttggtagtggggtcttaatgccttgcctttcttctctggtaacctgacactactccatggtccttgtgtgtcattaccactctagacactacgttgtctattccatggcttggtgtatctattgtagatattgtcacctacaagatcctaggtgaggaagagttaaagtctgagtagtcgagtgtggagtggagctgtcaggactgagctaaaataacagtccataaaaacacatgcaaaagaatagagaagcagcagcagggagacgagcctcaaactaacaatatcattggtaaattggttaattgatcattagcttattgataaataagttggtaagcagtgttttagtttataagacctctgaagtgggactagttcatcctaaatctagtggcttttagcttgtttgtgctggtaccattgagtgtgcgatgatagagctggtgtggttaggcgtgctccagactgggtactgtgagaggtagaaaagaatttagagtttatgagctaaaagggattttgaagttcacctaattcatttccctcattttgcagctaaggaaatagatcctctgagacaacttagctagtatcacaaaagtagtttgtggcccctagtagggtcacagccagcccctgcgtcgggtcatgctttttccttcacacgttctgcctccccgtgcaaggagacagactgagtgttttcatttaggacattaagtgccatcttaggaggccttactcaacagtgggctgtatgaacaggaggttctttgtctatgattgtctcatctatgcgaggggccagccaggaagcacaggaataaacattaagcatgacttgtcctagggatgttactttacatacaagtaattaggtaacagggggctgctgaagcagaaagggccactcgagcaaaagatggagtcgtttgccatagatttttcagcatcctaaaaagacacatttactataaagaatacatagagataaaggtatatggaatacaccatatgccacatcaaagtgtcaactcttttaaaattcacattgctgagggattcctggtggttctcttcactgccctgaatgacttgctgttatagcaccctcatgtggaggttaattttctatctaacctgacagggaaataaaagcatagattgggaaggagtctaatcagtaggggttttagacactaaatgaatgatttccttattgccttacaaattcatggcacagagcctatattgcatgtaaaactgttttcattaatgggaaatgaaaggtcatatgcctacatttagggaagaagtgcttccctctgctattttgaactcagggctttcattacattatccattgacatcttgaacaacattctaagcgaccacaaaattgaaggcacacaaattaaacctataatttatatgaggttaagatgcgtcaggaagaggtagcatacaaaagaaccttcagaatgcagaggttcttggtccttgaagaggggaattctgaatgtttataccaaatatgaagagagaagaagttgggagtgtcggttgatcccatgagaatttgaccagtgccacgtggatcttccagtcttttcttttatccttctcctctcttcctttcttttcctctattcaaaactagttcatgtggcacacgtcagccagtttgtatgtcctataatgttacttgagcccccagaagagaagtttgctaacttgaaagaatttccactgttacacactcctaatcagctctttctctttacaagtggtcctgaactaccaggtaaagtgagcatactttaaaaattcatgttctgatagatttccttgtctgcctcgtatattctttagatgagaaaacgattgttcagaatatttgctggcaggcacagtcatgcaaattacatgacagttgtcatataatgaggcttagcaacaatttagtcatttgctagaatgtaaaaatccagaaatagtagggtctcctgtatgtaattctaacttatacaagtatgtcattgaagtccaagtagctgaatttctagaacttgtgctttctttctttcagcattgctggcccaactttagatactggcatttaaaaatgattctttgaaacagagacggttacagggaaaaactgttaaacatagttttgatcattgttccctttcattaaatcctaggcaacagcttacctttcacctgaggaccttttgaggggagaaatagaagagtcactggaaaaggtgcaggtggctgttaacatcttaaagactttcaaaaactcctttttcaactatagaaaaaaattggcaagctactttatgggaagaaagctgagaccatgggatttccagtctcatctggtgttttgcagatttgacaagtttcttgatcgtttaataaaaatagaggtattcattttttgattttatttattcatgttgaaggtgggtgcaaaaagccagtagcttttcacatgattcatggaacagtttactttatatcataggtggaggtctcctttctcagtgattctcataaggagctcagcaggccaatgctatgatgatacaagggcattttttaaatctttaatttggattttttaaaagttcatttttgattccattattacattgagtataagtaaatctctttatgtatcagtgactcttagaattgactaatctgagagagagttgtaagtcaggaagcagtaagctcatcctctgtaaataaatccacttttccttttgtatatttaatgcttaaaattggtatttcataccctaaaacccattgcataatttaaattatcacacttttttagtatatgaatatatgctgtactacaaaaatattaaaaccatttgtaaaaataaaacatggaaaagtatgtgctctgtgtaaaagttttcaaataccttaaaaccaaaaattaaacacatacaacctacacattcttacatttatatggtgtctattggcttagtttaaaaaaaaaaaaaaaaagtttaaattgatgacactgccttattttctttgtaaagctctaagaattttgggcattgtcattgataaaggtttgttttattccattcaaaattagagctttatgtcttgagaattctcgtaatcacttaaatgagcctgaatgcctcttctgtctctgaatgtgaaatacctaatgaagggcagcttacatatgccttccttaacagtttcctgggctcgctttcaataaagcagactcactgccgggtatggggtgatgaaaacaggagttttggatattacctggggatctgacttacgtttaggaagatataaaattgggggagttatgtgtctagttatggtaaattagaggttgcttctactgcgagatagtttttgttttcttttttttagagacagggtctcattctgtcaccccggctgaagtgcagtggtgtgaacacagctcactgcagccttgacctcctggatcaagtgatcctcccgcctcagcttctcaagtagctgggactacaggtgcacgccaccatgcctagttaactttttaatgtttcatagagacaggatctttccttgttgcccaggttggtttcaaactcctgggcataagcgatcctcctgcctcggcctcccaaagtgctggtattacaagcgtgagccctgtgcctggccagtgagagttaatttttaataaacatgaaaatgggagagtaattttaaaaattagcaatgactttgtttaattaaatacttatttctgtcatgaaaatatttattttctgtcattttctgtcattgactcattgattttgaacatttgaaaatgttcttgatttgaaactttaaaatattttgctgctcaatgtagtggaaaggtctttactgtgttttttacaaaggatatatttgccaccactttggaatttgaaaagctggaaagactggaatttggtggtaccaaaggagcaattttaaatggacaagtccacgagatgagtgaagaacttatggaactctgtaaactttttaaacagagcacttatgacccatctgattgcactaacatggtaatgttgtacctttgcattttcattgcatgggatcctataattttatagctgaaaaggaagataggtcacagtgataatagggaccatccattccaatatctctaggaccaaaagaggttacatgacttgcctgaagtcttgtagctacttagttagtagatcagggatcagaacttaagcttttgcattttcagttcagaatgacggctgataaaactgcagacctcagtctggatttgtatcttgtttgtgtatgctaaacagaaactttccacatgaattcattttgatctgatgtccatgtaactcgtgctttattttagcattttcttgaatcactggatgttttgttttttgattcacctgaacacttgctttcaccccagtcattaagtgtatcatttacatgttggttgtttcttataatttttgttattcttgagagctgattataatttcatatttccaaccacaggaaagggggaacctttctgatttaagctgcttctgtgctctgtcagttccagcatgttagtagccagggagctacctgtgagcatccctgcagttctaggataaaaatagcttcattttagtagtttgccaagaacagcgaagcccaagtccaaaagaatgaagatttagctcttgttcttattattgtatatgtaatgtgagtttattcactattgtttatatttggccaaacaattgattctttgaagtgtacgagtgcagtatgttagctttataaggatgtagttagcaaacttaagccctctgaattatagtcagttttggaaagtggagttaatggtagaaggacactgctgtaataggtgactttttgctaaaccagggcactacactttgtgaaaaagtatgaggaacctaggatcatggtgatgaataatttgagtgagctcatccccaaagccttgtaagatgcctggcacttggaaggcattcaataaatacgtacagaatgggattcttaagagagcctctaggttagcgccgctgaacgagctagtggaggaggagtgtgagactgagcctgcacaagatccttggggacatttggattgcaagagagtcttgattttgttataattacaaaaactggcaagttttcagagtgccagaattagagaatgtggccaggtttaattgacgtcactaccttggccatgccaaaggtcctgattttactcctgtctctgcctaaagcctgcatagtcacaaacatgtaggaatagaaaattcatttactcttgaggtatatatctgcttggtatttgtattttggaagcctattctattttgcagataaggtgggcagggtttacctctgatcttcggtctggttggagacatcataaccttcccctgaagttcccttcatcctcctgtctgattcttgccttagaatctagaagctccttgactttggtcattccctaaaattaaaacatgaattaactaaaagttaacttaatcagcatacttatgttgaaaatgaccattacttttttaaaaaaatgtgttttgcctatcattattactttaaaatattgcatttatcatatatttttgcttaataagctgttcattttggtgctttttagctgagttccttgtactttgacttcatgatgaaatcagttggtagtttttgagacattattttaacaaatgacttccaacctagtgtatgcatatatttgcatgtacatatgaatacatgcccaacctctgcccttcccctcccattgcattcacccccatgttcctgctcctgccccatcccctctgactacaaactagtgcttatataacagggaagtgtgtcagggtcagccattctgccctttggtatatacatggtttaaatatgttccagtaaattaaagaaatgatcactggtaatttgctttttgaaatgctgttgtttatttctcttctcatcaatctcatgcctactaatcaggctttgagcctttattggcgtaccgaaaggtttgctgccgtggtccatttacagaatgtggggattttatcaggtgtgcccataaaaatggttttgggtttctcaattattgaatgttactttaggtgttttctttgacatcttcttaggggactgtttgaaatctagacagttatgggaagagacttgctttcttcattattaatgttgaacagttagtccagcaatattagactcagtaattttgctgtctttctgtggtgtttcttgatgaaatccctcagatacctaagcaaagatggtagctattcttgttgagggtaaccccttggctccacttagtctctgttaatgagagccagttaatatttatggacgaagtactggatgccaggcgttgtgccagagatttcccacattatatacctgcttaattttcactataacccagagagtggtcccgcaggcaaatgacagtttcactaaattacctgagattatagtttccagttggtggaatggaagtttgaatccagaactctcaaccacaagccctgcatacttttgttttccctccctccctccctcccttccttcctttttttttttttttttaagacagagtctcactctgtcgcccaggctggagtgcaatggtgcgatcttagctcactgcaacctctgcctcctggcttcaagtgattcttctgcctcagcctcctgagtagctgggattacaggggcacaccaccacgcccaggtaatttttttgtacttttagtagagatggggtttcgccatgttggccgggttggtctcaaactcccgacctcagatgatccaccctccttggcctcccaaagtgctgaggagattacaggcgtgagccactgcactgggctttttttttttttttttttttttttttgagacagtttcactctgtcacccaagttggagtgcagtggcatgatctcagctcactgcaacctctgcctcccaggttcaagtgattctcctgcctcagccttctgagtagctgggattacaggagtgtgccaccatgcccaactaacttttgtatttttaatagagatggggttttccaccatgttggccaggctggtcttaaactcctggcctcaagtgatccacctgcctcggcctccaaaagtgctgggattacaggcatgagccaccatgcccagcccctgcattcttttcactgcaccaccctgttagtatttatcttgcttgttgcatcctcattgaaatgaaaggaataagttcatctgtgggaactcacctgaggacctatggcctgagatggagtgatccaggttgctgtgtctgcttttctgctgattttcagtgggaagctttattcaggtgccttgttcaccatgatatcagaatctaaaatacattttaaaagtagttatttagttcatctgtactaggttgtattctaattcctagaacgagtctattgttctgctgtcactcactgaactattcttttgctatttatgtagtgttttctcattttaattaaacagatttcatctttattagtcatacacagcattttcatgttttgcctgcctattattcaagattaaatgagttatttagcaaccttccttagtaattcttttggaaaggtaacatctgtaaaaacttagtccctttcttctcaccctatggccttttccctagtcttccatttttcctccccaaaggcatctctattaaaaatttcttatatgatgttccagagatatttggtgcatgcactggcatatacatatatttattcctttgttttctgcttttgcattaatagcatttataccttgcttttatcccttactatattttggcagtcattctgtgtcactacaatagcattgctcatcttaaaacaactgcgcattccatcagatttatatactaaagtttatcttatttattttaaaatgtcatttagtagatatcattgtttaaaattttaatgagaaacttctgcttctggaaagagggagatgtacttttccctactgctcccagtaagtgcaactaaaacactggccgttatacagtagcatggctcacctgtcaccgagactcctctagatcttgttgctgctgagtatcctacctgccagcgatggagattgactctgaggctccaccatggtattatcccttgaggagaccaaacagctgcttggcaggaagttaattacccaagaaggacagcgattcatcttgtacaggattgatacatattccaaggttgtgtcttccttgcctgcctgaaaggcctcagcaagcacggcggccacaaacaacccttgaaaatgtctattgcaggaagcccagaaaggaagcaccaagttggtttaagggactgttcttggggttgtaggggagaggagataaaaggaagccaagatctgagatcccagaagatcttaatactgactcaagactctcttgaaagatgtaaactctgatagagggtatggataatatgtttgatcctttctagggcttaagccaagaccctatcaagcaagtaagtgggagattgtgcttataaacagctcttttgaagtaagacagatgttctccttgcttctcagaatattttaggccaaagcattttgtgggcataaattagcctaatatcagtgtcaatgctgtatttcagcttactcgtgaagacctggtctttgtgctgtaagcaattaagaaagacagaattcttaagtgtatttcaaggaaatgtaaaaacaaagtgttcaatgcacacttatgtatatatattatgatgtttataacaaaagtgtgaaaacacacatgggaaagattgaaacttactttggggtagtggttttctgggcaggcagaaagagaaatgtgtctatgtgtgttactacttatttctgaaataaaataacagtatctgagaaaaacaaaacaaaaaaaacactggccattatatataaaacagacctaagaagactctgaaaggtgaaaagaaaaaggcagagtggctaaggatattgggactcaagaaacaacaacgtgatgatgagttccctggattttcctgttgcctgaagtaatccagacttggagctgaaaacactggcaaccaggaaatgccagtgggcacagaccagaaagaagcccagtaaaagcctgatctctccctagccaaaggctcaagaaggagagagcttaacacaaaagaagatttgtaagccatcaactgtccactctagccaaacaccatggaagaaactgtgtcccacccctccccttgccaggaagagctgagtggggagcctagacttacaccctttctgtctgaaaatgctccaactcccacccttgctggggtgatgtcagagatgaccacatagggagccatgattttcatccctgctggccaggaatgaacttcattctctgtggtgtccggagaccatgtgggaatcctggatttccttcttcacccagcctgatgttggagcaaacctgatggagagtccagactatcaccctgaggccaagtggtaacaaggccacctgcacttgtggcagcagtagagaccacatggggaactggaagtcccaacccagcggtaacaaggagccccgcccacccttggtggatgagtaaatgccgagtggagaacctggacttctgtctctattgtaatgaggctggagcagcatcagagaaagtcagcaaaaacaaaaggtttaaataagagtcagagtcttataacaatatgaaatttcagtagaatatcagttagtataccaagaaccaggaagatctcaactgagtgaaaaaaagacaatcagtagatgccaataccaagataatagagattttggaattacttgaaaaagattttaaagtagtgtattagtccattttcacattgctacaaagaactacctgagactggataatttatgaagaaaagaggtttaattgactcacagttccacagacttaacagaaagcataactgggaggcctcaggaaacttacaatcatgatggaagatgaaggggaagcaaggaccttcttcacatagtgttcagagagagagcaaagggagaagtgccacatacttttaaaccatcagatctcatgaaaactcactgtcatgagaacaacaaagagtaaattcaccctccatgatcccctgtaaaatcaaaaacaagttagttatccaagatacaatgaaggtacacgtattgggtaaatattccccttccaaatgggagaaattggccaaaacaaaggggctacaggccctgtgcaagtgtgaaacccaccaaggcagtcattacatcttaaagctccaaaataatctcctttgactctatgtctcacatctaggacacgctgatataagaggtgggcttccaaggccttaggcagctccacccctgtggctctgcagggtacagcccccacaactgctttcactggctgatgttgagtgcctgcagcttttccaggtgtatggatctaccagctgtcagtggatctcccattctggggtctggaggacagtgaccctcttctcacagctccactaggtagtaccccagtggggactctgtgtgggggctccaaccccacactgccctagcagaggttctccatgagagctgtgctcctgcaactgacttctgcctagacatccaggtgtttccatacattctctgaaatctaggtggaggttctcaaggctcaactcttggcttctgtgtacccacagaaacatgtgccaaacacaactgcctacccaacgtctccactgagatatttcatacacatctcaaaatcacattcagatctaaacccctgcctgtccctccccaaacctactcttgcctgtctctccaactcattaaatggtacatataatgggctacttagtgagaaacctttgagtcatctgtaatcttgctcattttctcacaacaaccatccagttctttcagctatgccttgaaagtatttccaggtgttttctgtgacttggcttattgcacttgcctccaaactgctccctcttccccatcttggctttcttagtttgttctccacacggcagcctgagtgccttttagacactaagtcaaaccatggcttttctctaattacaacccttcaatagcttctcatgatgctaataaaggcaattatgcagttttcagaatacagcaacatttttataatgatttctgaacaatactagcacatcatttattctgtaatatatatttattgagaaacagctatgtcctgggaactccattaaatattggtactgtaattgtgaaagaaaaataaacctggcagttacactcagagattaaaatccaagggagaatgtagacaggcagttatcatatgggtgcccggtgctggagtatgaagagtacagagtgctctgagaacatttacatagggcccctttccagaggaggtgaaatgtaaactgagacctgtaacataaatagaaatgaagcaggtgagaagtgggtgaaggagagagacagaatgtgataaggctttgtggctggatctgagagtgtgaaattgggagagatggcagaatagttaggagcagtaagtggcatccagaccacatagggtcttatgcagtagattatgctaagacctttggacgttatcctaagaaactgacaattccgaattaagattgtgagttaaaggattctaaataagaaagtgacatgataagatttctattttaaaaaagattatttagtcagccattggaggatgaatcagagataggactagaggcgaagagtagttagaaagtgattaacagatacccagatgagcaataatggtgacttggaccaagggcatcctggagatggaggatagtagagagactccagaggtagttagaagagcacttgacagagaagtcaaggaggttgcccaagtttctattagggtgtataaaaagaagagcagctttgtagagaagataacaagttcagatttgtacttgaacaaattaggtatgaattttttgtgggactttccaagggagaggtcccacgtgcagttctaaatttgttttcaggaatgagtgagtgagaagggagggaggtgacagatatcagggagggagactagcatatttttctctccctgagatgtttatttctaaatgttcagttaatgttttgtgaccttaagccgtatgttctctattactatactaagaagagggatgttaggcgtgttaaaacttgttgggaagttgtgtttactttattagccaatgagccttgaataaagagattgcttggctctaattcagaagtggaaacttcctcttgatgctaaatataacattgtggtgtatgacacatagtgtcctagaactttgctgttacactgcttttcagcttgtgtgaaattcagcataaggtgccctctgtttaggttgctataacaaaacacgataaactgggtagcttataaacaacagaaatttatttttcagggtttcagaggctgagaagtccaagagcaaggctcccgcaggttcagtgtctggggagggctacatcccagttcacagatggcactttctagccatgtccttacttggtggaaggatggaggagtctctctcaggcctcttttatatgggcactgatcccattcatgaaggtcccacacttattacctagtcacccctgaaagcaccacttcttgatactatcgtattgagggttaggatttcaaaataaaattttgcaaggacataaaacattcagactctagcaggtatattccttcaaagaaacatagcatctgggatcaggagccaggttgcctggctttaaattccagccctgacatttaccagtggtgtgattttaggtgaatcatttaacttctctgagtttgttttgtcacctataatgcacaaaaaattataacctacatgaaatgttgtaagaggtgagttaatcatgtgaaatatttagaacagaattactcacgtgctaactgtcattaattctattaccgttgttattgttaatagattgaggctcagtttacagaggtggcaaaggccttcattgtgagaaatctgtggtgtgtacttcagaggccttttgactatgaagcaccaaaatgtttctgaaatcctgggacttctttactggagactcaactctgatgctgtgaagataatagttattctttcaccgtttcattgtaactatgggagtggatagttatgtatcaggaggaaactgagggatgctaaacgcacgctaataagaaactgggaaaacgtaagagtatttgtttcctctgtatcactaatgatattttcttaccagtggatttcagttctcacctgaagaaatagtgtttccgtgtagatttacaactccatgaaaaaacaaacaaaaacccttcctatttaaacttatagatggactaaagttataatgaggataggttcttttttcttttctgaaaaacttcactttttcatttataatcaaaatgaattgggagtaggaggagagactgaggcttctatgtgagcatgtgagccaaagcactgctgttgaggcctgggccactgaaaagaatcgggaaagcataggggaacagtgctaagctttcagtgattctgtaaggtggcacttgcacagtcagtcagatatagctctttcttgaacttccgtagaatgctgctatgaaaaataaattcactcagagacagagagcgagcgagagagagctaaagtaaggtcacgcttgtgtgattgctattttcgctgttggattatttccaatatactaatatttcactttgaattttacaggagtttgaaagtgattatgtggcatttaagtccaaaactctggaatttgacagaaggcttgggacaattatttgtgaagctttctttaactgcaatggcttagaagctgcatttaaggttagttctgaagaagctatcataaaaaacgtttactatgaataatataggctgttaaatgaaaggggtgaattctcattcaggtagagtattcactaggttaactagtcatattcccttcaaattcagctcactgaataataaactttgaatagtgtactaatgaataatgacactttggacaagattattttaggacatttagttactgttctgttcttgcattcacagtgttttagctctcattatcttcacagcaaatttggcctggccaatgaaatattgattcaaaattaagtcacagtgaaaagtgaaaaataccttaattcaggaatttcttttatttaccattgtttagattgttaggttcatctgcctattttattattctgactgaaacaaatagcaatttatatactgtatttacccaggcataagacatcattgattatcagacacaccattattttgtgtaacaataaaaaatgctgccaaataattatgatttcattgactgcataatgtatttcagtcgcagagattttgaaacataaaagtatgcttgtcacagaattgatgaaatacagttaagagttatataaaagaaaagcatctcaatagtgtccccagatgaaaagcttataatatgaggaatagcaacaccatgtaaaacttgcttgacaaagaaaaaaatcacaaatcaagtataaattaataattagataacgtcccaaaagagggatggagggttcaatatcagaagaaaaagagctaagaaatcatggatataattcattgagaatggcagtgccaaacaatatagcagacacagatttttaaaagatattgtttgattttgaccttcgaatgaattggctggtcagtggagaagacaccggcgttctctggccccagtcaagcattttaacataaagaattcacgaggatctggataggaagaatcattatcatgaaaatggccatactgctcaaagtaatttatagattcaatgctatccccatcaagctaccactgactttcttcacagaattagaaaaaactactttaaatttcatatggaactgaaaaagagcatgtatagccaatataatcctaagcaaaaagaacaaagctggaggcatcatgctacctgacttgaaactacactacaaggctacagtaaccaaaacagtatagtactggtaccaaaacagattgtagaccaatggaacagaacagaggcctcagaaataatgacacacacatctacaaccatgtgatctttgacaaacctgacaaaaacaagcaatggggaaaggattccctatttaataaatggtgttgggaaaactggcttgccatatgcagaaaacggaaactggacctcttccttacaccttatagaaaaattaagatggattaaagacttacatgtaagacctaaaaccataatacccctagaagaaatcccaggcaataccattcaggacataggcatgggcaaagacttcatgactaaaacaccaaaaggaattgtaacaaaagccaaaattgacaaatgggatctaattaaactaaaatgcgtctccacagcgaaagaaactatcatcagagtgaacaggcaacctacagaatgggagaatatttttgcaatctatccatctgacaaaggtctaatatccagaatctacaaggaacttaaacaaatttacaagaaaaaaacaaccccatcaaaaagtgggcgaaagacatgaacagacacttctcaaaaagagacatttatgtggccaagaaacatgaaaaaaagctcatcatcactggtcattagagaaatgcaaatcaaaaccgtaatgacataccacctcatgccagttagaatggcgatcattaaaaagtcaggaaacaacagatgctagagggaatgtggagaaataggaatgcttttacactgttggtgggagtgcaaattagttcaaccattgtggaagacagtgcggcgattcctcaaggatctagaaccagaaataccatttgacctggcaataccattactgggtatatacccaaaggattataagtcattcttctataaagacacatgcacacatatgtttattgcagcactgttcacagtagcaaagacttggaaccaacccaaatgcccatcaatgatagactggataaagaaaatgtggcacatgtacaccatggaatactatgcagccataaagaagaatgagttcatgtcctttgcagggacatggatgaagctggaaaccaacattctcagcaaactaacacaggaacagaaaaccaaacactgcatgttctcactcataagtgggagttaaacagtgagaacacatggacacagagaggggaacatcacacaccaggggatgtcagggagtggggggctaggggagaggtagcattaggagaaatacccaatgtagatgatgggttgataggtacagcaaaccagcatggcacatgtatacctatgtaacaaacctgcacattgtgtacatgtatcccagaacttaaagtattaaaaaaaattcatgaggatcaaatagttctttgttttataagaactcttcagtgaaactcaggtgccagccatcagccgaaatgtacagcctgttgttataaaatgacctgtaatctcatctctcaggtatacttgctagtatatttaatactgccactattttttctttgtctagatatgcatacatgtttctctttgacaaaaatgacattatattttaatcctctactgtaatcttcttcacttaacagagtcataaaattttttcttgcctttataacagaattcaagtattatttttttacatgtgtgatagtctatcatattctttgctactggaactagttttctttcttgcttttacaaataactaaaaaaaatgtagagtgaaatctcaattacagaggctcctgccattttcaattcaagtctctctttttcacaaccattagtatgaattctgttatagtacctgtcagttaatgttttttctaaacaatttaatctcttaggtaaaaggtttttttctttaacttttcagatatttgacctgtttactgaacaaatataagatgagatcctactgtcataagcttggcgggggtgtggcatcatcttacagcttctgtgtagattgccttccatggtgacttgtacaaagtggcgtttaataagtacttgaggctaggtggagtgactggtagttcaagtaatgaaataacatgctgatgagggtaaactgctgcaagtgtaatggcagaggaaaaaattacaaggctgtgtacttagaaaaatattgcatccatagggatagaatgatgagctcagaccatttactgttggtccctgggaaaaaaatatttatagatggttctctgaagacgactattccagtacctgctattgtcacagacatggccaggaagggcaccggaactgagcgctattctactctaatataaaagtatagtactttaaaatctgaagtgctggtgctcaccaaaaaccaaaaccaaatactactgaatggctctctaaaatttacatgaaggtaaaccgaagtgtgtaaaaaaaattgtctagaaaggacttcagctttgaaaagtattaaaatgtgaagtgtatatggtttaggtggccacagatttttaaaaatctttgaaagaggcgcacctaggaaaaatataaatatgtactacaccgaacaatggcaatggtgttatgaaaaactgtattatgcaatgaaagagaagtggagcaaaattaaggcaaaccttgcagatctcagatgtgatatttagaaagagaagcatgtggtgggaattactctttagtcttgaagtcaatgtgaaagaaaacatctctactcttcataaaatagcttttagttttactgtgaacaaagaagcaagaggttgaaatgacctttactctcctcctggagggtggtttttatacattttgcatgacaaacaattacaataatgtatactgcctaaaacattgagacttttcctactactttttggctttacaacctcgcctcagagtattttctctatgtattttctcttgaaaacttggagttaaggaccgctaagctggtgggcaagatgtgatgtagctaggaagcttctggtattctttccattgtggtcaatatgataagtttttacaaaataatgttgtgaaataaatacacttatcatttcttgttggaatatacttttttgttaaatacataaggcaatgtttacttcagaatttttatttgaaacccaaactcaacaaaacaatgactgtgggaagaaagttaatcatttacattttgctaggtagccccgagtagtagatttaaaaatatttagcagtttctactgtagttataattgctgtcaccagaaaaagtcagaatgtgtttgtctaaattgatccctaaggtatagttatagttacattttagtttctataattttttcatggtaattttattttcagtgaatgtagtttatggaaatatttgcaaatttttattatgaagctgttttttaagtgaaacaagttttagggaatacctgttatttccttaagaaaaagaacaaagccccctcctttgccatattgctaaacaaggcgtgaccttggatacagtttatctaccactgtaaatatacttagttattttgagatgtcttctttcagagaaaatacctatatgacaggcttaataactaacatattataaagcccacacagaatgatcagataacaaaatgacataactttcaatggcgtattagctgatgagaagctacacactgaagcacaaacccgaatgctagactgcctggtttcaaatcccagctccgccactagctgttacgaatttgggaaaatcattccctccttgtaactcagtttcctcacctggagtgtgtaataataacagcacttttaaagcccttaacacatagttcctgggacatagcactatagaaacattggttatatacaaataaatgttttggttacatcattttgcttgcaaggaaagagctattttatgctagcacacagaagaatccacattgggtagtaaacaagacaagagactaatgggaatccaaaatcagactcactggataactaagctttgtgaacaccggcagtgaaggtaagtttgaaatctagggggctccattgactgagcaagaggagtttgtgagactcgactcctgctttgctggtcatgtgatcctgttcagtctgtgtgtctgctttctcctgtcccactatcagttgacttcctctgcttgctagtagtttctgctcactgataattttagccagcatggattcagccaggccctgactctgagaaagaatcttattagctcaaagcattgatttgagccaggacagtcatccacctgtggagtggttgtccttgtaacagtcaccactgtagccccaggacactgttgggggtggctgggtcgtgtggatgtaccagcggccataggcatgcagtcatggtgactggcacatctggtataattattcatgctgtgacctagagggccttaatatggatatatggatatttatatctaaagaatacatatgtaggagggaagaacaataacaagtatgtgaatcttgtttctattcttatatctgcaaagcatcttctaaaatgttacctggaacccaacaggaaataatattagctgtgaacggaaattgcagacagacagtggttcctttctgctgagaaagggaaattattttacatctagaattggtttattggatgtacagaaattttagggagatggaaaaatacattttacattttgaagcatcacaggatgcttttaagattctaaactttagtcatgtaagaggtttgaaggggaacattatgagctgagtatttgttaaaaactcatagtgcttaatgttgccttcactttgatttttatagcttttgaccatatttggaaattttctagagaagccagttgtcatggaaattttcagcctacattacagcacactagtgcatatgtttaatacagagctggatgtgtgtaagcaactgtataatgaacacatgaaacaggtaagtggtggataaggttggacacatttacaatatcatttaggcggataatgaccatcaactagaactctatgtgattatatctaaagattagatataggcactacatttttgtgcttttatttaactggtttcctcatggagatggtaaacttgctttaggactgtaactcttctagtaatcaagtgattaaacacatatgttttatactactgtaaaaataccaaaatgaaaaattgcttacagggttggaaaccattctgactaaatgttccctttcttcctcttcaccaaaatatcaacttgcagattgaatgtggtcatgtagttcttaacaagaacatgccatttacctcaggaaatatgaaatgggcccagcaggttctccaacgacttcaaatgttttggtcaaacttcgcatctctccgttatctgtaagtagttaagcttaggtcatggcaagttattctaatggtacgggtgacattttatataagagagtgagctgttcatattagcacttaggaagccattgccctgttcacttctctcactggttgggtttgtggagagggattcattcccatggttttggaatatttctaatgggactcttagaatttcatatgcttacatgttttctggtcctttttttctttttccttgtcctttccacccaccatgtttggagtttctcgttattgtttttcctttttccaataaataacactgcttttataatgcaatctttgtacctttttcttctcttcctaggagccagtagcttgttgctatcaacatttagtaaaatcttgagtttcattcatcttataactttatcttttaaagcaaaagcaattaatacgcacataatttggtcttgactgtttctcttcctggttgtttatagtgtattatattttatatattgtattactatacaattattaagcggaaatctatctaatatacgtataaaccagtagaaaaaccttattcctacagatttttgggcaatcctgatcacgctttagtttatcaaaagtatgttgaaatgaccactttgcttgatcaatttgaaagtcgtatctataatgaatggaaaagtaatgtggatgaaatctgtgaattcaatttgaatcaacccttggttaaattcagtgccataaatggtcttctctgtgtcaattttgacccaaaggtagggatttgattttttaagatgatttataagtgccctttttattataagcctatttctgatatttccagtcatttgtaatttacatttgggaaaatgtcagagttgtgaggactgtaactgtaaacaatttcttacaggtcttcattgtagagatttgtttctcaaattctactaattactctattaatttgtattgtaattgtttctttaccacgccaccctcactagataatgagccactgagagtagcatccgtttcattgcatctttatgctctatgtttctagtttagtgtctggtacttggtgacagttagtaaatgttagctcaactgaattgaatcatttgtctttgccggacagtttctggcttaaatatattcataacatacaccagtgttttagttaaaatttcatcacgtaagttaagatttggggaatcaacagaatacacagaatgaaagacacgtcacgtttttgatgagcactggtagattttaatttattgtcatttctttcaaagggacaataagcttgtatatggtaattaaattgatggtaattttaaaaaacataaaacatattaatataaaaaatattaagttaaataatgtccaggatgaatattatctttattgaacaggtcttttgttaatgcatggtaagtcatgtaacaaaggaaatttcatatattttctcaattctcataatttcattacatgttatgtaacaatgggatttttgttaccatttatgtatgtgtatgtgtatataattatacaatatgtgcatatatttaatcaatgctagatgtgcatgtatatatgtatgtatatgcattgtatatattttaaacaaacgatctccaagtctggcagcttgctagatatgagacataaaataagctttcttttctatttaccaccatgggtatgctttagggtaaggggcaagcttataagaatatctatttgtaatttccatgacaaaacacaaaatgccttaaacatctagctgaatttttaggggatgaagattatacattcactattagtgattacctggagtctctcatggcagtcaaaatgcatgcctaggaagtgggaaagttagcctcactgagttggataagcatactctgcacccaaattctgatctgtttccctaaaatatgtacagagaatagttgactttattttgctagtaaaactcagcacacatacctaaatatatgacatagttaactgaggattcgttctactttctgatttcataaaaccaatttatagaaactaatttcttgagatgtttaaggataattcatatacctttactatattatgaatgtatgatttttgtttttaaaaagtatatgaaacaaaagtctatttaccttgatttggaaatatagtaatacttggataacatcttaagtatttcaagttaaacttgagttaaaatagaatgacattatgaaaatatgcaataattttaataattgtattttaatagctagtggctgtattgagagaagtgaaatatcttttgatgttgaagaaacaagacataccagattcagctttagccatcttcaagaaaaggaacactattttaaaggtttgtgatttttgttaaaaaaaagatactagggcctattatgaatataaatattttgaattttaattattatatagatctatatgatatttttacacctttaagacagagaaaatagctaacatatttggcactttttgttttggggttttctttgctcagtacattggaaatcttgaccttcttgtgcaagggtataataaactcaaacagacgctcctggaagttgaataccctctgattgaagatgagctgagggctattgacgagcagctgacagcagccacaacgtggctgacatggcaggatgactgctggggctacatcgagagggtgagggcagccacgtccgagttggagcacagagttgagcgcacacagaaaaacgtgaaggtgatccagcagaccatgaggggctgggccaggtgcgtgctacctcccaggagagagcacagacgagaggcagccttcaccttggaggacaagggtgatttgtttacaaaaaaatacaagttaatccaaggagatggctgcaagatccacaacttggtcgaggtaatggcttttaacctttcaagatttatagatcttttcattgagttcagagaagagcaaaaatctttaacctaataatgtgggactcttttatcaagcctgaaagagctttatgaatggtattattaggcatttaaagtggaggaatttgtgttacttgcctgcaatttctgtagccctcaccactgtcattcctgagggaagagattagaatgtgagatgtgttgattaaacagaaaggctagtgatagaatctttatcttgtcacagttgcatcctcttttggatgctccttatagctaccactgtttgttgactgcctcgtatgtgccaaacaaacaacttccttaggtcatctcaaggtaccctctcaaccatctcctaagggtggcaacaataattactctccttttaacaaagatttgagttcctaaaacagtaacaggcactcatctaggcttgtgaatgcaagagaaaacagaaaaaaaacacacacacacacacaaaaggcagaaggcaggaaaataaaagcaaacaacacaatgctcccctgccaaccaccaccaaatcctttatttcatggagcttacactctagtcagaggaagttagcaagagaaaagaacaaatagatatgtcagttgtaataggagcaatgatgaaaaatagagcagagcaggtgggatagggagtcgcttgcgggtagggtggttgggcaggcctctttcctaagatagtatttctgcagagaactgacagggaacaaagcatatggatatcaggagaagaacattctggagagcaaaagtatagacactttgaggcaggagcagcctggcctgttccaggatcagtcagcaaactgagatcagaatttgcaaggggagtggtagtagagggtgaggtagaagagactaatggtacattatgtggggttagcaggctgttatgaggactttggattttaccgtaaggggaaagagcagccagagactttctgctcaaaggctttccctgtggagggtaagccacaggcaagcaaagaagtggttggcagggagactcttcagagcctatgctaataatccaggtgagaaatgatgctgccttgggtcatagtgctagtgatcaaggcagttcatatcctgcagatattttgatggcagagccagcagaatttgctttgaggaatcagaggagagagaagtcaaggatgatttcaaggtttttggtctgagtgattggactggactggggttgccctttaatgatatgaggaagactgtggtgagcagattttgtagcagaaaaaaaaaggaggtttggttttggacaagttagttagagatgcttgtcctaagggacattttgagtagactagaattgcaaatgtgtcttgtgttcagggcaaaatccaggtaagtaacagagaattgagatttatgcacatatgtatggtatttagagccatataattagattaagaacatgtgggaattgtagatagaaaagaggcccaaaaactagcctcgaagtcctccctaggtcagggagaagaggaaaatcccacagaggatactgaaaaagagagagtgatgccctggaaaccaataatagaagggatttcaaggaggaggaagagctcaactctgtcccatcctgacgtaggacctgaaaataaagacggaggctaaccctcagatctggcagcacggaagtcattgggatgaggagaggtgatttcatgtggtggcagagtggaagcttggtgggagtgggctgatgagagaatggggaaatatgagtggaggcagctgaggagatcctgaggagctctgctgtgtggcaaaccaacaactgggcagtacctggggcctgtgtatcagggtggggagggttttatttttaatagtggttgatgtttcaggatgtttgtatgttaactgcagtaatctaggaaggagaaaaaattgttggaagaaagccattgagggaaatgggatttagtaaatacctgtagaaggtgtctttagacaggagcgcggagcattcatctgtagtacaggatggagggaaggcaaagataggaatgtggtgctcacagatgtgcaatgctgatgatgggaacatggggagttgatttcttgttgttactatttcttaaggaaaaaagggataggaatgaaagagcgtatttcatgtttcctctgagcatccttgttatgtggagtcttctctatagaccagcacagtccttaatccatgaatactctcctttgggcaaggcagacagaccccctcccctgcccctgctccccccagacacaaaatctctctctctctaacacacacacactctctttcacacacacatactctttttctctgtatgtcacatactctcacacacagtctcttcctctcacatatcacacacacactcacacacactctttctccctcatgcacactctttcatacacacatacacacacacacacacacacacacacacacacacactctgaagccatcatgaagtagcacagtgtggggtagggaaagtgtccttggtaaaggctggaaaccagagtcttccagaggctgggcctgaattttctcatgtgtaaaatgaaggtccttgtctctaggataattctcagcagaacaagaaatagattacggttttcctgctgggaattgtatgcaacccattatgtatcttgtctttgcagtccatcatcattcacttatttgagaaatatttattgtgagcattgtgtgtacccagcacctttctaggtttttgaaatatgagagcagagcagacaaagttccttgctctcatggaacttgaatcaagtgaggagagagacaataagcagtgacatagtaagtcgtgctgtgttagaactggtacgcgctgcaggaaaaagatcaaattggagcagggcaagggaattctggagggtggggtcgaggatgcagttttaagtaggatgatcagagtaggcctcaaccagaaggtgaaatttgaacaaagacttgacagaggtgatagagtcagccaagtgggcctttggtgaagagtgttccaggcagaggagatagttttggggcaggagatccctgggcatgctcgaggaggagcagggaagtaagtgtggggggagtagagggagctgagtggagagttgctgaggtgaggtcagacgctaagctgcgtggtgagggactggcagctcaggggaggcttcataggcctttttgcagattctggctttggctcactctgaggtatgtgaaagacactgcagaattttgagattttgagaaggggagtaaatacaatctgactttcattctaaaaggatttctggctgttgtgttgagaccctctgtagggaggctagggaagaggcaggccgacctggtaggttgccattcttactagtaatctaggggttccgtatgttcaggctgatatagcaaaatactctaaactgagtagctttaaaacagcagaaatggttatctcatagttctggaggaccaggtgccagcatgatcagtttctggcaaggcccctcttctaggttgcagactgccaacttctcattgtgtcctcacatggaggaagttcccctgggcctgtttcatataggcagtactttcattcatgaaggctctgccctcaggacctaatcacctcctcctaaacccctcctcataataccatccccttgggggttgggattttcacattcaaattttgggaggacataagcattcagacagtggcacaggcacgtaacagatgatggtgctggaccagggtggtagcagtgaaagtgattagaagtagttggattctggatatattttgaattaagtggagcaaacagagtttcccaaagactggatgtggagcacgaaagaaagacacgttaaagattattctacacattttgtcatgatcaactggaaaggtgaatttgcaatctattcagatggggaagggtatgagaggaagagacttagcagggaaggtcaagatttcagttttgggcattttgaatttgaggtgttaattagccaagaggagttgagtgggctattggatttactcatttagagttaatgagaggggtccaaactgaaaacacaaatgaaggaggagtggatggcaatgatatttaagccaggagactggatgtgatcaccgagaacatgagtttagctagagaatagaagaaaatcaaggactgttggctggaccaccattcttctcttaggagaccagggagaagaaggaccagccaaagatgcagaaaaggaaaggctgagacagtaggaggaaaaccaggacaggaagccgagtgaagaaagggttcggagggtaacagattttcttaccaaaacgtaaagtacagtacatttgatatgctctagtggatatggagaagaaaataaaaagaagtacataattaacatgggtttcagtgtttctgttgacttccagtgttttctaaaatttctaagaaagttttaattttcccatcaatgacaatttgctaggacaaagactttgtttctgtcttctttgagtactgcctggaatagcgtcccaaggctgccatgacaaggtccacaaacaggctgtcctgaaatgaaagaagtttattctctcatagtctagagggctgaagtctgaaatcaaagtgtgggcagggccatgctccctcagaaggctctgccaaagtcctgggtagcctggagagaatctcaggggtgtcctgacgtgtaagggaggtatttatctagaaattaatttgtttttcagcagtatcttaactaagtcatgccgtggactatttctagttgttcaataaatgctgtgaattattctctgacttttaagacatctctacaactgtttatgtgttagaatctgtctcatagaggacagatgatggattacggttagttttttctgttacattttcttgataataaaaaaatgtactccccaaactctaaggatttaaaccattaagatatgaatcctgatgaaaatgcattaaaagtatggccaagacatgactagaaatcatcagaaaacaaggttttgcattgtcatctcagagaaaaatgttagaattttttgtattaataaatggattctcctatttttgtccttaaggcaaaaactaggaagctttgaaatcactgttctcaatccaagaatggaagagagcttctgccttgagggaatgtaagccagctttaaaatggaaatgaaatgattatttgtttccataagttgggtcttttaagtgattattttcctcttgacttagcacgtgatgttgaacctagttctcaggcttctggtgaggaacatggtttggggaaaagctgtagaaatatggccaagggtgagtcagttctgccttttgcatgctgcatgttttctggctggtggcatgtcagcgagtggtctggagtcagagttaaagatggagagaagagaggagcaggaccatggaatattgggcctgagtgatcattcagttatctaaagctctcctttctcttcctttcgctccctttatccgaatgtgctgaagatacagcatttctcatcaatgtgactgtagtgaggtaaactggatctcttggtatgaaaaagtgtgtatgaccgtgacatgatgggaaaggccctactctgggaggtcaagagggctggtttctagtcctagctcagctattaacttcctactagtgcgacgctgaatgtgtattaggtctttgttttcatgtctatgttagtatgttttcacactgctttgaaaaaaagaactacctgagacagggtcatttatgaagaaaagagatttaattgactcgcagttctagatggctggggaggcctcaggaaacttacaatcatggcagaaggcaaaggggaagcaaggtccgtcttacatggtggcaggagagagagcaaaggggaagaaacacacacttatcaaacaaccagatctcatgagaattctgtaatgagaacagcaagcggggggttggggcagggagtctgcccccatgattcagtcaccttccaccaggccactctcccaacacatggagattacaattcaagtttagatttgggtgaggacacagagtcaaaccgtattaatatctttaagatgaggagacttaacaagatggtctctaaggatttttcttcagctgtaagatctatacttttctcttttagtgcctacaaaggggccagggcagctgtgtatactttcctagggtgtgtactgcacaattccaggggtgcatgtcacatgattacacagatgtgaatggttccacctggctggtaggcaacacagcattcctgagaaggagcagttcttaaatttttttgagagctagggttctctcatctctcccctgccttattaggatctgtacttacctctctagttctgattcttgcttacaacataacacctttgcatcctggatcatatatccatagtaaagaataatcaaagaaaacagagagtatagtccaccttacaatcagctcttattccagtgtcaccttataatcagctcttattccaatgtctcttttgctctgtgcttcagttcctcccttgggtatctgccgtctggtctgtatagaccatgcaagtttagccactcagcctctctagaatcaactttgctgcccacctgaccttttgaaacctgtgtctctaggcaagcacactgcgtgctcaacctgtagtggtccttaaccacacctctgtcttcaggtcctattttgccccaactggcttgtccattgtgtcgcccaaactcttgggagacactaaggtgcaagaagctcatattgttgatgcaagaagggagcttagaacttccctagtccagtgttttctaaactgggtctattccacaggttgcttatcatagatggtatgcaaaaataaataaataaataaataaataaataaataaataaattgtgcttaaacaaggtctgaaaacatgaaggtttattgtacagattattttatcacccaggtattatgcctagtacccactggttatttttcctgatcctctccctccttccaatccttaccctcctttagatcccagtgtgtgttgtgcccctctatgtgtccatgtgttctcatcatttatttcccacttaaaagtgagaaaatgcagtatttggttttctgctcctgcattagtttgctgaggataatggcctccagctccatccatgttcctgcaaaggacatgatctcgttgttttttatggctgcatagtattccatgtatacacgtaccacattttctttatccagtgtatcattgataggcacttaggttgattccatgtctttgctattgtgaatagtgctataatgaacatacatgtgtgtgtctttataatagaatgatttatatcccttttggtgtatatccagtgatgggattgctgggtcaaatgatatttctgtttttgggtctttgaggaatttccacactgtcttccacagtggttgaactaattaacatttctaccaacagtatataaacattcctttttctgtgcaacctcaccagcatctgttattttttgactttttaataatagcctcagtggactttaatagaataggtacattgtgagtctccaagaatggcatagagtacatagtacttcactgacttgatagtcttcagatgttccagaacagtgttctctgaaggaccagtttgacagatctctttatttatacggaaggccctggaaggcaaagtctaaggacacagagttagtgacagagcaaaaactagagcccaggtccaaaatgtctagaattcactgggaactagtgtatttcctgtctgtatctgaagatagcaatctttgtagagaactttccttgaaacaacttttgaatgtatttcatgtgtgaacttaatgttctaaattcctgcttagatctttgacatctagcttaaggttctgcaacttagtatttgaatgttcctgtcttgtgcacaacaatgcagtctcttcttttacaaactatttaaacggagagttttagtttttatgctaattatttgtttatattcatccactaatacttgtctgtttctaggaaaataggaagctcttcaaagccaatccctctctggatacctggaaaatttatgtagaattcattgacgacattgtggtggaaggcttttttcaggctataatgcacgacttagacttctttctgaagaatacagagaaacaattgaaaccggcaccgttttttcaagcacaaatgatcttgttgcctcctgagattgtgtttaaaccttccctagacagagaggctggggatggcttctatgatcttgtagaagaaatgttatgcaatagttttagaatgtctgcccagatgaaccgaatagcaacacacctggaaattaaaaattatcaggtattttcttagtaaatgggtatttagcttttatattaatgattcaaaaacaaattgtggctgagtatggtagctcatgctgggaatcccagaactttgggaggctgaggcaagaggattgcttgggcccaagagttcaagaccagcctaagcagcatagcaagaccgtctcttaaaaaaattaaaaaattagctgggtgtggtggcatgcatctgtagtcccagctactcaggaggctcaggcaggaggattgcttgagtccaggagttagaggctgcagtgagctatgattaagccagtgcactccagcttgagtgacaaaaccctgtctcaaaaaaacaaaaacaaaacacaaaaaaccaccagaaaacaaaacccagaacaaattaggaaaatgggaagcacagggaaaagagaagttggaaaaagcaacatgatttttaatttttctaactactctccctttgaagaattaccttggtaatgttatgttgtagataattggtaaagtaaggttggtttgaatagtaagtgctgtgttttcctctcatttagaatgatatggataacatgttaggcctggcagaggtcaggcaggagatcatgaacagagtggtgaatgtcatcaacaaagtcttagatttcagaaacaccctggagacccacacttacctctgggtggatgatcgagctgagtttatgaagcattttctcttgtatggccatgctgtgtcttccgatgaaatggatgctcatgcaaatgaagaaattcccgaacaaccaccaactcttgagcaattcaaagaacaggcaaggaaaacccttagcatttaatgtagtgaaatggcttttcactgagttgttctaattaatctttttctcactacagattgacatttatgaagctttgtatgttcaaatgagcaaatttgaggactttagagtgtttgatagttggttcaaggtggacatgaagcctttcaaagtgagcttgttaaccataattaagaaatggagctggatgtttcaggagcatcttttgagatttgtcattgacaggtagccttttactttggtttttggaattataactttctaaactgctttctaaaactgagatgttacttttaagcgtattaatgttgccagtttcatgatagagataaatgtttaatcaggtacataatgaaaataagattcaatcagaagtcttatactgctaaatgttttaataaacttaatttgtgtgtatctatgtacatatatatttaatagtctgaatgagctacaagaatttataaaggagacagattccggacttcagagagaattaaatgaaggtgatcatgatggtttagttgacatcatggtgcatcttctggctgtaagaagccgacagagagctactgatgaactctttgaacctctaaaagaaacgatcaccctcttggaaagctatggccagaagatgcctgagcaggtctatattcagctagaggtaagtgcagaggtgaaataatcataattaccataaattgagcatctcttttattaaagtactttacatgtactctcttatgatgtccttataacaatctatactgtacacatttgatgttttcaatttacaggttaggaatctgatacttaaggagatttaataactttctcaaggtcatgcaaatagtaaagccagccaacactctcggtgtgttttatgacaaaatacttaaccactgtgctccactgccttcttattagaaagaatgtagattgtaaagaacctatgagttgcttttttgagttcagttttaccatcatttttcacacatgaaatatatccatacttttttttttcattcaaaaaaactacctgtcagtcaagaagtgccctagtcttgcaaacgtatcatggatttgttaataaagaataaataggccaggcgtggtggctcatgtctgtaatcccagcactgtgagaggctgaggcaggcagatcacctgaggttcggagttcaagaccagcctggccaacatgctgaaaccccatctctactaaaaatacaaaaattagctgggcatggtggcacgcacctgtagtccacctactcaggaggctgaggcagaagaatcgtttgaactcgggaggtgaaggttgcagtgagctgagatcacaccactgcactctagcatggggacaaagcgagactccttctcaaaataataataatactaataataaataaatgaaactcaatttggatggggaaatcactgtgctttctaaatagatttctatgccatccacctgtttccatgctgtggaaagatttgggggctttttaacaacaaagtctctttaattagaactgaaatcatgaaccacagtctcacaatttagattctttttctatgccaatattgatattttatagattgtgtgtgtgtgtgtgtgtgtgtgtgtgtgtgtgtgtgtgtgtacacacatgtacttgaattttgcaaatgtgatcagtggacacattaaccaaaaagctttcactggattctagttgatctagtttagtagtcagagcacagaactcaaacttagatttgttttcaagtactgtatgagttcatcttttctgtttgccttgacaagtttgttaatgtctaagaccacacttactttttgctaaaatatgcctcatgatccctcatttaaacaatttctctatacttgctcccatcaatttctgtttttttcttttttttattgaggtgaaatgtactattcggataacatataaaagtaaccatttaaaaatgtacaatttagtacaatattgtgcaactaccacctctatctagttccagaaattttcatcactcccagaaatcccataccacttctctgtctctccccattatcctcctccatgccctgccaagccttgcaaacccctacccaccaatccttggcaattcccaatctatttctgcctttatgggttcacttactctagatatttcagatagatggaatcatacaatatgtgacctattttgttaggcttctttcacttggtataatgttttccaggttcattcacattgtagcatgtgttggtacttcatttctttttatggctgaataacattccattgtatgtccgtccataccaccattggcttatccactcgtctgtcaatggacatttgggttgtttccatctttgggctattgtcagtagtgctgctatgaacactggtgtgtatttatttgagtatctgttttcaattcttttcagtacacctaggagtggaattgctgggtcatctggtagttctatatttaactttttgagccattgccaaactatttttcacagtggctgttttgttttatattctgtcattttgctttgtgaggattaaatgcagcagggtatttacaagtgctctcttgactataaagactatgagaattactgtatatgaattgttaaattctatttaagtataaaactgcccttagagcttgcaagccagttagacatggagcaagatgacaagttctagacagatacatacataacaagatgaagagataaaacagttacagtagaaacaactataaatagttcttgtttctaggaagatttagatattccttgaatcagatgttgaaccttaaactatatctcatagagaaagtagtcataataagtaattgatgagggaaatttagatatggcctccagaatttgtattatataagtttggttcactctttcgggtgatggtagtattgaaagcattaggcttttcaacatttcaaaagcagaatacaattttagctgtgtatcagtaatttagacttgtcaggagggaaaataagattcataggcggtatgtggtgtatttggagggtaacgaggcccaattttattttaatttaagcaacttcaagtgatagttactttcagtttctcctttgttattatgagaagtcataacattttccaaatacttgtctatgcttagttctgtgggaaaacaccctaaagtctggctatgcctactaagagttgaagtattacttccttaaagtcatgaggactcaccaccagcaagatctttgtcctgttggagcatctcttcagtcttttgcctcttttcactgctgttaacacccactttaattcagctcttgttacttctcacctcacagcaacagccccttaattcatcccattcctcctcacaccccacccacaatatactctgaaacaagatgaatattctgatctgcaggacttatccagtcccttttctgctcagaaaccttcattaactgcccctaacttcccgaatgctgtccagtttccataagagctcacacactcacaccatcctgtattggtcgtcatacctcaagggatctcaccctaatctctgcctgttgaaacctagtcatttcgttgagcctcagtttcagtgtcacctcctccttgagtggatcatctgactttgagaggctttggagatcatctgatcttttgggtttcaagaaaatttatttttaccaagtaaaaacttgtttggaatccccaaatataaagcaggtttgttgtgtttgaagagggataaggggacctgagctcatggatgtaacttcctcctggcttcccagccatggcctccgagggactccatggaatacttaggttccatggaatggaattggaaatgcaaagtgagactctgtctgtacagagggcggatgcagagttttgatgagaagccacgagagggaaggacaaaggggtttaaagcccaggtcccttggttcctgagctggtttggtattcctgtcatgtcaccaaattgtctcccaactgttttgattccataacacatagacctcctgatagttagcacattctgttgtgtagaatagttattgtgtgtgcctcttgctcactctgacagattataaaacaatttgagagaatgttttacctttttagcaccctgttcaccacacaaatagtatttagacctagcacagtgcgtttttccataactggcagttactgaatcgttcatcaaatatttactgaggtttacaaaatagtctttagaacctttgagttttgcacttcagctacaagtagagttccatcactgtgggtgggtttgtgtgacaaaacaatttcactgtcccaggagatgaccgagaggaacaattctttgttaattgggacacaaggaatgcttttcaacagtaattatgctccatgcattgctccttaaagaaaataacttgcttttgtcctatttgcattgtaggcagggagagcagagttgagttggtacctgaactatttattgtgtcttttgtcctacatagagtaggaattaacctttcttccctttgccctcttctcccttcaaaaactcctagtcccctaaaataaacccaacctcaatcctcaaactctccaacaagaaggagaatgtacagagctttgggagctagagaaaagccgaggatgagattgattcacattttcatccttgccccagcattttcaaagcatcttttttttcacttgctaaattactaaacatggctggcttccatttctagttgttagagatcaacaaagtcatttccagagcacttcaattttattcccacagcagcaaaacaattaggagatttgtgtttattttaaaaagatttccatggattctgagatgagaacaattctggtacatgctttggagttctgaacccagcagtgccagtgaatcagcctgtacttcagccttggttctaagccttttcatcactttcatccttttttataaactcattatataagaatgaagagatgtcatgggttagtgtaaagaaattagaatcatttacatggacatggtggctcatgcctgtaatcccagcactttgggagccagaggcaggtgaatcgcttgaattcacgagttcaagaccagcctgaacaacatgctgaaaccctgtcctacaacaaatacaaaaattatctgggcatggtggtacatgcctgtagttccagctactggggagactgagctgggaggatcacttgagccttggaggtgaaggtttcagtgagctgagatcatgccagtgcactccagcctaggggatagagccagaccttgtctcaagagaaaaaaaaaaaagaaagaaattagagtcatttaatcctatagggttgatttgttttaggaattgaagtaatttcgcatttgtgcctttgcttttgcaggaattacctgaaagatgggaaactaccaaaaagatcgcagcaactgtcagacatgaagtctcacctctccataatgcggaagtcactcttataaggaaaaaatgtattttgtttgacgtaagctagttaccaagtttttgttttaagaaaggttttactaggataattgaagtatttgtttgaaattcacttttttttttttttttttttgcaatgatcaggcaaagcaggcagagttcagagagagattcagacactatgcccctcttggatttaatgcagaaaatccatacacagcgcttgataaggtaatacagatctcaaatatcctgtgtgcattaaaatagctactttaaaaaatgtaagtttagacacaaaatactgccacattttgtctttgttttgctgttataggaattgatttatttaaaacccagttataagcaatttccccttaagtaaattgtattgtatttcaaatcatgcctcccaaaaccatcatcgtcattgtattagggttctctagagggacaggactagtaggatagatgtatataggaaagggcgtttattaaggagtattgactcacaccatcacaaggcgaagtcccacagtaggctgtctgcaagctgaggaacaaggaagccactctgagtctcaaaacctcaaaagtaggggagccagcattgcggccttgagtctgtggccaaaggccccagactccctagcaagctggtgtaggtccaagagaccaaaagctgaagaacatggagtccagtgttcgtggacaagaagcatctagcacgggagaaagatggaggccagaagactcagccagcctagtccttccacattcctctgtctgcttttatcctagctgtgctggcagctgattagatggtgcccacccagattgagggtgggtttgcctctcccagtctcctgactcaattgttaatctcctttggcatcaccctcacagacacacccaggaacaatactttgtatccttcagtccaatcatgttgacagtcagtattaactatcacaatcatcatagtaatcatacgagagacagtaacaactactactattttttgagtccttactatatgtcaagaattttgttaagcatatgactttcattatttctttttaattctcagtctccctatgatatggcttgtattacttttcctctttcaattaaaaaaacaagcttgtggccgggtacggtggctcacacctgtaacccaggcactttgggattcgaggtgggcatatcatgaggtcaggagatcaagaccatcctggccaacacggtgaaaccccgtctctactaaaataaaaattaaaaaaaaaattgctgggcatggtggtgggtgcctgtagtcccaactactcaggaggctgaggcaggggaatctcttgaacccaggaggcagagattgcagtgagccgagattgcgccattgtactccagcctggcgacagagcaagacttcatctcaaaaaaaaaaaaaaaaaaaaaaaaggcttgtataattaagtaattccttgcagatttctgttagtaagtgacagaactaggattaacattctggctatctaaactttttttttttttttaatcagaaattttaaccactataccctttctcttgtgattcttttgcccgtaacttttaaccatagtcaaggaagcccataacttattcttaaccctggacatgaagattgttgagtcattcaatcctagtttataatgaacaactgtactttattatagttgactataagaatgaatatggtgggcaaagaatccaaatggtaagtaattcacagaacacttgaaaagatgttttaaacttttattagaaaaatggtgtctttgtttctctaggaacttaacctggcaaccaaaataagaaaataattgggtgaagtttagatttaggagctgggcacctttctgagttgctcatctagcctgtcaccctgatttcatttcatgctggagatagtcttaactccttagctggatgcggctgacagagcccttacctctctttccaaattttgggttgaatttagatttaattgctttaaacttattcagaaaacaccattctatagcatcatgttgcctctttcacttggcagaagaaaattggttaacatattcattgaaaagggagtaggttagagtatgctaatatacttggttttattttttattttttaaagattatgtctaaattgcaggtggtctgaacagattgtggatggggaaacgtttttacttgactaaccaacatgctgtatgtaaacatttactacagttacttattgaattgtatcatgttcatgctatactataacagcatgtagttacatatttaaaagtcagagactgtacgcttataactacaggaatattttgaatgtagtagggctgggtgaactttttcttgaagtcatgttcttggtgtgtttgttcagcagacatgtctaatgtaaatctagttagactcagtgaaaggcatatgtattattgttctgggctggtatggtggaccctggttctgaaggcatctcagtccacaagacagaaaacactgactttccacaaataaggagaacagtacagtgaatccctccctttaaaatgaggttccctggttaagtactaccgtttcttcacagccaaagatatagtaactgtataataaccagctgaattaacataactgggtatttcttcctttcctttccttttcctttcgtttttcttttcttttctttctttgacagagtctcgctctgtcacccaggctggagtacagtggcatgatctcagctcactacaacctctgcctcccaggttcaagcaattctcctgcctcaacgtcctgagtagctgggaccacagacaggcacgcaccaccacacctggctaatttttgtatttttagtagagacagggtttcgccatgttggccagactgttcttgaactcttgacctccagtgatctgcctgcctcagcctcccaacttgctgggattacaagcatgagccactgtgcccggccataactgggtatatatttctaggaataatggaattagtgtaagtgataggaaaaaaaacgattaaaaataaatcaaagggatattggctttggagattatggtggaccagacattttgaaaagccctctttcataaaacagatgctgaatacatattcacaaatgtgtaatttttaatctgttgcggagttcacaagaacataaaacaaatctctaaagggcaagaaaaaatagaggcaaatgcagaagcctgtgctgctgtagtgaaaatggaaatatcagaagtctagaactatgagattgagtttctcatggggaagtagaagatgctgttaagggtgataccctcattggagagtgggctagggaaggtctgcagcctgcaaaggaagccgatgagatcactgtgggtcttcactaatgctcagagtagggtgaaaaaaacagaaaaggggccgggcgcggtggctcacgcctgtaatcccagcactttgggaggctgaggcaggcagatcacaaggtcaggagatggagaccatcctggctaacacagtgaaaccccgtctctactaaaaatacaaaaaattagccgggcgtggtggcaggcgcttgtagtcccagctactcgggaggctgaggcaggagaatggcgtgaacctgggaggtgtagcttgcagtgagccgagattgcgccacttcactccagcctgggcgacagtgcgagactccatctcaaaaaaacaaaaacaaaacagaaaaagatactctgggagtttgtaaacatattcctgttctcacaagggtctatggtccggttttatactacccctctgattaaggaatttctaagacaggaaattgaaatggttacaagtatcttcctagtaactagtagaagcaaacctaaatcatctctggaaaaaagcactctcattcagtctctttagggggtccaacagattaagttcagtcaaatatgagtacacaataaaacaatgaacacaccattacgcataagagtcagttgaaagaaaccacggatagagatgcatgcaaagtttcagatattagaaggaaataaaagataatattgaaaaaaatgagcaagttctcagttttgagactatcaaccatgatcagttgaatttgaaaaagggccagatacttacagaaatgaaaaatacagttgtgaaaaaaaaaatacaactcagcagatgggttaaagagctcattaaaattggaaagagaattagtgaaatacaaattacattggaggaaatcacttagaacgcagtcataggtgtaaggagatggaaaatataaaagagcctaagggacgcatagaaagaagttagaatgccgtccaactgttctattcatacttcctggaagagagaatgaacagaatatagtctgcaagataatagctaagacttaaaggactggttgtgatggttaaatttaggtgtcaacctgactagattaagggatacctacagagctggtaaaacattatttctgggcatgtctgaggacacaggagagactggtttgtaagttggtggactgagtggagaagatccacctgcagtgcgggtgggcattgtccaattggctgggggcccagatagaagaaaaaggcaaaggagaggcaaatttgctgtctcctctggaaaaggaatacctttctcctggtcttggacatcagaattccagtgtccctggactttggactccaggacttgaacctgcagcctcccaccctcagcatctggttcttaggactttggccccggactgaggattaccctatcagctttcctggttctgaggcctttgaacttgcattgagccacactgctggcatccgggtttccagcttgcaaatagcttattgtgagacttctcagccttcataatcgtgtgagccaatacccctaatgaaacttccctcatgtatctatttattttttcctattggttctgtctttctggagaaccgtgactaatacactggtcaaaacatgaatcgatagattcaggaaattcaccaaatcccaaccaggataaatacaaagactgcatctagacacatcacagtgaactgcagaataccaaaagcaaaaatattttcaaagcaaccagatagaaaagactggtcacttgttagaaatgatgattaggctaagagcatacttctcattagcaacaatcggagccagaaggtagtggatgatgtctttcaattctactgggaaaaattctctctcaataatagtgaaatgaagatatttcaggtaaacaaaaatgcaatatatttaccaccaataaaccattactaacataactctagttatttatagtgaaccatcactaactctagttatttatagtgaataactagttatgctccaaacaatgccaaatttgcttcttagaaaagactaactctatggacaaacctctggtgaaatcatcaagggaaaaacagaaaaacagcaaaattaacagtattagaataaaatagggaatgattgtacagaaacagcagatattcaaaaatatagagcactattaataagaaacttaaaaacttaaaatggataaatttttagaaaaatataatttaccaaaactgtctcagtaaatctgagtagtcatataactattcaaacttagccagtcagaaaataaaaagaaaaatattaaccagtagttaaaaaacaaaaaaatttccaaaacagagactaagaaggctgggcatggtggctcacgcctgtaatcccagcactttgggaggccgaggtgggcagatcacaaggtcaggagatcgagaccatcctggctaatacggtgaaaccctgtctctactaaaaatacaaaaaattagccgggcgtggtggcaggcgccagtagtcccagctactcagggggctgaagcaggagaatggcatgaacccaggaggcagagcttgcagtgagccaagattgcaccactgcactccagcctgggcgacagagtgaggctccgtctcaaaaaaaaaaaaaaaaaaaaaagagactaagaagccctgatggctttacaggtgaatcttaagaagctttcaagaaacggatctcattcacatgattccaggaacctgaagaagaatgaacactcaaaaattactttgtgaagcatgtctgatttttataaaggcatagtatgagaaaggaaaaaaatatagatcagtctttctcacgtacatatagatacaaacatactaaacaaaacaatcaaattataccaatttataaacaagttttcatttaaggaaaataagtttcacttaacattagaaaatcagtgtaattaattgcattaacaaattagggagaaaaaatcgtatgattatcgcgagaaatgccaaaagaactttagctatcattcaacattcattcatgatagaaacacttagcagccattttttacctaataaaagaatgaaaactctacgtaaaatactatacgatagggaacgtgaaaatttccagaagcattagtaataagggtgaaacataggaaaagacaaaatgactatcagaagtaaaaaaaaatagtgtgtattcatataatgtagtactatgcagtaggggaaatgaacttcacacacatcatcatgaatatataggtggacataaatatcaattgaaatgtgatatatgtagtaaactgcatttcacaaacataaattttaacatttagcgcttagcaatacattaatgtgaaaatattataaaaattagattattaaataaaaaggtaggttttgtggttaaatatgtagtagggaaaagagggatgaaattaagaaaaggcattaaaaattattagtcatatttcttaggctaggtggggaacaaacgcatatatccttttatgtgtataaaatgtttcataataaaacattttaaaactaaaagaattgcagttcttgtatgtgaagatataacttgtaaaaatgaaagcaggatgctaatactcttctttacatagtaggaaatgaagagacagagttggggttggggagatgttagttcacaagacttcttgtacaatatggtgactatagttaatagcaacgtactgtattttgaaaattgctgagtagattttaagtgttctcaccacaaaaagtgtgagatgatgaagtatgtgagataatgcatatattaattagctctatagagccatttcacaatatatagattttttgttttgttgagacagggtctcactctgaccaggctgtagtgcagtggtacaatttcaactcagtgcagcctcaaccttccctgatcttacttaggtcattctcccacctcagcctcccgagtaactgggactataggcacatgccaccatgcccagctaattttttttttttttgcacttttaatagagatgaggttttgctacattgcccaggctggtctcaaactcctgggctcaagcaatccacctactgtgacttcccaaagtgctgggattacaagcatgagccactgtgcccagcctcgcaattccaaagcatcatgttgtacgtgataaatatatacaatttttatttgtcaattgaaaaagagttgaaggttgatggaacataaaagcattaagtataggtatttaaagttcaaagaaactaaagtaatacaattgttggatcttgggaggaggatgggagaaaatagaaagtggaaaaacaaagtcaaatccttcttttgcaaagccagtagtaacctagtataatgtctaaacgtgatcaatcaacaaagagcagcttgagcacagaattggaagttacagaaatagcatccaaaagaatgactgaacctgaaggattgctttcctgccttgcaagtgctcctctacaccttgaacttttaccatgtaagcatagtaccattttgttaattaaagatgaaaattaagacttggtcatcacaaaagaaaaaacatgtcagcatttacgtttggtgtaaaatgtaaactattctatgtagatggggtatataattgaaccttgataaagacagtcatatggtgatgttttcatactgggctgtgtttttagctttatgctttatttcacaaattctcttgagtgcatttgatattattgataatctgtagggtattttttaaatctgaaagttttaataaactaagtcattacttaaaatataattcattcttacatggaagtttctagagccccaccttttgttcttcagcaaattccccagctctcggtacaaaaaccaagaggaaaaattgtattcagagaaatctgatgaagaagaaattttgctaatacgtgtatagggacagtattgttgaagttactgtgtttaacagtaatctgttctcactttttgtgcagctgagtttgctcttctaaaacctacattttgccagtaattacgctgcagatttatttttattttcccgttaaaaatcaaagattgaaatgtcgagataaccagagctacagaactgcatgtcttctctttctctggcagtttgtatgcaggtgtttatgttctctccttaggcaaatgaagagcttgaggccttagaagaagaaatgttgcagatgcaagaatctactcgtctttttgaagtggctcttccagagtacaaacaaatgaaacagtgtcgcaaagaaataaaattgctcaagggactgtgggatgtcattatttatgttcgagtaagatgtgctttttcaaaacatgctttttatttagtagttcttttacatatgcagtttgtggagcctatattattctatttgggttttataatgtcttgaaatatgtggaaattagatcctcaccccagccccaaattagagttcatgtatctctgttagtggatgattcttctttgaataccagttgtttttatttttagttcaggatgaaactttgtttaataagctgactgcctcaaatcctttggggagattgtaaagaatataaataaaataaaaattaatatataaatatatattacatgtgtagtcatctgtgcataccaactcatacatattcctatgcttatacttacatgcctgggcatacacaaacagacccttcctaaaaataatttgtatgtggttaattaagttaaaaacttaagtgaaaaagtaagttctagggaatgaggcatattgcaacaagcactataatcttttatgttagttgaaagccatatagaaatatattaacaaaatataaaatatggtcaagaaatggttgatgagagttttgtttataatggttgaaaattgtcatgtgaaagcttatttagttacatgtagaattataaaagtctgttatttaataatctacttatcaatttattcaaagtacacaggattaagtgataatgatggtatgtgtatggaatttatcatcgctactagaaattaatatatcataatgttttagcctttagcttgacgtgttctgacaacttttttgttttggtgatagggaagttttgacaagtgcagttaatattttaaaaattgactttccactggatgatagagttacagtgtatcatcagtttatatattttgctgcagagacttgctttcaccaaatgttgttgacacttttatctgcttttgcgttttcagagaagcattgataattggactaaaacccagtggagacagattcatgtggaacagatggatgtagaactcagaaggtttgccaaggcgagttccataactgtctattacaacaatttatctttctcagcaccacctccttccatcttccctaatctagtatctggtgtattgggctgcatgtacttatttacttctaacagagtgatagcagacagtgtttttttcacccttagccagttgcacttctaatcaagcctgtctttctgtgagtgagttgatagaagcatattagggttaatgaatttatgagaagctactctaattatgagcttcctacagcttcctagaacagagaggaacattatcagggccaaggggtcaggcttctgaaagcttttgatttctttgcttagcaaccataaacattttgtatctgaaaaggtaccttttggctctggaatttggggcaactaataggagcatgccacctctggatttatgcggaatactatgatctttgttcttattaatgactctggtatcccaagggggctcaacatatacagaactgagcctattgtaatttggtacttattggaatttgatgtctattctgcatagccgtatgccctctgaagacagagcatctttggataaaggcaaaatgcatatcagtgaaaggcagttaaaagtgacaggaccatttgctttttttccaccccagggcttccttgcctcagcttctacccactctcgcctgtattttcccccatattatgccagtcccaaagacccaaactaaaatgtcccttcattctttcggatgtcatggggtcacattgtcctttatttcgtgctaagttctagttgttttcttatgggttttctcattcacaattgctgatgtttttccttgggctgagaggaccagccaagtcaaaggacctatttggcattttaagatgatgaaatatttaggtttcaagaaacaggcactcaaaggtaatcaacattccaaggctgttgtttaaatgagtcatgtattccgaaggaggtcttagtaatctgataacagtctgtttccatttacttatgtttatagaagaaacattcttcattgcacgtgtcctgtgaactctgttacttacctgtgtttcctcatgggacattcagttagatcttgtgaatgagaaagcagtgtatacaagtggcttgtacggagtgggcttgtaatgtacaaatgagtggatcccttttcgtttctctggttttgctccttggtctaggagttcaaatgctttcactcttttctaatccaggagttgggaaatatatgtcaaaggaggcaaattattaatatatactgtgttatatcttgggagctaggttttttcctccacttttctttaggaaatttggtcactcaacaaggaagtccgcgtctgggatgcttacacgggcctggaaggcacagttaaggacatgacagcctccctgagggccatcacagagttacagagccctgccctcagggacaggcattggcaccagctgatgaaagctattggggtcagtatccttggtctcactaatgaacctttttatgactgtgaagtgttacttcttggtttgcatcatctgagatgaagtgtaatttatgaaaagacccccctcagcatagcctctacttgctgtgttatgcctttttgctgtctagaaaaagtcgcctgatccgaccaacaatttagaaaaaggcaccctcctccaggctgtccccaggacagcagagcggaggctggcttccatctccatttgtcatctgggctggtgtccacgttcagtacacagattgcacaactaatcagggtggccctattactcatctctcctcattctttctcaaggacagacctagctccctggctcccagcaactctggagtgaggccaaagttgacacagagatagtctggcaaactcatctagctttctcaggactttccagattttagcactgaaagtatcacatccctgaaatccacttgctagaaacccctcagtccggagcaaatcagggcatttggtcctcttatgcagaggcgtggatggtgctaaggaatgttagagggtagggaggggcagagggtggcagcttccaagaagcagattctggatattcttagcaaaagccggaaagaaaatggctttcctgcaacccatatggctggctcaactcttcacttacaggagacatgagtgagtttgggtatgtcgaagagctgaggatgtctcaaggacccaatataggggagggaaggagagtcaatgtgagagaaggggagtcattgtcacaagacaatgtggaaatgagaattatttttcacatggtaaatatgaataatgacactgtaagactattttttttgccaatgaactgagattaaattagtgataaaactaggttaaatcacagaagcagctgggaattatgttcagtgaatagggttctttaggaagaaaagacaaatgagccactacctgattcctgggatttcaaccaaattataataaatgaacaatgagattctctttaaaaatgggttttgtgggcaaaggagataagaaacgtgccgacaagggaaagatgtgaaacaaagaaaatagtgtagcacggatgtgactaaactgtggcccttgcttccggcaggtgacgcctcaggaattgtgagttaaaaaggagtgtcttagattctccacgtatttcaagacgagagatgtactcagcacctgacttgagtatattttagttaagattcatttcaccagcctttaggcaaaaggaaccgttcatatatgtggaatataaagtctaactttttttcccccaatcaggtcaagtttttaataaatgaagccacaactttggcagatttgttagcactgcggttacacagagtggaagatgatgtccgaaggattgtggacaaggcggtgaaagagctggggactgagaaggtagtgtcctcgggactgggtcatttctacttggctaattttgggtatttgcatagaagccaacttagagaaaagtccttttgatgtcctgggagcctggagagatgagtcccagtttgttccctgctgttcattaggtgtgggatgagcaggaactagaatcattctaagccacagtaaaacaggaggattggtcttgttgatgatgatgattatagcagaaaatacttacatatcctttattttgtagccaacaccactctgagtgctttatttatattaacccatttaatcttctgaggtaagtaatagtatctctattttacacatggggaaactgaggtataaagagataattaacttacccagattcacacagaagactgagattcattcacatttgaggcattacctgtttcatgctggctaatttgtaaatagtatctaccaaacatttaagtcccttcctgctcttgaattgtgttttggttagggatgataaactcacattcagtagaagtttgatgttagtgtgatgctcatacctttgatgtgataaaattcattcttcaaaccccattagcatgaattacttggaggaaaaaactcaagccaataatacttgatatcagtttgcatttttgaaagttgaaaaaaattaattccagataatagtctacatattgattatcaattaaattttgtgcacattaattatattgttgattactaggttattactgaaatcagtcagacctgggcaaccatgaagttttcttacgaagttcactatcgaacaggcattccattactaaagtctgatgaacaactttttgaaactctagagcacaaccaagtaagatggatatttttattgcatatatttttcattttatttttatttgacaaataattgtatatatagggtaccatgtgatgttttgatgtatgtttacaatgtggaaagattaaatcaggctaaccgtcatctcatacacttaacattttttttgtggtgaatcacttaaaatctcctttaggaattttgaaacatacaatgcattattatttattgtagtcaccaactgtgcaatagatcactaaagcttattcctcctgtctaactgaaaatttgtaccctttgatcaacagctcctcttgccccctccccccggctctggtaaccatcattctactctctgtttctatgagttcaacttttttagattccacgtgtagatggcatcgtacaatatttgtctttttgttcctggcttattttgcttagcactgtcctttagggtcatccatgttgttgcaaaccaggattttattcttttttttaaattttactattatactttaagttttagggtacacgcgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatctgtgccacatttgcttaatccagtctatcctcgttggacatttgggttggttccaagtctttgctgttgtgaatagtgccacaataaacatacgtgtgcatgtgtctttatagcagcatgatttataatcctttgggtgtatacccagtaatgggatggctgggtcaaatggtatttctagttctagatccctgaggaatcgccacactgacttccacaagagttgaatacaaactaccatcagagaatactacaaacacctctatgcaaataaactagaaaatctagaagaaatggataaattcctcgacacatacaccctcccaagactaaaccaggaagaagttgactctctgaatagaccaataacaggctccgaaattgtggcaataatcaatagcttaccaaccaaaaagagtccaggaccagatggattcacagccgaattctaccagaggtacaaggaggaactggtaccattccttctgaaactattccaatcaatagaaaaagaggaaatcctccctaactcattttatgaggccagcatcatcctgataccaaagccgggcagagacacaaccaaaaaagagaattttagaccaatatccttgatgaacattgatgcaaaaatcctcagtaaaatactggcaaactgaatccagcagcacatcaaaaagcttatccaccaggatcaagtgggcttcatccctgggatgcaaggctggttcaatacacacaaatcaataaatgtaatccagcatataaacagaaccaaagacaaaaaccacatgattatctcaatagatgcagaaaaggcctttgacaaaattcaacaaccttcatgctaaaactcaataaattaggtattgatgggacgtatctcaaaataataagagctatctatgacaaacccacagccaatatcatactgaatgggcgaaaactggaagcattccctttgaaaactggcacgagacagggatgccctctctcaccactcctattcaacatagtgttggaagttctgaccagggcattttggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaacgtacaaaaatcacaagcattcttatacaccaataacagacaaacagagagccaaatcctgagtgaactcccattcacaattgcttcaaagagaataaaatacctaggaatccaacttacaagggatgtgaaggacctcttcaaggagaactacaaaccactgctcaatgaaataaaagaggatacaaagaaatggaagaacgttccatgctcatgggtaagaagaatcaatattgtgaaaatggccatactgcccaaagtaatttatagattcaatgccatccccatcaagctaccaatgactttcttcacagaattggaaaaaactactttaaagttcatatggcaccaaaaaagaccccgcattgccaagtcaatcctaagccaaaagaacaagcctggagtcatcacactacccgacttcaaactatactacaaggctacagtaaccaaaacagcatggtactggtaccaaaacagatatagatcaatggaacagaacagagccctcagaaataatgccacatatctacaactatctgatctttgacaaacctgagaaaaacaagcaatggggaaaggattccccatttaataaatggtgctgggaaaactggctagccatatgtagaaagctgaaactggatcccttccttacaccttatacaaaaattaattcacgatggattaaagacttaaacgttagatctaaaaccataaaaaccctagaagaaaacctaggcattaccattcaggacataggcatgggcaaggacttcatgtctaaaacaccaaaagcaatggcaacaaaagccaaaattgacaaatgggatctaattaaactgaagagcttctgcacaacaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaaaaagtgggcgaaggacatgaacagacacttctcaaaagaagacatttatgcaaccaaaaaacacatgaaaaagtgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaacccttgtggaagtcagtgtggcaattcctcagggatctagaactagaaataccgtttgacccaggcatcccattactgggtatatacccaaaggattataaatcatgctgctataaagacacatgcacacgtatgtttattgtggcactattcacaatagcaaagacttggaaccaacccaaatgtccaacaatgatagactggattaagcaaatgtggcacatatacaccatggaatactatgcagccataaaaaatgatgagttcatgtcctttgtagggacatggatgaaattggaaatcatcattctcagtaaactatcacaagaagaaaaaaccaagcactgcatgttctcacacataggtgggaatggaacaatgagaacacatggacacaggaaggggaacatcacactctggggactgttgtggggtggggggaggagggagggatagcattaggagatacacctaatgctaaatgacgagttaatgggtgcagcacaccagcatggcacatgtatacatatgtaactaacctgcacattgtgcacatgtaccctaaaacttaaagtataataataataataataaaataaaaataaaaaataaaaaaaaagaatccactttcttaatatcactaactcactaatgagggcagagccctcatggtacctcttaaaggtctcacctcaaacactgttgcattgttgattaagttgcaacacatgagctttgagacacaataacaggtagtacaatagcaggtagtgtgaacattttaacaatattaaatactgggataactttaaatactgaatacctttcagtgtgtttgtattatctacattttttcatcaatgttttgtggtttttagtatacagatatttcacctcctttggttaaatttgctcaagtattttattgtttgatactattgtgaatgggattgatttcttaatttctttttcagatagtttgttgttagtataaaagaatgctgatttttgtgtgttggttttgtaccttacaagtttgctttattcatttattagttctaacagttttaggatggagctgttaggattttctaaatataagattatgtcatcagcaaacagacacactttcacttcttcctttccatttgagtgctttttatttcttgtctagttgctctggctagaacttccagtactgtattgaatagaagcatgagagtgggcatccttatctttttcctgattttagacaaaaagcttttgattttttgctgttgagtatattagctgtgtgcttttcatgttcagcctttattgtgctgaagtacattctttatatgccaattttgttggaagttttaatcatgaaatgatgttgaattttaccaaatgtcttttctgcatatattcagatgttcatatcattttgtcctttctgttaaatatggtatatcacatttattgatttgcatattcttgcattcctgagataaatcccacttgatcatggtgaatgatcttttttagtgtactgttaaaatcagtttgctagactttgctgaggatttttttaatgtatgttcatcagggatattggcttctaattttctttacttgtggtgtccttgtttggctttggtatcagaataatcatggcctcataaagtgagtttggaagtatttctccttaagtttttttggaagagtttgagaagggttagtattagttcttctttaaatgtttggcagaattccaccgtgaagccctcctgtcctaggcctttcttttgaggggaaatattttagtattcaatcagtgtctttactcatctgttgagatcttttatttcttcttgattcagtcttggtaggttgtatgtttctaggaacttaaccatttcaatttgttgacatataactgttcatagtagtctcttatgatcctttgtatttctgtcgtatcagttgtaataactcttctttcatttctgattttgagttatctcccttctttccttagtctggctaaaggtttgttgattttgtttactattcaaaaaaccaattcttcattccattggtcgttttgttgtctttgtagtctctgtttcatcaattactgctctgatcgttatcattttttcctactattgattgtgggcttagtttgttcttctttttctagttcctgaagggttagcattaagttgtttatttgagattttcttgttgttgtaaacacttattgctaaaaacttccctcttagaactggttttgctgcattccgtaagttttagtatgttgtgtttctgttttcatttgtctcaatatattttaaaatttctcttttagtttcttctttgacccattggttgtttgggagcatgttattaattttcatgtatttgtgagtttccaaaattcctcctgttattgatttctacttttatgccactgtgattggaaaaatacttgatgttatttttgatcttcttaagtttttagctaagattatctggcagacttggaaaacatttatgtttttttatattgatgcgtaagagatgtacataatttgggggtacatgtgataatttaatatatgcatataaaatgtaaagatcaaatcagtgtaattgggatggccatcatcttaaatatttgtctttgtgctaaaactactggaatttttctcttctagatcttttgaaatacacaatagattattgtaaactgtagccaccctactgatctatctaacactgggtcttatgagacccgctttttaaaaaaaattcccacatgtgaatgggaatacgtgatatttgtctttctatgcttgccttatttcacttaacataatgtcctctagttccatccacatagctgcaaatgacatgatttaattattagttttatggctgaataatattctattgtatgtatatgccattcttaaatctatctgttagtaggcacttaggtcaattctgtattttggctattgtaaattagtactgcaaaaaacatggaagtgcagatgtgttttcaacatactgattttctttcttttgggtatatacctagtagtggaattgctggattacatttttcgttctttgaaaactctccgtactgttctccatagtgactatactaatttacatttctaccaacagtgtacaagtgttcccctttctccacatccttgccagcagcatccatttttgcctatctttctggtaaaagccatttaactggggtgacatcatatctcattgtattatgatttgcatttctcttaggattagtgatgttgagcattttttcatgtaactgatggccttctgtatgtcttttttttttttttttttttttttgaggcggagtctcatctgtcacccaggctggagtacagtggcgtgatctcggctcactgcaagctctgccttccaggttcatgccattcttctgcctcagcctcccaagtagctgggactacaggcgcccgccaccatgcctggctaattttttgtatttttagtagagatggggtttcactgtgttagccaggatggtctcgatctcctgacctcgtgatctgtgtgcctctgcccctaaagtgtgggattacaggcataatccacagcgcccggcctgtgtgtcttcttttgagaaatgcctattcaaatattttgcccattttaaaatcagattggggttttgttttgtttttgttttgccactgggttgtttgaattttgtatgtattctggttattaatcccttatcagatgagtagtttgcaaatattttctcccattctgtagtttggctattcacttcgttaattgtttctattgctgtgcagaagcattttgtcttggcatgatcctgtttgcccagttttgtttttgttgcctggggttttgaagtcttacacacacacacaaaatctttgcccacactaaagtcctggagcatttctccagtgttttcttctagtagttttatagtttcaggtcttagattcaactcttaatccatttttatttgatttttgtttacattgagggatagaaatctagtttcattcttctgcatatggttatccagttttcccagtaccatttattgaaaagactgtcctttccccattgtatgttcttggcaccttagttgaaaattaattggctgtaaatgtatgggtttatatcttgggtctctattctgttccattggtctctgtgtctgttattatgccagtactatgctgatttggttactgtagctttgtagtaaatttcaaagacaggtagtttgatgcctctagctttgttctttttgctcaggattgctttgactattcagggtcttctgtgattccatataaattttgaaactttttctatttctgtggaaaaaagtcattggtattttgatagagattgcattgaatttagaaattgctttgggtaatattgtcattttaacaatactcttccaatccatgagcgtggaatatctttctgttttttgtgtgtgtcttcagtttttttcattagtgtttcataatgtttctcatatagaaactttcacttttcatctttcacttctttggttaatttgattcctacatagttgatattatttgtagctattgtaaatgtgattgccttcttgatttcttttttcaaatgttttctgttggtacatataaatgcaactgttttttgtatgtctactttgtattctgcaacttgcgtaaacttgtttatcagttctaacagttttttttttgatggagtctttaggtttttctaagtacaagatcatgtaatctgagaacaaggctaatttgacttctaccttccagtttgaatgccttttatttctttctcttgcctaattgctctgaccaggacttctaatactatattgaatacaaagagtgaaaatgggtatcttgtcttgttccagatcttagaggaaaggctatcaaattttccccattcagtacaatgttagctgtggatttattgtatatgtcctttactattttgagatatgttccttctgtgccaattttgatgagggtttttatcataaacggatgttgaattttatcaaatgtctttttgaaatttgttaaaataatcatatggtttttcttcttggttctattgatgtgctacatcacatttgttgactcacataagttaaactgtccttctatctctggaatgactcccacttaaccatggtaaatgagtttttaatgtattgttgaattccatcagctaatattttgtagagaattgtggcatctatgtttatcagtagtattggcctgtaattttctcttttctttgtgtccttttctgcttttggtatcagggtaatgctggcttcattttcttagtctagctaaaggcttatcaattttatcttttcacaaaaccaccttttgtgttgttgatcttctgtattttttcttcagttttaattttatttgtttcagctctcatccttgttattcccttccttttgctaatgttcacttgggattgtttttgcttttctagttccttgaggtgtattgttaggttgttgatttgaaggccttctacttttttgatatatgtgcttattgctctaaactttcctcttattactggcttttactgtatcacatagattttgatatgttttatttccattttaatttgtttcagaaaatttttacatttgcttcttaatttcttcattgattcattggttggttaggagcatgttgtttaatttgcatgtgtttgtgacatttctaaggttcctcttgttagtgatttctagttttatttcattgtaatcagaaaaggtactcgatatgatttctactttttagaattttttgaaacttgttttgtgccctaagatatgatctattctggagaatccatgtgctgacaaaaaggatttgtattctgcagtagttgggtaaaatgttctgtgtcagtcagtcaggcctactaggtctagtgtgtagtttaagtctgatgtttctttgttgatttttgaaatcttggaagatctgtccatttctaagaatggggcgttaaagtcctgtactatcattgtgttgcagcctatctttccctttatccctttaggtctattaatgtttgtgttatatacctgggagtttaggtgttgggtgcacagatatttaatacttataattattattttctcttgcctaattggttcctttatcattatgtagttatcttctttacctctttttacagtcttgattgtaatatattttatctgatctaagtatagctactcttactcttttttggtttctagttgcatggtatatcattttccactctttcactttcagtctgtgtgtgtctttataggtgaagtgggtttcttgtaggcactgtatagttctgttatgtttctttagctattcagccactttatgcatttaattggataattgagtccatttatggtgagtgttgttattaaggacttattactgccattttgttacttatcttctggttgttttgtaatttttcttttttacttttttactgccttcctttattgttaagtgattttctctgttaatatgttttaattcaatgctttttatttttagtgaatccattacaggtttttgcattgtggttaccatgagtcgtagaaaaactataccaagttattttaaagagatgacaacttatattagatcacaaagaaaaaaaaacccaaagaaaaaatgaagaagaaactccattccttccccccaccccacattttgagctttagttgtctcaatttgtatatttttatattgtctatctcttaaccgtttgctgtagctattgtttttgatagatttgtcttttgggcttcatgccaggagtatgagtagattgcacaccatagttacagtactagaatattctgtgtttgttcacatatttaattttaccagtgggttttatggctttaaatacattgtttaatgtcagtgtttttctatttcagattgaagaatttcctttagcattttttgtaaaactattctggtggtggcgaattagctcagcttttgtttgtcagggaaaatacttcaatctgtctctcatatttgaagtataagtttgctggacacagtattcttggttagtaggggtttgttttgttgttacatttagcactttgaaaatgtcattccactttctactggcctgtattctttctgttgagatgtctcttgtcaaattggagctcctttatatcttatttgcttcttttcttttgttgctttacgattctctgtgtccttgacctttgagaatttgattattttatgacttggagtagtattatttgggtcagttctatttggtgttctctgacctttttgtacctggatatttatatctctctcaggctttcaaaagtttttaatattatttatcttgtagacaatcttcactgcttttcattcttttttctcttaaatttgttaagacttgttttgtggctgtattagtccgttttcatgctcctgataacgacatacccagggctgggcaatttacaaaagaaagaggtttattggacttacagttccatgtggctagggaggcctcacaattgtagtggaaggtgaaaggcttgtctcacatggcagcagacaagagaagaaagcttgtgcaggcaatctcccctttctaaaaccatcagatctcttgaggcttattcacagtcacgagaacagcatgggaaggacctgcctccgtgattcagttacctcccactgggtccttctcacaaaacatgggaattcaaggtgagatttggatagggagacagccaaaccatatcattccacccctggtccctcccaaatcatgtcctcacatttcaaaaccaatcatgccttcccaacagtccccgaaagtcttaactcatttcagcattaactcaagagtccacagttgttcaaagtctcatctgagacaaggcaagtcccttccacatatgagcctgtaaaatcaaaagcaagttagttacttcctagataaaatgggggtacagctattggataaatacagccattccaaatgggagaaagcagccaaaacaaaggggttacaggccccatgcaagtctgaaatccagcggggcagtcaaatcttaaagctccagaatgatcttctttgactccatgtttcacatccaggtcacgctgatgcaagaggtgggttcccacagtcttgggcagctccgcctctgtggctttttggggtacagtctccctcccggctgctttcacaggctggtgttgagtatctgcagcttttccaggtgcacagtacaagctgtcggtggatctacctttctggggtctggaggacagtggccctcttctcatggcttcactagtcagtgccccagttgggactttgtgtgggggctctgatcccacatttcccttctgcactgccatagcagaggttctccatgaggacgctgccgctgcagcaaacttctgcctgggcatccaggcatttccatgcatcttgtgaaatctaggtagaggtttccacacctcagttcttgacttttgtgcactggcagactcaacaccacatggaagctgccaatgcttgaggtttgcatcctctgaagccacgtcccgagctctatgttggcccctttcagccatggctggagtggctgggatgcagggcaccaagtctctaggtagcacacagcacaggaaccctgggcctggcccaggaaacccctttttcctctgaggcctccaggactgagatgggagggcctgccacaaaggtctctgatgccttggatacattttccccattgccttggagattaacattcagctcctggttacttttgcaaatttctgcagtcaggttgaatttctcctcagaatatgggattttctttcctatcacattgtcgggctacaaattttctgaacttctgtggtctgcttcccttataaaactgaattcctgtaacagcacccaagtcacctctcgaatgctttgttgcttagaaatttcttctgctaggtaccctaaattatctctgtcaagttaaaagtgccaaaaatctctagggcaggggaaaaactccaccagtctctttgctaaaacataacaagagtcacctttgttccagttcccaacaagtttttcatctccatctgagaccacctcagcctggatttcattgtctgtgtcattatcagcatttgggtcaaagccattcaagtctctagggagttccaaactttcccacattttcctgtcttcttctgagccctccaaactgttccaacctctgcctgttacccagttccaaagttgcttccacattttcgggtgtcttttcaatagcaccccaccctattggtaccaatttactgaattagttcattttcatgctgctgataaagacatacccaagattgggcaatttgtaaaagaaagaggtttattggacatacagttccatgtggctggggaggcctcacaatcatggtggaaggtgaaaagcacgtctcccaaagtggcagacaagacagcttgtgctggcgatctcccctttttaaaaccatcagatcttgcgagacttattcacaatcatgagaactgtatgggaaagacctgcccccatgattcaattacctcccagtgggtcccttccacaacatgtgaaaattcaagatgagatttgggtggggacacagccaaaccatatcactggcctaacatatgatctgtcttggagaatgtttcatttgcacttgagaaaaatctgtattctgctattggatgaaatagtctgtcgatgtccattaggtctatttggtctaaggtgttcaagtccactgtttctctcttgattttctgtccagatgatctatccattgttgaaagtggaatattgttatccccttctattactgtattgcagtctatctcatacttcagacctgttaatatttgatttatatatttaggttctctgatgttgggttcatatacattttaaatcacattttttaaattttaaattgtgattttttactttttcctagttctaatactcaacatatgtttatttattcattgagcacctaattgttacaggctccaggtatgataccatttgtgatccaaagttatgaacacttgttctctaggaagatgcacttgagtagggagacaagcaaaaggactccaaggagtctaagaagagacagagaggctttgtgattaaggtgggcggaagacccagggagggccttagaagatgatggtgctcatgctgagacttgaagggtagtctattattcttcaaaaaatggcagtcagaaaagggtatttaggcaatgaggacaatattagtagcaccttggaatgacaggatgtctctaccattcaaaggtaatgttaagactctagtttccttggactatagattttctttatgggggtagtgaaagataggcctggacagatagtctgagcacatgatacatggtcttgaattctaaaattatagtgttaacatctcttcagacatgaaaagaaatgtagaagagacaaactattcagaggaaataacagtagtgttattattagacataagacatttaggaaaagaaactggtttggagagatgacacttattattggtttattcagtgtgaaggacatttatgcaaaggtgaaacaccagaccacagctcaacacagaggttcagccaagagctggtagctgggagttcactgtcagtatcttgagacttgatgaactagataaagagactaaaggagataagccagctgagaatagagcattggaaaagactgaattcggtgaacaagaggaggagacaaaaaggaggcagcaagagagtggtcagagaaatgcttgaaacaggatactgtaatgtcatagagaagtcaaggcatgaggtttttccctcaaagaagagtcaagtatgttaaatacctagagtagagaaaaatgagcagtagaggtcattgtactcagtgactttctgagatttcagtgtcatagaatagtgagaaatactagctaggctccatggcattaaaacaagcactgctgagctaaacattgagtccccttggacacaaagaagggaatgatacacactggggcctagttgagagtggagggcaggaggagggtgaggatcaaaaacctacctgtcaggtactatgcccattacctgggtgatgaaatcatgtgcacaccaaactcccataacatgcaatttacctatgtaacaagcctgcatatgtacccccccgaacccaaaataaatgttggaagggaaaaaaagacatatgaggacagatttaaaacatttaagttgggcagatatgtaatgctgtgtgatagaagcgtttcagacatactaaccatattttaattaaaatagagtttgttagcttttcttttaatttaaacatgagaaacaaaaaccacattaattatagcattcttttcaaaataaaactgcaaccaatacttgaaaaaacaaaacaaaaacaagcactggtgataggagagctgtggagcttagcagtaaactgaaaagggaggaaagtggaagctggagggcctagcaggctggtggggggcagtttgtttgtttgtttgtttgtttgtttgtttgagacagagtctcactctgttgcccaggcttggagtgcagtggcgtgatctcagctcactgcaagctccgcctcccgggttcacaccgttctcctgcctcagcctcccaggtagctgggactacaggcgcccgtcaccacgcccagctaatttcttgtatttttagtagagacggggttttaccgtgttagccaggttggtctcaatctcctgacctcgtgatccgcccacctcggcctcccaaagtgctgggattacaggcgtgagccaccgtgcccggcctatttttttaagattaataaacacatacctatacaatcttggcatgactaataggcagggatgaggggaagagcaatgaaagaatacagtttaattcccagtgctgaacccccaatacacagtattttttttctgcctgcaatagatgcagggccttcttgagaaagacatatgaggagataacagttgcatatatttatctttttttctttttggaaaaatgttaatataaatatttactaccattaattcactcattcactcatttagcaaaaacttattaaatgccagttccagatattacatgctaggtctaagaatccagcaataaacagagtagatatagtgcctccctcatagcactcacattctactaaatttagctactatttaaaattctttgcctttattttaggttcagttgcagactcttcttcaaagcaagtatgtagaatatttcattgagcaagtgttaagctggcaaaataaattaaacatagcagacttggtcatcttcacttggatggaagtccagcgaacttggtctcacctggaaagcatttttgtctgttcagaagatattcgaatccagcttgtgaaagatgctagaagatttgatggggtggatgctgaatttaaggtttgtcaaagacaggctgtatgctattctagcaaagttttgtaaagtaacatggttttgagcatcgtatttataaaaatgaatgcatttttgcatgagtaagcaggagtcaggagacttttcctgcaaagggccaggtaataaatatttcaggctgtgtggatcatgcagcctgtctaacaccttctgaatgctgccattacaacatgaaagaagacatgggtaataaataaacaaatggatatggttatatgccaataaagctttacttgtagacactgaaatttgaatttcacatagttatcatgtgtcacaaaatacactgttttttatttttttcactgatttaaaaaggtaggctaggctcggtggctcacacctataatcccagccttttgggagtccaaggtaggaggatgacttgaggccaggagttcgagacaagcctaggcagtatggtgagatcccttctctactaaaaaatttttaataattggctaggcaaggtggcccaagcttgcagtcctagctacttgggaggctgaggtgggaggatcacttgagccaaggtagtttgaggttgcagtgagctatgactgcagcactgcactccagcctgggtgacagaatgagaccctgtctccaaaataaatttaaaaaccatttttagctgctaggtcgtgcaaaaacaaacatcaggccatatttgtcccatgcaccatagattgccgacctttgtggtaataaaggtaaacagattcatcttcagaagtaaaagactgagaaaggacaacaggtagaaaataacactactagtttcggtttttcttttctgtaaaagccatagaaagcacgtggcatggtgcatgtaatgataattgattggagagatttctagcaaaggagagtgactatttctcataaaaattgagattaaaaggttttttctttctacctgaagtagaagtcacagataaattttaagtcatttaacttttgaggaagaaaaaatagattgtttatatctctctcatttttatatgtaggtatgctttttaagattctgggcgctctctcattctctgtctctctctttctctctctcccttcctctctttctccctttctctctccttctcctccccctctgcccccacctcctcctacttgtctccctttctcttctttttcctcttcccattctcccttccttgtctccttttgcctttattctttttcgtttgatttagaagagaaaaattctgtgtgggcctaaagtggtgacagtgcttatcacatttatttttataaaaacggtgtgcttctacattgcttttgatcttcatctaagagttgaaaagcaaaagtaaacagatgtggtgtcagacattcttagaagtatctttgaccttgcctcttcattctttgttcttcatttttttaattcttgaaatgattaaaagtttagaaaagattgttctaatatccacggccccgtattgtactttcatgcaggagttaatgttcaagacagccaaagtagaaaatgtgttagaagcaacgtgcagacctaatctctatgaaaaacttaaagatttacagtccaggtaagaataaagctatataagataatcaatttactgtaattttatgaagtctttttcacatacctaatagtatttaatactgtgttatggaggtgcaacctctactaaattattttgtaattttgcttataattatctagttgtctcgtacatatgacatggaacatatatatagtaagttaatgtaaataaacccaaaaatatttgttttctgagaggagtattatactagtaaaattagagtatcttattatcaagagaattgacatgattgattgatcaattatttcctcagactatcctgtaaatattgattgagcacctgggattgcactccgttaatgtagtcctttagtttctatgtagtttcattttattagaaattatcctgagggagcacagcagcatttttaaaatcattgtcccaagggccatttgtaaagtaattttcacatttaattctataagagttagtggtcgtaagaatattctggcttttgattaaaaatgagcagatctgctactaaaatgatgggttgtggaagtgcgatcctttttttattgcaaggtaaggagaagatctagataaaattttatattacataaacagagcagttttatagtctgaaagtttttttggtaacgaaaagggcgaagttaattatttcagttgagtaatgctctttggggctttggggctcgggctctgcctctgggtcatttctgctctgctaagggcaataaagtggaaccaattctggatcttatgactcctctgaatacctgacaggagggaagtcacttgtgttttgtagacatccagtgggggaaaagaaggctgtaaacgaattacatcttaccagtgcattttgctctcaggttgaaggatggcgacctagtcttctccactgctgtttaggagtgtcattcggaaaagcaatgaataatgtaaacctaagtctaattcatatttagccacagctaatggggtgtgtgtgtgtgtgtgtgtgtgtgtgtgtgtgtgtgtgtgtatttggcatagtactcttctacttggcataatgtatattagtcataagcaagatagatgatggtgtaaaaaagaaggaagtaagctacctgttaaacagtgagtttactataatgaatggacatagaggacttgagttttgttttgccgaagttttaatgactgaagggacaagatatgcttaaaaacatttttcattcatgtaggctttctctttgtgaaaaagctctcgctgaatacctggaaaccaagcgcatagcctttcctcgcttctatttcgtctcttctgctgatttacttgacattctctcaaaaggagctcagcctaaacaggtaatattttttttgaaagtctcgtattatactgtgttagctgaggaatgtcatagcgtctctatcattgtcaaatgctacctgtcatgtcacgtgggccaggaactagaaaatctgcagttaaaatttgtaatgtagcatcagagggatgtcagaggctgtgcaaaagggagtaggaagaataactgtctggtgctgtgtaaagaggaactatattcagtgtgtaaggcttacagtgctgaaagaagtcgatggaaagaaacactgtcgccaaatcccccagaattctgggacaagaactgggacatccattgcctggttagcagctttcctaggggagaaagggtcacttggaacaagatcatagctggtaccttcttactcctccctccagagtcaccttcataattatgacattgggcttatcttcagtgctgtccaagttagatttgtatcatttcaggatcatcccgaattaaccctctaattttcccctatctctgcaaaaataatgcatcacctttttgctgattcccatgtcaatatttaaagcaaataaaaacagatactatcttgtgtaatctgagagctcagatcagggacaaactgtacaaattccaaagcactccttcctataaactttaagagaatgttgcctttcatttagaccaactcaatcattcctattcacttagatcttacagttgtggctgacatagctggtcactcctagagttgagtgtatattacagattattttaaaactgaagcttgtgctatataattgtggagttttctccatgttttttttttctcagaaaaattttactctagatattttttgtgccattttctttagaatctgtgtctgttcacattgcagttccctgaattttgctgttctttgggcacagtatttatcttaattatttctctcttgttcatcacttaactttgaacctaaattcaattggttggctattcttgttgttgataatacaagtgcagtcgtgctgttagtaacagaattgttggacaatttgggcaacaggttcagggtcaccactcaggtagtattgttttgtatattcatgctaatttccagatggctttgcaaataaaatctgtgattaaattgactatgaatctactatatccgtcttttacatacttattagcacacaattggatgcctttaaaaaaactattttgaaacataatagttgtcactacactatgcttcaataagcccctgagggcatcctcatgaccagcagctgaaccctctgcccagggtgactgtatgagggtagcaggtattgtatttcacaaaagtacgtgtttctgaatacttttcaaatctgaaatgcttataatgcaaaatgaattttcaataagtaagttagcagagaggtacataaatctgtgagtaggtaagcattctttttcttttaatcatattatttaaatacagtgaacacttatgtgactggtttattgaataatattaattccatgggataacagtcatgaaacagttttatctttctgcaatgactaatctcacatgtgccctgccgagtctctttgcccaggtagcagaccccttaataatatctcgggcaggtatcgtaatctcctggtccccctttcttattaaaaacttaaaaaagaaaccaaaagcaactcagcatattctagttggaaatttccatctcatctccatgtcaaggccaagctttcgtttaataacttggtgttgggagggagacttcagctttttcatcccccgtctctgtccatttatcatgaggaggggtttaggggtgtgatctgtctgtcattgtcctttcttaatgaccgctcctgcttccctcaccagtggtgactgtccatcttcacccttaacagcaaggatccacgtgctggatttctggtggaacaagtgtgcaggtcctctggacaaagggaacctccccagggatgtatatgccagagccacccccactttaatcctcccatttcttgctcctggcagtgtaaccagccacctggttccatcttcctcctccttttctacctaggcagatgtccaaacaaggggcacatcaaagattcacttcttactggtgcccagagtttttatgagtgattctcctattcctcttccttgaccttagagtggaggttgggggacccagtcttctaccttacccaaaaaaggcgggggagatgccatggcctccccgtcgtggctgataattcacactgtgcagatggcctcctttgccctcttcctccctatggtactttctgtagaaggcatgcatggaggtagaggagggtggggtattgagatgtgtcttaccaaaccctggaaggactaactgtcctaacccatgtccattaccttcagaatgtgcacatactcaccacctctttgtccttaattgaagtcctagtctgtgctagaggaaaagatcactcaatgaattcttgtcaccaactctgttcaccctccttttaaatcatcaaaaaatccttcatgccttagctaaactacatgttgactcacagtctgtgcatctctgatgccagttgatttttcagatttcagtgatgtgctttttacatcctttaaaaaaattttttacaacatgacttcggtattttacagagtgctatcttctccattatcagtgtgacttactgtgaatgtctcctcacctaccccattcatagcattttaactacgcgttctaaatccctgaattccaggtacattgctcagtactagtccccctccttaatgaatgactagattatataagacgtttgaaacatttgaaattatgatgaagctgaatgttaaaatcatagcgtagagctctccaaactccctcacagctgtgctgataaatgccaccacgctaacaaagggaggtgggtatttcttcttgccagctaaaggatccagtcctgtggccacagtataaacatgcttacagttttgacacacagatttgaagtggttacatatatttttgatatattttgaaattttgggaaaatttgtattccaagttgtgctcaaaatgtgatttcattgaggtcttttcatgtacactacataaattttgaacaattaacacttacataaaatgctatcacactgttactaaaggtctatcattagaagtgtttagcagcctttgtggtacaaataaccatccaagagtgacttgttgagaaggagctaggggccatttgagtcatctagagccatagtcggcttctttccctgaaagaaatggttctgcaaattcaacatgcattctgaattcttgctcactaactatggaataattaatgctacaggctgttatgccagatagtgtgatcttgccacactctcttaccctcttttcaacattagagtcagtttcaaaccaccagacttagtctttccgtccatgccttttgtgctaacattcctgaatgtgctccctgtagtgtgaccgagataacatggcaactgcagcttgtggagcaacaatgcaatttccccataaaaggcgccctgtgtgggtagataactcatcttgacatcttgtgaatgacttgaattttccaggcgtccctcctttactcacccaaactccatttaagagtgttggtccaagtgagagtttctgcagttaattgtggaatgtgatcagcttgaatagaccagccagggaggtctgataaccactacaaccgccattctgcaagcagaaacccccagtttaagatacaagagttggaatgacagagtgataaaattggtgtgtctagaatgctgtcagtaattatcagcttaggagtaagtttggttaaggtcaagttttaaaaatttccttccctcaaaatttagcctgacctcccaaggttatcgattaactaaaggatgatggatacaggtgctgcttaacttcaatgataaaagtctctggtagttgctgtagaaataaaacttaaaggtgtatttgcaggattcattgacatggtgcaatagctatggacaactggcctgaagtccttatgggattcagtattaacattctttggtatttttttcccctttcagaaaaacatttgtattttttaactgaactagtatagttgttaaagtcagacaaaataatatcagtttacccttttgcaccctttcaggttgttatatactaccttaaaataactgacaactttgggcaatcaaggtgtttttaaccactgattccttatgatgtgaaaggtctttttgtctgagaacagtttgcacattttctttctcttgtctatgaaacatttaacttctccataaaggttaggtttggagaagctaatccacaatagagctatactaaagaaagactcactgtcaacgtgattggctctacttgtgcttctcatggggtagctgtgattcttatatggctactgagcacttgaaatgtggcagctaaggaactgactttttattgtaatgaattgcaattgatttaaatccaaaaattgatatttgattcagtaattggaaaacattgcgtgtttgaaacaacttgggtgagtgaatctacctttgcccctgcatattgtatgaaacgcaaatacagatgtagcattttcagatgaaaaatccaaattgagctatgctgtaaatataaaatacatacctggtttcaaagacttgctgcaaataaaataatgcaaaagatctcactttttatattactcacatgttgaatgataatattttgggatatactggattaaatatacattaaaattaatttcacctttttaaaatatgacttaatgtggctgctagatggttgtagctgtggaaattgaagccacaatgcattctgtaaaatgacaagatacatatactcaggaatgcttaatgtttgcatgaagaaatgcccttcaaggacatctgcaccaatctacacacaaggaaatctgccaacttgtctttggagaaatcccctaaattacagcgatgagacagatggcactcaactgatacctctaatagactgtaaatattggcattcaaaaaggtgcttgtgagaaatgagctttatattaggtgataaaaagcaccactggatcttaaaggagcaaatatctagaccccacattcccacaagcacagtgtgtttttatgcagagcttccatttggttatcttcctgatagagtaaaagtgtctcagcatatgaattttaagaggatggagctcaataatcattcatagtatgccaaaaccttcactgacaggaggatattcttctttagaaaattaataggaaaaagactcaatacgtgcatggtaagttgagggcgtgtaagaatgaatgagttttagttaaaatgaaatccataaaaaaattctaactttcctaaaggaagtagaaagctggaaagataagacgtatctaatgtggaggaagtggttgctcctgagtttaagctggggctgaagaaggaatgagaaagaaggagcaaaaggacacagaaaaggggtcatggttttgaccatcttgccattggctctatttacctgcagctgaggaggaaggaatagaagctgctcatgaaagtgtagtctgtcacagaaagtacagtgtaagagcaactctgcttggcatgacttatgaatatgtaatattttaaatggataccttaatataaaggcagcctgattcacctagaggttcaggtatttaggtgtatgacaagaaaatagagaatctactttcagaataaatgccataaattatatatcccatggagattatccttgattatcttctcaaaatgatgaatatgtggttaaccacaaactgtacaacaatatgcacaattttttcttcattttgcatatgtgttgccactgcattgtattctattgtagcccctttggaattctctccatagccaatgtataagttgtacaacaacattaaggttattataatgtgagattaaagtaaaatatcacttcaatgttatgagttccaaaaattaaatgttacaaatgtggggtcctgccagcgaggagtttctaggcccttctgtggaatctgaaattgttgtggtttcagccttgctttgatgtcacttgatgaaggttgttcagttccagcttgaactcagtgggtagagcttccagctataacagattagcttttcacagagtactgttctttctggaaacaactagaaaagctggataaaatatttaactgaatctgtttaaatgcactgaagagcatttaaagagtattgaagaataagtgtgccaggggctacgatagcagcagtttggtgctgcttttctcctcgagacatttgataattcatagatgtggccaacggcatgagaagctgatcagagctttcaagaggctcgtggaacttgaaagaaggagagaaataaaataaaactggaactcaggccccattaaggaggatatatacagagaatcaaacaataataacaaatggttctaaggtggattggatagaaatttgccagggtagggggaggaggaatctactatatctaaaaatcagatatctaaatcagatatctaaaaatcagatatctaaatcagatatctaaaaatcagatatctaaatcagatatctaaaaattagatatctaccatatctaagaatcaattccagatggatgtagatctaaatgtgaaaggtgaaacaaacgatatacaacatgtgaggaaggatatcttcataatcttgcactaagcaaaatcttcttaaattggacactgaagtcctaactataaacaaaaaaatggataaatttgactatgttaaaattttaaaactttagcttatcaaaagatgctcttaagagaataacaatgcaagctgcaaagtgggaaaaggtgttggcaatgcaaacaaaagactcatatatggaatatataaagaactccaacaaaaaaacaaaggcagattatctaatataaaagtgggcagaatacttagttcacaaaaaaaagatggaatggctagtaaacataagaaaggttgctcaatttcagaagtcatcagggaaatgtaaaccaaaaccacaacaagatgagataacaggatggccaagatgaaataacaggaactggatttaccttcttgcctgaaacaatgaaaaatttcaacaaaatatatgaaaaacagcagctttctagacgctggacatcaggcagtggggattcatgacagatgaggaacagggattcatcacaggtgaggaacaaatggagtgagcactatgattgtctcagttttctgtcctgagagagtttccaggccatagcacatgaagggaaacccagacagagtccaaagtgactatactttgcagaactgagtaccacagaggaaagagttgtacaaagagaactccagagacttctggagagtattaggcagagtgctgaatagtgcactacatgtgaggaaactacccaggcctggggaaagaactatcaggtgcccagtgagctccagcagggcaagaaataatggctgcttctaccaactagacttgaagcccttataatttataggtagaatactgacagggtctttcctggtagcggggaataaatagccctagattagacactgctctagtcccaccaaacaagtcttaaatagcaatatccaaaaggatcaaaccttttccaagtaatttatgccaggaaaaaaatctcaaaagtatgggagtgaaaatatattcatttttaagcagcgtaaagttcacaatgtctggcattgcattaaagtttactgagcatgtgaagaaataggaatattcaacccatgaaaaaagagacaaatcaaaactgacccagaactgacacagatgatagacttagccaataagatattaaaagtaattatatgtgtatttcatgtgttcaaaaagttaagtgagacctggaaaatatcagagagcttaatatgtgtgctaggacttcccaaagtgcggaacaagaagaaagatagaaaatatttgaaaaacaacagccaaaagttctccaaattgatgaaaagtacaaaagtgtaaattcacagacttaagaaatttaatgagcccaaacacaaaaaaagaaagaaaactacaccaaattgctcagattggtcaaaacaatatagaagtctcaaaatcatccataaagccatattttatacaaatgaacaaacataaggatgacaacagacttcacattggaaacaaagcaagtaagcagacagtggagtagcaatttctttctttcttttttttttttttttttttgagacagagtcttactctattgcccaggctggagtgtagtggcctgatctcggctcactgcaggctccgcctcccaggttcacgccattctcctgcctcagcctcctgagtagctaggactacaggcgcctaccaccacaactggctaattttttttgtatttttagtagagacggggtttcaccttgttagccaggatggtcttgatctcctgaccttgtgatctgcctgcctcagcctcccaaagagctgggattacaggcattagccactgcacctggcctacagtggagtagcagtttcaatgtactgaaagaaaaaaaacacctgtaactctaaaattttatacccagtaaaaatacctttttaaaaaaggatagcaaaataaagatgttttaacacattcaaaaactcttaagatttcatcaccaccagactggcactacaagaaatgttagagaaagttcttcaagcaaaaggaagatgacactagatggaaatttggatctataccaaaaaattatgaacactgaaatgtcaactgtatggaactagaaaaaattggagcattagccaatcattagaagatggaatggtaccaaaaacatagaaacattgaaataatatatatgtaagtttaaatactggtgctgttgattataataactggctatgttattgcttaacctttctgaacctcaatatccttatataccaaatgcagaaagcagtaggtattgtctgtttggcttctaagtaacaggcaaaacaaagtgcataaagaaccaataaaagtacgtaacgtacaataatgtaaaattggccacaaattctttcccttcctgtatccatgccctttgaatgtgatgtggccgtattgatcaaggctagaaactagttctccatttgggttgccatatgacttgttttggccactgtgtcattagcaaaagcttgaaaattttttgtatatcatcacttgcccttttgctgctctttgaaaacctgtaaccatcccatcatgaatgggtcaaccctagcctgctggataatgagatgaacatgcccatacccaagctaccagctgagcaaccatcacacacatgagagaagccaccgatcaccagcaggctacaaatatgtgggacagcccagctggactagctgaggcaacccaaaaccaacacacagaattgtggctgatgaagaagccattaaatcttggcgtgttttgttatactgcaaagttaattaatatatgttatgtatttacatatttatatatgtgtatgtggatatatattcatcagtatcaaggactctttgtgctactgatttaaaataaaatattttacttgaaatttaaaaacaaagcaaagaattgattaaaacaagtactaatccaagtttttgttttctttatttctttaatttttttcccttcctgaataccttgatattattgttttgacatcagtgagtttgggaagattggtgaaaacatcataagttaatgtgtttctctttacttaaaatactctgcctagtaaagtattcattttcccttctctttttaatttgtgtagatatttcctaaattgttgatatgatttgggattcaaaaaacacatatacttgctcatacaatgagatatcaagatcaaacccaccaaaggctaaaattaaaactcactaaacaatggaaaggatgtggagtaatgggaatgttcatatctagccaccagtattataagttagtacaactacttgggaaaactgtttaacagcattttctaaataggaatatatcatacatttttatctagcagttcaccttttcagtgtacactcagcagaaatacatagatggaccaaaagaagtatacaagaattttcatagccactttatttataatagtccaaaatgggaaacaatttaaatgtcccttaacagtgggatggctaaatatatttatatattgtattgtctttatacaatggaataccacatagcaataaaaatgaagaaaacctagtggtataccaaataacatgaataaattcaagtgacataatatcgaactataggaggcagatgcaaaagagtacgtactatgtgaattcacttctataaagataatgtccctttttagagaaatagtaactggcatgcaccatgaggagtcttacgggtgctggtatcctactcttttttttttttttttctgtagatggagtctcactctgtcacccatgctggagtgctggagtgcaatagtgcaatctggactcactgcaacctccacctcctgggttcaagcaattcttaagcctcagccacctgagtagctgggattataggtgtgcaccaccgtggccagctaatttttgtatttttagtagagatggggttttgccttgttggccaggctggtctcaaacttctggcctcaggtgatctgcctgcattgcctcccaaagtgctgggattacacacgtgagcccccatgcccagcgactattctattccttaatcttgtggtaagcacaagagttgtgcttactttgttaaaatttattaagttgtacacacatgattttttcccatttttctgcatatatgtattgcaatttccaaaagtttattttaaaaaaaacccagcatttgtgttgtgaacacatttacataaaattatacaatttatgcatgtaaacattttatgaaagaaacaccaaatcaaccttatatgcactgatatacggatatgtttaagttacagtaataagtgagaaatcaaattacaaaatattatactgtgattttatttttggcaaaagcaaatctggattatgtaagtaattgcatgttcattattgaacgtttgacaaatatagaaatacattaaaaagttgagattaatatactcattgctatttttgagttactatagttttttaaatgtgtctgtgtttgtgagttataacatatatacttaaacaaaattgtaatattcctctacaatttgatgtttcatagctgtaagaggtttcattttatgaatgtgccatactgatttaactagcttctagaaggccttttttttttttttttccaatttagattcttaaccatattgcatgcctatttccctgtaccatcaccaaaactgttatttaattttattattttattattatttttttctttggagatggagtttcgttcttgtctcccaggctggagtgcagtggtgcaatctcagctcactgcaacctctgcctcccgggttcaagcgattctcctgcctcagcctccagagtagcggggattacaggcacatgctaccacacccagcacatttttgtatttttagtagagttggcgtttcaccatattggccaggctggtctcgaactcctgacctcaggtgatccacttgcctctgcctcccaaagtgctgggattataggcgtaagccaccgtgccgggcccaaaactgttattttaaaaaaaaaaaaaaacacatgcaactatttactattttgacacattgacttaagtttttacacatgtaaaaatcatggactcactttatctcattctagagaatatcatccacaaaagaccagggctgcccatattttggtcatgatttatattcttacaaatattattatgaatattgtcattatgaataaattagttaatgaaaacatatgaatgagtcctgaggtgctcaccaggcaggagtggcactaggctttgtgtatattttatcccattaataagcggcagcagcatctttaggtaggtagggcaaatacgaacttagatataggcagaaagcaagcggtatggtttgagaatataattgtaagctgccgtaatttcatctttcttccttttttattttttatttatttattttttttgagacagagtctcgctctgtcacccaggctggagtgcagtggcgcgatctcagctcactgcaacctccgcccctccaggtttaagcaattctctgcctcagcctccggagtagctggaattataggcgcgtgccacttttccctttgttttctaagtgaacagtagctgtgagtcatgacggtagatcaactgatcactgtatgcattttaaattataaaattagctagtgattaggtattttcagtttacttacaattagataaatgtaagttcttttatttcataagaggttctccctgtgcagagttctgatatttatgaatttcagtcactaaggtttggttaaataacgccagtgccctggcaacatggttcaaatttcagctactatggtaaattaactcttgagtgattgcataaagcacatagttgattactaactctccagcccacaaaaatcactgcctaagtaacagatgtgcatcatcatcagtgacagtcatgtcacatctttctaattctgtcagtgattagccactgtgctgcttttactcacttcacacacagacagctaagcttgtagttctatgatgaacctacatgacatttttcattagttaatggacagaaggaaatagtaacaaagttggaagtgtagcaaagaaatgaaaattgataatgctagaagcaaaaatggaatcaaacatagatgggagtcacagaagagagagctgacggacagtgatgaccagacaccaccagagagagtgatatgcagccaggggaacttagtgaagataaacttgggaacataaacgacaacagtggttttgacaaaaagaatgaagatgtaccagaggaagtgatgccaggaaaaacaaacatattaaataaaacaaacctcccaaacaacaaaaactgacttcacattgaagagaattacaataaatttcatgacattgaatgcttgaaaggtaaaatgttgatggccggatataaattcaaagggagtatgagtttgtcaaggcagagaaaagatgctcgttctgtaccttaagtagtaagatgagaaggaggcaatgctattcatataacttaagttttctgcaacgaagactgtttagtgttttaaaatgcagttgacaaaatattagtttatggatttttttgatctccctgtatgtttataaccaacagtgagaagctttaatgttttgacacaaatttgtaaaggtcattgtcccatcgtaggtttctcccattgatcattcagattgcataacgtgatttcaactggtgtggtcatttttatgattttgtactattctgcaaagtcaggactacctgtattcaatttttgtactaatcttttagaaacctactcaaaatacatggtgagttattggttctttttaaaaaatgatttgaggtgctcatatcctttctctatcaaaagaggggcctacgaagtattagttttttttaatatttatttatttatttatgtatttgagatggagttttgctgttgttgcccaggctggagtgcagtggtgccttctcggctcactgcaacctctgcctcccaggttcaagtgattctccagcctcagcctcccaagtagctggtattacaggcatgtgccaccatgcccagctaattttgtatttgtagtaggaacagagtttcaccatgttggtcaggctggtttggaactcctgacctcaggtgatccacccgccttggcctcccaaagtgctgggattacaggtatgagccactgcacccagcctaatctattctttttagttgtaaaatgaaaggcctttccgaacagctcactgggaagaaggaattttaattttgggttaacaaatacgaagcaatctcattaaaaatagaacaaatctgagggcaacaggggccacacgagttaaaaaaatagtcttgttccctcagaaagtttaaatagaagacagtatgaaaacatctaacgtcaactatgccatgtataagaaataggagaactctgcctaagatttgtgtttcctggtcattgagttactatagagctagaagttcttgaaattattttctcacccaagccgtaatgtgtgagggtgtctgatggctgaaggctcatttatccaaaggcttttcagttgaatattatctaggcccattacacagtagaagccattcaacatctgtgtacttcctggccacttcagctgggagagtgaattatgagattagtggagactttctctatattaatatcctctgggtaatgtacagggatggaggagaatagaacccaagctgtgatcaggcagctaccgctctatctgtgtttaaagtaagcgagagtctcaaaaactcatctatttgaaactcggaggacttcttgctgtgattttctttgatactaaaactgcatgtacagcaaaaatgaaaaggctgaaagctttaaagattaaatcaccctaaggaagttccttgccaatattggtgttggtcttgtcatgcagaaaatttaggcaggttgctattgtttctagaagttgctgtggtatacttctcatgtccagttaaactgcacttccagaaaagtttgttacagcagtggcgcctgtatgcttggaaatgttttgtattgcttcaccctatcttctggttatcagcagctcatatttatttttttctgttgaggtgaaatttaacattaaattaactgttttaagtgtgcaattcaatagcattttgtacattcacaaccaccttttatctaattccaaaccattttcatcaagccgaaagtaaaaccccctatccattaagcagtaccttctcatacccctccctccagcccctagcagccgccaatctgctgtctgtatctatggatttatctcttgtggatatttcatataaatgggataatacaagatacgacgtgtggtatattgtgactagtttctttcatttagcttatattttcaagattcatccaagttgtagcatgtatcagtaatattccttttaatgactgaacaatattccgttgtatggatataccacattttgtttatccattcatcatttgatggacatttaggttgtttccgccttttggctattgtgaataatgcttcgatgaacagagatgtacaaatacctgtttgagttcctattttcaactctgtaggtatatacctaggagaggagttgctggatcattgctaattctatgtttaagtttttgaggaaccacaaaactgttttccacttagcggcttttatttgcaccgtgaataacaagggaacatgtattcccatttctgatacttcttctgggccgcccctgccctttactcagtctacctcaagagagatgatagagtaacttccctgattaataaagtctgttctctttttgtctccttgggtgtgaatttacctacacaacacatgtcattctctcctttcctccatgacaaaaacacagggcagtgctccccagaggaggattgttccggtctgtgctaacataacaagatgaataagtgttgttcattctggggttgcggttggaggccagatagattttgttcttcaaactgacttctgcaaaataaatgctaatgttttgtctttgatctgatctttgttgttgttggttttccccccccacccccaaattgtctggagcctgcatagagttcaatgtgctatttactggttttgtattggagaacgcaaaacttaggatgtaagaggttatgacaccagaagaacttgatctttatagatgtggcctggaattataggttcattgtctaactgtccacttacttttagttatgtcaacttggagaatttacctaatattttagttttaatttcctcatcaatgaaaagggagaaatcctactcatctttcttatgtaccaaggatactgtggggctcaccaaagtatcaaggcaagtgcgtgttaacagataatctcccccaaaagtaaaattctttctaattgacatttttcatttcagacattttaatagctttttcatagtgtacactaatgctaggaatctgaatttttaaaactttactacagaagccccagtaggatgcctgtctacaggaatatggtacagatagagaagtcagtaagcatccagtcatcaagtagaaaataggtcacttttcatggtaagcattcatcagccagtatgtgatgatttgaccagagtgactggccacttcaccaccaagatcctttcaagctctcatattttagaagtgacttttattttgagggaaaacattttgagacaactctaactccataacgtttcatgacttcatatggcatcatctctagattatcagaatatacctacagtaagaaatgttcttatcttttctaatattctcattttaggtaacatgtcaccttgccaaacttttcgacagcattgcagatctgcagtttgaagacaatcaggatgtttctgcacacagggcagttggaatgtacagcaaagaaaaggagtatgtcccattccaagccgagtgtgaatgtgtgggccatgtaagatttgattatgaggttttctatgctaggggagtattttcagcatgctcttagaaggttgagttcaacaagcaaaaaattcaacccaggtcaaatcaggctctgcttagttttgtgctcggaggttcctttttatctgtatccactgtgacagagggctcttctgccatgcgtcccagtttctactcatgtggctttggcacccagcagggtctcagagacgctaggaattgagctagacagaagcaactgtcacagattgaatgagtgaccccagaattagtagcaaatgcaactcagtgactgagtctgctacaaagagtattctgttttcaccactgctcggagaacagagaagggttatagtgaagcagcaccttgcaataaagcttgttttaaagaggctttgtggttcagtagtccattgtgaatgttataaatggctcctcataaataaagttgatcgagtctagcaagctgatgtcctgtactctaattaccatgtgcacagagttaagttagcatattctctcctctcacagccaaatacctcaaaaatattcttaacagttatccgcaagaatggctcattatgatttctgaaagcgtttctggtgtgttcagatgatttaggggaattgcatctttttatgatggagcttgcgtagcttgggttaatccacagagtaactgatggaatagtgtctagtggagaaccatttgggttggggcaggggttcctgaaagtatttgcagaaagatgagtggcaaccttatttcacaagggttttctttactcctttctgttgctttttaatattgtaccagaaaaatcctgccaaatgaaggagaagcagatggtggaatactttgattaaaatatattttttgatctcttgggctttttaggatgatattataatgattagaaaaagttgccataaactctcttgacaaaagtgtgttgctgtctgctccctcccagcaaactgctcaccgactggcatgatgcccggagggggatagtccaattgatggatgtggttgtcactagcaggaacccttgatattgaaagtttttatagtgctctaatttattctgtataagcaacttatgctagagacttgtaaacatatacaaattcaccctctaattgcctttgttttataaaaagatgcttttaatttggtgcttttttgtatttctgcctcttttaattggctcaccccaatttagtccattagtgtattcttcagcaagtgttgaatacctactatgcatcagatgctaggtcaggctttggggagttccgaaatggcccttgtcttcgaggagctcttaggcccattgagaaaatggatatgcacataataatggaggtagcaattgttgttatagggggttggttgagaagtgccaaaaagggaaggatccagcaagcacctcatcagagcttagttctcaaagcatactgagttaggttgccattgttggcacagtcatctgtacgtgagctgacatattgacatgtatgtgtgtttggtcttcccaaatggactgcaaagttcttgagaacaggtggccatgtggaggatatggatcccagggtatccaggagacatacaataatgactgaattaatgagggaacttgttgcttgatgaccttaaaagttacccttagttattaaggcagagataccagaccccattggttagatcagaacaacctgacataattcggttaatctgaactcatgcatgttaacaaagcacagttgtgaagccagagggaaggcccttaagaagagatactgaggccatttccagagcagtgtttcctgtttctttcaagagaggaggttgtccactcattaaccacttatcactccattccaattcttcagaggttctaggaatgctgctgctctcttcacaggggtggaggaagaagtcagttgtatcatcttcagaatctcatgtgattcttggtatttattttttatagtcactttttattgctatggtcaattatttgcaaataatatatgtatcactttaattatatgatatcctaagaaaataaatacctggattaatataacaaaatacatttgaacaggatggaaactgggctaagttgtatttttgggcgcaaactaagcttcaattttttaaaaaaaaaaagattaatttttacaagtcagcagttgtcctatgtctaatactctcctgtggtctaatttctgacaagtgtgaagattagagccagtagggaatataattaaggtacttgctgaaaacattttatcttaaaactgtgaactatgaagattttagagaagaattttcagtagatttaaaaattaatagaaaaaaatttaactgaatttttattattaaagctctagaatatgactcatacctctataggtgtctgtgatgtttggcttctgaaaacactgtgtgttaccagaggggaatcttggtctagaacctccttgccttcaaagctgagaaatgaatagtgaagaaccccttttctgtttaggctgtggaaagttgttagccagctggtgggtaaagtcagatgagcattattcctgggagaaggcgggttcctgcaggagaaagatttcaccaatccgttgttcactttcccctttgagttatgcctcttgcagttttctacctgggtttaaaatgaatccacctggggcattaccctctgcgtggccttagagccagtaggaggatgaaattatccttccatagttaagcctgtgttataacatttcaacttgcttccaaaggtggaaacatggcttctgcaacttgaacagactatgcaagaaacggtgcgtcattctataacagaagccatagtggcctacgaggaaaaacctagggaactgtggatttttgatttcccagctcaggttgcactaaccagctcacaaatatggtggaccacagatgtaggaatagccttcagtagactggaagaaggctacgaaacagccctgaaggatttccataaaaaacaggtattacatagatttgtgattttgagacataaaggaacttcaagatgtaagcttgcttcattcattcttttagtcattcatttaccgagtgtcatctgtgtgcaaaatactatgctgggaagattttagcaatcagttgttaaatcattttttacctttgtggtatccttctagatttctttatgggtttttaaaaagtacatcgtgtctattgtcttctaaggctctaggatagcactcatactagatactgtacatgcttattttcttctgtgtaagactctccaactaggcagatcatgtatttattagaaaatatgtgcatgatttgcattattcaaaatggtggaggttggctcagcaagagcaaatattttcatgggctttggttttctgttaattataaattacagatgagaactttgaaaaataatctattttgaattctattttattgatcccagttatcctgtgacctttccttaagtctttcatcttaatatgtgctgtgagctatataacagttcagagatgtagtctttctttggtcttatagaatcagagtatattaggcttgaaaaggagtttaagtattagtttgtctactcttctggttttcagtggataaaatctgaatccataaatatgaagtggctttcccaatgttgcacagtttataagtgaacctggtaggattgtaccttcttcctggtactgagttagaatgcttcccaatgctcctcatcgaccccttttctgctttagcagtacttttacttcaataacttgagaatcaaatagatttagatagtgagtgatccttgtattgttaacacatttgaagattcaagtgtggattattccttttaattttactctttcaatcttgcatagcgaccacccaacttatttatattactaaagaagtgtttgtaccacttacttttggggaaaaagaaattcttgattttacactcttaggggaagataaggtaattgtttctatttaataggcttgaagttacaggattcaattgaaagaagtggctggtttcttcctacggtgccatctttgcaattctagtaactaccacttggatgctgaagctgagtagttaaattttttttcatggacataaataactgagataattaaatgcaattctgctatgcctttcttataaaatagcctctggttagttaatttattgatatttatgcttttattatgaccattttcattatgcatataagtaaggacatttaaaaatacttggttaaaataatatcctcttttaaatttcagctatcctcaatcactactcaaacttaaatctttctacatgcatattcctacttattttactctgttttttttctaactcttatctccaacttgtcttttttttgtttctagactgttttattgcttataaggttaaatgatgttttatggctatttattatttatatcagcttttttatttctttgttattttttgctgttaaagatgataaagaaaatacagtcacagaaaatgaaaagaagggacataacatttaaacaacacccataaattcattttcaggagaaaaattattaacattttggcatgcaaacatcaaaagttttttctctatttactatcttttgtctgtctttatgaatgtatagacatgcctgtttataggtataaacatgtataaatctgtagctatttatatataagtgtaattatttatgtagctatgtatctgtgtctatagatacacattttaaaaaattattttacattccatacatttatttgattattttatattttcactcaatatattatctacatattttcttgtcataaatatacatcagatccacactaaaagtgactgaatattatttctttatatggatataccagaatttattttctttcttctcctttgtttcggtttactctggttgtctaacttcttatcaggcactgctctaggttctgtgattctagcagcgatgttcctccactcaggcacttacattctagttaatcattaatagatcttaacgtctctcctcaagaatcttaggatcatttattctgttctccactccccatcttacatgtagtcatttaaaccttatttttttaaaattatccattaattatggtgggagtggtattattatttcagatcttaattagatttaccaacatatttaccaatgactttgctcattttttatttatttttcacctgattgcttatttgtgaattaaattcccttctttctatagaatatattttaggagtttgtgcagtggtgaattgttacaggaaaatttctggtcccttgtctttattttgacttcctttttgataatccagctgggtatagaattctaagttgatagttttttttaatacctgaaaaatatttttccatttatcttatggcttttattattgttattgtaaaatcttatgtcattcaaattatttttccattgtaagctatctgtcttgttttgggggataattttaagatttctttctttttgtggttctgataaaacttttttccttgtagcatatgattaagaagaaagaggaatccagggccagattaagtagactcaaatctcagcttctactattcattagctatgtgactatggacaagctatttagctactctatgccttagttttatcatctgcaaaacacggacaatgacagtacttgcatcgtaggatcattagaaggattacttagttagtatatggaaaatactattttttttttgagatggagtttcgctcctgtcatccagtctggagtgcaatggcacaatctcagctcactgcaacctctaccttccaggtcaagcaattctcctgccacagcctcctgagtagctgggattacaggcaccctccattatgcccagctaatttttgtgtttttagtagagacagggtttcaccatgttggccaggctggtctcgaactcctgacctcaagatgatccacctgcctcgacctcccaaagtgctgggattatagacatgagccactgtgcctggccaaatgctatttttaaatagtgttttagtttatgtgctatataagggctggctattgctgctgttgttaatgctatgacaataatgatgatggtgtccagtgtggtacacaacttatttaatacattttcctcagtagtttataagaaaaattttctaacatgcagaaaagctgaaagaattttgtaacatgtgtgcctaccacttagattctacaattaatatcttgttttattttctttataacatgtcatttatcaaaccctataaccatccatcaattcattttgtgtctatgaatcatttcaaaggaagttgcagataccataatctttacccctaaatattccattatttaaaattttaaattttaattgaaaggtaaatactgtgtatatttatgtgtacacatgatgttttgatatctgtatgtatgatggaatggctaaatcagggtatttaacatttgcgttacctcacttttttttgtggtaagaatgtttaaaaggtactttcttagcacttttcaaaaatattttattttgttactaactgaggtcaccatgatgtacaatagacctcttgaacttattcctcccaactgaaattttgtgtcctttgactaatagctccccaaaccttctacccctcagcctgtggtaactactattttgctgtttatgtaaattggactttttcatttaaaatttttttaaattttatttgcagaaatgtatgaagtacaagtgcaatcttgctacctgcgttgaattcgtaatggtgaattcagtgctttttagggtatctttcatctgaacaatgtatagtgtgtccattaatttctcatcatccaccccttaccaccccctaatgattcccagtctccgttgtctgtcattccacactcaatatccatgtgtacacattgtttagctcccacttataggtgagaacatgtgacatttgtctatgtctcacttgtttcactgatgataatgacctctagttccctgcgtgttgctacaaaagacatgattttattcttttttatggtggagtagtagtccattgtatatatatgtcacattttctttttccattcatccgtcagtggccacttaggttgattccgtaagtttgctattgtgaatagtgttgcaataaacataggggtagagatatctttctgatgcaatgacttattttcctttcagtagatacttggtaatgggattgctgggtcaaatgctggttctattattagttctttgagaaatctccatactgttttccataggggttgtgctaatttatattctcacgaagaatgtataagagttcttttttttccgcatcttcaccaacatctgtgttgttgttggtctttttaatagccattctgactgctatagtatctcactgtggttttaatttgcatttccctgatgattagtgatgttgagcattttttcagatgtcctttggtttttgtataacttcttttgaaaaatgtttattcatggagtttgacatttttatattccacatacaagtgagatcatacagtatttgtttttctatgcctggcttatttcaattcacataatgtcctcctgattgtcataaatgacaggatttcctttttttttttttaaagacacaatagtatttcattgtgtatatttgccatatttgctttattcgtccattgatggagacctaggttgattccatagcttagtgattcttcataatgctgaataatgctgaagagatacaggtgtctcttcaacgtactgatttcagttctctggtatatatctccattagtcagattgctggatcatatggtaattctatttttaattttttgaggaaactttatgctatttttcataatggctgcactaacttacattcccaccaacagtgtacaaggattccctttttaagcacttcaatttacatacccaattcatcagtttaatttcagttattatatctcaatttcccaaagtttttttttttttttggcttttttaaaaattttatggtcacctgtcttttcattgtggtttctattctttaatcttattaattattttaaagagatgtttaatagttttacttggattgttctactagctctagttctgaggctggatctcctgttaaatttgatttgtttttaaatgttcatttttaaaggttatctttatgtctggttttttttctgtaggaattgtcttccctaaattgagcaaatgtctctacagtgtatctcccctcgcccccgcccccgcaattctttcaggtttctatagatcttctaagttctgggtgatgattgtgattatgattgagacagtcttgctctttttcctgggctggagttcagtgaagaaatcatggctcactgcagcctcaaactcctgggctcaagcaaacctcccgcctcatgttcctgagtagctaggaccacaggtgcatactaccacagctgactaatttttgtttttttcttatggagaggtggtctaactatgttgagcaggctggttttgaactccaggcttgaagcaatcctcccactccagtctctcaaagtgctggaattacaggtgtgagccactgcctcggccagttgtagattaattttgcaattactcagtttaggattttctgatcacattagcagggttaatttggatgcttcagtatctcagctttatgttcaacatctcagtcccaactttctgccttgcttgagggagtatgagaggcacaactgaaatgggaacatttctgtccccatgtggcaatttaaacctcagctccagatgtttggctctctgtccaaattctttgagctgccatggcattcgcttatcgacctcatcatacctctctgctttgaggctcattcttgttgtcaggaagggatcagtctcctctctttctttatctctctctctctctctcactctctcttccccttcctccctctcagtgcctttcactccctctctctcactccgctattgacctctccccctttctacctttctcatgtttggctatgtactttgtatttagatatgttctgttttatttcatatttctgtgttaataaagaaattgtccatgttcatttaatatattgcaagaccacctattattatgatgattattgttggtaatactggctagttgggttgcttttccatttttggttatcgttaataatactgcaaggaacagccttgtatagacatgttacatgtatttttatttattcaggataaatttccagatgtaaaattgctagatcaaagcctttgcaagatagtgccaaatttaccttcccaatatcagtgtataagaagtgtccactccttcccctgtcaacaacattgggctggttcttttttttgttctcattcttataaaattattcatatcccagtagctttggctggttcaactaattaatggaatttagtgttcttctcttaaaatcttttaaaagttttccactttgttctagagttaaatagtgcttcttttttcatgttggatgagaaatagagaaaagggatgatttgtgaagaaagcatttatccacataattataaaacacttctagcatgaattgaaatgtttgacagaccagacaagcagatgcttttactacagtgtttcagttttgtgactggcactaacatgtatattacagaagctaacatttgaattctgctaagctgtggtttgggtcatgagaaatgtttgcatctaagttgaaacctttttagttttcttcctttcaaaatggatgtaaccatctgctggagtgtgcttttaattaaaattattcttactaatactgtaagcagttttttaaatgagctttagtcatttaaaatagcttaattttaaaactggtatcagagttgtgtataattgatgattataagtaattcctttcagtaattcctttccttggttatcccaaattgtagtgagataaataaaccaaggtaataattttaaactctatttcccccttggatctatggtgattgcatattagtattgggattaaaggcaaaaatactgcattttgaatatatatcgctgccttgtcagagtctttgaaaaaagtggcaagtatgataaatttaatttcccagatttgaaggttccttggtgaaagtgttttgttttggaggcttgggatatggtaggaaagtttctccactcctcttttattattgagctgtgtgaaaatcatcaaaagagagatagaagtgttttaaactttaaaaaattaatatctgtagtgtgcagggacattacccagagacttttgttaagaactcatgataaataatataaaacttttctcattaaccatcctctccctctcaacaaagactcagaaataccagtatacatataagaaagagaccctcattttgctgctgaaagccaatttttggcctcacttttagttgctaaggaagtcttttaaaaaatttggatacaatattggtagcattcttatcttgtttcagccctattacctgaatagagaagcctgtcaagcctggagctaccaagtgtatattggacacaagtattttttttttttggcctttatataacaatgtgatctgatagccttatactttataatctagcagtaactcacaagatcatgagtagagcacatactctctacctcccctctcatcaaaggttacattgaatgacaggtaaggtatatgaaaaaaaacatagtgttcctagaaatacaggaacagatgatttgaggaatgctaggaacacatgaaattgaattgatagctgactaagaacagagaaaatcagtccaaacctataaaaagaggaagctattgcaatggtaagccaattttcacccagcaaaatttcagataaattatgaactcaccttaagcaaatataaaaaatgtggagtttatggttagtgataaggattaaatctagaagaaatggataactgtagcagcttctctcccctgtatatcccaagaggctattagtggaggtgtttgtccccagtacaaagccctgagaaatgctttgcaagcaaagtgagccatttatagagggcttctgtcataaatatgtcttgactgaagagcaggagttggcctactttttctgggaagaatcaggtagtaattattttgtctttgtgggccatatagtctcttctgcatgcacgcatctctattgtagtggttgcaaagaagcaattcataatttgtaagtgaatagttgggttgtaataaaatggtgtttataaaaacaggtggtgggccaaatttggttcatggcctatagtttaccacctctgctttagagaaagaagcagaacaaatcctgaagtaactgaagatccccacaatgagagatggaggtaagagaaaaaaggatttgtcacccatatatgccattggatttcaatatgatccattaacatgagagttggttctttgaacagaccaataatactgacaaattttgcagtttagagaaggaatcaaaaacatacaataaagggatagggaaaaaacataatccctgtaagagattttaaaatgactgtgtacgtatgtgattttttttgctaataattaagtcaaaatctaaaataaatggatgtttctctatgaatactttttctagaattgaatcaaaataatttagaaaactcaagtagaccattaacgatggaaataattgaaattgtaatcatggtagtcaaagatgggcactccttcctaaataggaccctgtttcaatgattttatcatgggaaaggtaaacaccatgttacatcaactgttctggaatataaacagagatgtaaggattttccactctttctataaagttctaatatacttgatagaaaaaccacacaaagataaaatacaaaagaaaattctttcagcaaatctcctaagttagcatatcttcttttttgtgtggattttttacttaacactgggagccagtccttatgggtcttacatttatatacatcttatgaacagaggtaatgactgccctttgttccagatatatttttatagtgaacattcttgaaaatagagatagtatctctctccagagcaaagggcatgttgacttattttttagtataataaaaataatatctcttcctagggcaaatgtcagacatgctgtcttataaaagatttgcactccctaaatccagaatgtttctcttgtaacacagctcattgcatgtgctagccctctttgaatatcctttgaaagtttgtactcagtgctaatgttctaatattactcatggtattgctgtaataaactgtcctttatctctgacctgtgagtctcatgtcttctgccagcatccatgacttgttagccagcaagtaggataaaatttcagacccctcacatttttcaacgaacatatttttgagattcatctctgtcgttgcatgtatttgctgttcattatttgttattgcttactaataatacattgtatacgtgtaccacaatttttctactcatcttgttacttgacatttgggtttccagtttgagactattatttctaaggctgctttaaacattactggattaagtctttttgtgaacatatattttcatttctcctgggtagaagcctaaaagtgaaattgctggatcacagagaaagtgtacgtttaaccatttaagaaacagtcaaacagttctctattgttaatactaccatggacaatgtaaccgaatttcagttgctttatatactcgctcatatttgtattgtcagtcttataattgcagccatttcagtggatataaaatagtatatcattgtgattttaactggcatttttctaatgtctaaagatgttgagcaacttcttatggggtaattagcattcgtacatcctctattgtgaagtatctattaaaatcttttgatcttttgctccattttcaaacagttgggtgatttgccttatatatttttaagacagggtctcactctgtcaaccaggctggagtgcagtggcacaatctgcagcctcaaactcctgggctcgagcgattctcctgcctcagcctcttttgtagcaaggactagaggcaagcaccaccgtgctcagtttaaacattttaaaaattctttttgtaggtcttgctatgtttcccaggttctcttgagctcctgacctcaaatgatcctcctgcctcggcctcccaaagtgttgggattaaaggtgtgagccactgagcctggtcttttttaattgttgattgtaggatttctttatttatttgggatacaagttttttgttcgaaaatggactactcattttcttaatggcatattttatcagaaagttataattttgatgcagtgtagtgtatcacatttttttttcatggctagtgctttttgtgtctttttaaaaatgtttttctttttgtgtgtgtgtgtgtgtgtgtatgagagatagatgttattgcctgtccaaaagtcatgaaaatatatttctgtttctctcaaggtgcttcatggttctgggtttttcccattaggtctgcaatccatacctctttcctttctctattgaattaatgtggtaccttggttgaaagtcaactgactatatacgtatgtgggtctattttcagattctcttgtttcattgatctatttttctgccttcatgccaaatccatctttcttaattaccatagctttgtagtaatccttaaagtcattttatatataccttccaactttgttcattattttccccaagattgttttgactgtttgaagttcttttttatacaactcttacatcacattgtttatttgtacaaacctaattaattttagcctaattaaattgcgactggggcagcctctaaatataaattttggaagaatgaacatctcaataattatggttcttataacccaagaacatggtgtatctctttatatgggttttctctaatttctctcagcaatgttttctgtagttttcaatgtagaagccttgcacatttctcattagatttatttttagatggttgatgtgttttttattctattttatataataatttttaaatttcatttcccagtgtttttggctggtacatagaaatttattgatttttaaatattcaccttttatcttggggctttgctaaatttacttagtacatttagtagtttttaaataaatatatactctacagggcttcctgtgtacagaaatacatcatctgtaagtaatgacagttttcttctcttccattctttttctttttgttctttatttcctttttttgagctattgaattggttgggcctccagcacagtgttgaatagaggtagtgagacatccttgtccatttacattctttggtaagagtaatgtttctccagtaaatataatgttagttgaatgtttcttggagatgccccttatcagatagaggaaaatcctttccattaccacatgcagagagtttgcatcttaaatcagcattgagctttctccaatctcatgagatgaccatgccattctgttattgtggtgaattttcgaaagttacgccaactttgcattcctgaataataaacaattggttatgaattatcctttaagtgtgtacgtgtgtgtgtgtgtgtgtgtgtgtgtatttttggctggattctatttgctattattttgttaacaaattctacatttatgtttatcaggtacatttgtctgtaattttctttttctatgatatctttgccagattttgaaatcagggtatactccttagaaggagttggaaagtgatccatttatatctattttgtgaaagagcttatgttagacatcactggtgatgcatctgggcttgaagttttctttatagaacattttttattgtaaattgatttcttttatacatatgcagctgtttagttttttgggctcttcctttcttgtgtcagttttggaagtttgtatttttcaagatatttgcccattttaagtaattcagcatgtggcaaattacaaacctctggccaaatctggcccagtgtctattgtctgtggctattttcacatcacgatggcagagtggagtggctgtgacagagactgcatggcctacaaatccaaaaatatttactatctgttccttttcaggaaaagggccacacttggcctatgcttttcaatttactgatgtaagttggtcatgctatttcagtattatcctcagaacatctggaagatctgcccagatgtcctactttcatttctggggttcgtaatttattttttttctcttttttttcttaattgggttttctaggtgtttatcaattttatttctgttttcaaagaactaatctttgacgttattggttttctctatagcttgttttatatttcacttatctctgcccttattttgattatttcctttcttctacttactttgagcttaatttgttcctctttttcaagtttcttacagtgggcgtttattgactttatacctttttcttttctaatataagcatttaaaggaacttttataacttaaaaaatatctaccagaaacctgcagagaaaatcatacttaatggtgaaacattagaatcatttccattagtgtcaagaatcaggtaatgatgctcactatatctgacattcgttgctcaatattgcactggtggttttagcagtaggattaaaggagaagtaggaagtgaacactgaaaagaggacaacaaactgagattcaacaacccatgttctgatagttttaagagcatgggacttggtctctttgtcatttcctttgctctggctggcggaaatgaaaattcattgtttctgatattgctgaaggtgaaactggtgggtttcaagatgagaggtcctcgttgctgttatgaaacaagaggaacttcagtattatgtcttgttagaaagggatccaggatcctggtagctgatctccaaggtgctatagcaattacattgtaatgttcactttgatctgctaagctgaggacttctagctccagactacttttctaagagagtgtgtctcgctctattgtccaggctagagtgcagtaacgtgatcatagctcactgcagcctcaaacttacgggctcaaacagtcctcctgcctcagcctcccaagtaggtaggactacagaggcttaacaccatgtctggctaagttttacatttttttgtagagatggggtcttgctgtgttgcctaggctggtctcaaactcctggcctcaggccattctcgctccttggcctccagaagcactggggttacaggcatgagccaccaaatctgacctccagatctcaacttttctgcagagtggcctcttccagcttctttgccaccatggcttgggtgtccccatattgggagatatgccatggctgatgctggtaaaactgcaatgcttctgctgcaaggaagattttttttctttgttgccttatttaaacctatagtatttagggacacactctttaaattcacggtatggcctctttctaccatgctgccatgggagccaggacaggaaaaaatgggggaccagccaccactatgtatcaggaaccactgcttctctctgaccttaagtctgttactttctaggtctgacattgtcctacatggtgaacccactgtcatcctaccaagctcgctggccctctttgggaacactgtagtcctttagatatgtgtatcctatacaccccaatggtggtcaagattgtgtcttttcctttttctttttttcacggtgtgtgacatagaaggtgtaagatcttgtctttttgttaggaagcatttctatgtttatataaataagagaattcataagtggggtatactgagttatctctctctacttaccacaatcattggaggccagctcttgcctggtctgataccctgttatccacataagaaggtttagtatttgtaaaatatacagtgagatcttagaattgtgtactagaccctggctccaccgtttataactgtgtgatctcaggcaggtaatcttatattctcatatgtaaaactggaatactaatcgtgcctacttcgtagagttgtgatgattaaattagaaaacacatacacagtacacatgtacccatacaatgcctgtcagtcagtgcttttattatctgccgacatcatcaaagaggaactagagcaatggccatcaggctgatgtccctccccccacagcatcctccagctaggagggaagggtgatctccactgcccagagcatttctccatctctgctctgggtcccttctgctctgacctctctcaaggctgccctgactttctttcctcctgtttcttcggtttctcgctcttgctcattcccatcagtaattaaacatgcccaactccctcattactcaaaacaaaataataaccaaaaattgtccactcatgccacatcttttgtttcctgccttatctttgttttattataatcaagcttgctgacctatacttgctctttcctttttctcatcaccacaacctatttctaccacttgattgagtctatttctgttttctttaacttagaaaatacttcctacttcttcacatactctgttcctttatattcatgttttttttttgaattctagttttctacctagaaaacttgggctgctgtttacttcacctggctggtcttcctcctgctccttaaatattcctgttccttatggctctattctgttttgttttgtgtgtgtgtgtgtgtgtgtgtgtgtgtgtgtgagttttgttttgtttttcatggagtttcaccctgtcgcccaggctggaatgcagtggcactatctcggctcactgcaacctctgcctcctgggttcaagcaattcttctgcctcagcctcccaagtacctggagttataggcgtgatcatgcccagctaatttttgtatttttagtacagacgaggcttcaccatcttggccagactggtcttgaactcctgatctcaggtgatccacccaccctggcctcccaaagttctgggattacagatgtgagccactgcgcctggtctgtttttgtgttttgttttgtttgaaacagggtctcgctctgtcacccaggctggagtgcagtggtgtgatcttggctcactgcaacttctgcctcccagcttcaaacaattcccatgcctcagcctcccaagtaactggggttacaagtgtgcaccaccatgcctggctaatgtttttgtagttttagtagatacagggtttcgccatgttgaccaggcctgtaactcctagcctcaagtgatccatctgcctcggcctgccacgatctttctttttccttcccttttcttttcctcttttcttttttcacacatccctgactgatttcatccacttttatggctgctcagtttcctttgctccagtctacatctctctcctgaagcacagccagaagcagatagggaattttcactgaagtctcacacgcacacccaatctaaaagatccagtgcacattagctcttctcaaacttgcctcccaacgtgcccaactgcagaaaaaaaaaagaacaaaaaaccaacatacttcactagttgctcacactagaagcccgcttgactcttcttttcctcaatagccaatcaaccaccaattctgtcactgttctgaagatccctattctcactgccttctccaactgctttgataatgtcctagaccaagccactctctttcatctaaatgactgtagcatcctcctcacaggtcttttcttccagtcttaccttcctccaattcattctttacagtatagccagagaaataatttaataacacaaatctcattatcaccccactttctagacctttcagcaccatctcattgtcctaactgagctgggcaagccctgcatgcttgggcacttgccttcctctgcagcatccttacacacccctccttcctatgccgcccactcctgccatgggtgacctctttcagtttttccacagagccacccgatccattcagggcctttacacaggctgcttcctgtggcataacgactgcctccctgctggccaacccctaaattcttgtcaacctaaatcctgctcattctttaggtcttagtatacattcctctaaagtgcctttctaatccctatatcaggcaaggccttatttctgtgtgctgtcagcatactttctacttgccctagcaaaacaattttaattatttatctgcattccttcttgtcctgtaaggtctggaaacaagaaccacatttgtcatcttgtatgagtgagtgaatgagagaacaaaaaactgttgttttggtgtgtattgttgctgtcgttcgtttgttcatttcttcatcagttcctacagcgagtgttgatttggacacatgctttatgctggccgctatgctaagcatgagaacataacacagaatgagacagatgtgggccttgctcctttagagtttagggtggaggagacaaagaaatacatgattgataggatactcataagttccataaagataataaaatagaaacatttagaataaatagatagggggtaatagtaaatagaatggccagggaaggccaatttgaggaggtaaatttgaagtacagctttgaataatgagaggaagccagtcatacaaggattagagggaagatgactcccggaacatgaagtggttgctgtggccttaaaacagctgtgataggagaacagagagaaggccagcatggttagtgaagtgagataggaaaggagtggtgtgaggtcatggaagactttgtgctccaggaacaaaagtttggattttactctaagttgggcttatttctagttcaagatacatgctgtacttgcactctaatgaagccaagatgtcccaggaaaatagccacttgagtttcaaaggggcgtaggtagacttgagccaagacacccttgatccagtagaaaatcatgtaacactgttgcgatcagtggcaagaatatgtactgattacatgataggatatattttcttaaagctgctaaggagtgttttctatgtcacagaccataaacttatatacaagtacagtactgaccataatgattgctatctcttgccactgcccaaataatagacattttataactacattatataactgtgggtacagaattttattacttacaaaagagtatcatcagagaaggtttaatcttgatacacagtataagatccccagcatatgatgctgtgcagattatgttgacaagctgtgtttttaatcatcttccatttgactgcacttctgtgaaaaatgaatcaataatgcagaaatcacaggttgttgggaggctcaggcaagacaatgcgtgtgaatgcacttacaattatacatgttcttataaggcatatgatattattactgttgttacaatcaactttattttaaaccaaatactggtagtggtgtaagattggatactgcaaagaccggatatcttgacccagatgagaaaatatccaaggcctaaatatctcttttctcactaaagtgtatattaattttccctagaaacttgcataggtatgggttgttattgtacattaattcatctgttcagcatacacccattgagcacccacactctgacagttcttcagtggctctgggaaaaggcatcgaataagatggatgctgtcgttgcctttgtggaacataaaatctaggggatgatgagcagtgaacatattagacataaaacaataatcacatctgctttttaaacatttaactactttttaaagatgcaatgtattaaaagtacaggtgtatctcattttactgtgattcactttactgtgctttgcagatactgcctttttttttttttttttttaaacaaattaaagatctgtggcaaccctatctatgctgggcattgacatcatcattcaaacaacatgagcttgctttgtgtctttttgtcacattttcataattcttggaatatttaatttttttattattgtatctatcatagtgatctgtgatcagtaatctttttttattttttgagacagaatctcactctgtcacccaggctggagtgcagtggtgtgatctcagctcactgcagcctatacatctcagagtcaagcgattctcctgcctcagcctcccgtgtagctgggattacaggtacacgtcactatgcctggctgatattttttgtatttttagtagagatggggtttcaccccattggccaggctggtctttaactcctgacctcaagtgatccacctgcctgggcctcccaaagtgctgagattacaggcatgagccatcacggccagcctgtgatcagtgatctttgatgtcactcttgtagtaggttaaggtacatcattgccaacaagatcttttgacttttttattatagccagtgtaatgggtgtgaggtgatagctcattgtggttttgatttctctaatgattagtgattttgagcatcttttcatatactagttagacatttgtatgttttctttgggaaaatgtctattctggtcctttgcccattgctaatcagcctatttgttgccgttgagttgtatgagttccttatatattttagatattaattccttatcagatatattgtttgtaaatattttcttccattccataggctacctttttattttgttgatttttttctgttgatgtacagaaactttttagtttgatatagttcacttgtttattttttattttgttgtctatgtttttggtgtcaagtccaaaaaatcattgtcaagaccaaagtcatgaagcttttcccacttttttttttttaaggaattttacagtttcaggtcttatctttaagtctttgattcattttgagttttttttgtgtgtgtatagtgtaagggtccaatttcgttcttttgcatgtgatgtccagttttttccaacaccattaatgtaagagtcttctttcttcactgtttttggtgcctatgctgaaaatcagttgaaaaatttattttttaactctctattctgttccactggtctatgtgcctttttgtatgccagtaccacactgttttgattactatagctttgtaatataatttgaaatcaagagatgtgatgcctccagctttgtttttcttgcttaagattgctttggctattcagggtccttggtgattccatacaaattttaagattgttttttctacatctgcaaaaaaaaaaatggcatcaaaatcttgatgcagttgaattaagtctacagagaactctgggcagtacagagattttaacaaatataaattattctaatccaagggcataggatcattccatttatttgtgtctttaatttttttccttggagttttgtagttttcagtgtatggatctttgacctccttggtggttggtaggaagtagtatagccattatggaaaacattatgaacattcctcaaaatattaaaaataggactaccaaatgatccagcaatctcacttctgggtatataggtaaaggaaataaaatcactgtcttgacaagatatgtgcactcccgtgttcattgcagctttattcacaatagccaagatgtagaaaaaacccaagtattcattaatagatggataaagaaaatgtgtagacactcatgcccatgcacacacacacagaggaatatgatttagcctttacaaagaaggaatcttaccatttgtgacaacctggatgaatctgaagggcattattctatgtgaaataagctaaacacagaaagacaaatactgcataatctcacttataagtggattaaaaaaaaaaagtctaacacatagtaacggtacaatggtggttaccagaggatagggatgggggaaaacagaagatattggtcaaagggtacaaactttcagttatagcatgaataagttctagagatctaatttaacatatggcacctataattaataataacgtagtgtatacttgaaatttgctaagagagtaaatatcaagtattttcacttaaaagatgtgtgagctgatggatatgtcagttagcttggttggggtaatagtttcacaatgtatacctacatcaaaatatcacgttgtataccttaaacgtatacaatttttgttttccagtcatacctcaataaagcccagggggtggagaaatagggcaaatgcttataaagctgtcgtgtatcctgaatatctaggggacatatattaatatttttatttctttaagccagctttcctttgtgtttgactctaagtctgtcctgaatgcttcttgcacagctacagtttctcagacctgaagggatgggtaggtcttgtggaggctggagagggtctttgtgatgaatctgaagtcagactgttgggatttgaatttctcctccctggattggcaaatgtggttaatagggctttgactcaattttctcatctgcaaagttcggatacagattatctttcttttttaaaaaattttattattattatactttaagttttagggtacatgtgcacaacatgcaggtttgttacatatgtatacatatgccatgttggtgtgctgcacccattcactcgtcatttagcattttaagattaagtgcaatgagatcagcaacgtgcttagtcagtgcctggaaccttctttgttcttatttcatggaaattgcacatgttacagttatctcttcctccctttcttctcccttcttattccagctgtatgactttctctagcctccagccgcacggcaatctcagggaagtttgcagggtttcgcattttccggggcatgataatagtacagtagtggacctgtattttgacagtaggctacaaaggtttgagtctctggtgatctgtcatattcacttaccaccagctttcttaggtgctagcagtttgtcattgactgtccttttgcagagctgaagagaaaaggggatggtattgtttcacagtatgatacctggaataaggcagaaatattgtttttgtaaataaggcttgagtaaggcagaaatctttttgtgtaaataaccatactaacaaaatgaccacctaagacagcatctttcaaacctctctgaccacaattcaccataagaaatattttctattagatccaagttcacatgtttatgtaggtagtcaaaacggaaataaaacagcatgaaacaatacattctcttactacctgtgataccgtattttctattccattcacttcaatgaattgtcattcatggcattccattttattcctttccattctatgaaaaaagaccagcagtttgaaaaatatttatctacgagttcgacggacctaaacaagaataagaataaaggaggatattcttcatctcttaattttaaatattttttcagtagtcatcactatcttgtatttttaaaaaccaaagcaaacacaaattgttaggtgaatgcttttctaaagaaaaatataatttgtcatttagcttttactatgcttttttgaaagttagtctaatttggcctttcaagatttgtagtcatttcctttccaacaatgttatggaccgggctatcattagggtagagggtcagtccagtgcagccgggaaaccctgtgtcttccctggctttgtcattactcacaggttctcttgtccttcatctgtgtgagggggtaataatattgtgatttctacaccaaggttctttgaggtccagctggggtaacatatttgaaattgttttgtggccaggcgtggtggctcatgcctgtaatcccagcattttgggaggccgaggtaggcagatcactcaaggtcaggagtttgagaccagcctgaccaaaatggtgaaatcatgtccctacgaaaaatataagaattagctgggcgtggtggtgggcacctgtaatcccaactactagggaggctgaggcaggagaattgcttgaacccaggacgcagaggttgcagtgagcagagatcatgccactgcactccagcctgggtgacagagtgagactccatctcaaaaaaaaaaagaaattgttttgcaaactaaatcagcctttacaaatacgaagaatttggggctcttaaattctgtatttgtaacccttctctcctttttaaaaaatgattccttctagatttctcagctgaatacactgattacacttttgctgggagaacttccacctggagacagacagaagatcatgacaatttgtaccatagatgtccatgccagagacgtggtggcaaaacttatttctcagaaggcaagttgtttgtagaaattttatgtattcattattgtttcctgaaagtggtgtttattgccagagtagttccaagaaagtcgttgtttttttgaaagtttgtatgttttaattagtcctgaaaagttgtgtttgtcttgggtgcatttgattttggttagccaatatattattctgatgagacctattccaagtgatatcccaaaaggttttgccaagttaggaacatcagatcatcaaaaaaaattttatcacagtggaagaaccgtgagaaatcactgtgttcatctctctgtgtgtgaccgtcttggtcattggcctgtgagcctcaactctgtgacttacacagccaatagcagtaagattatgtgtatgtgatttaaaccatgtctgtgtgcctttgatacatttccccttgaagagagaggtgttggtcataattctaggttgtcacttgggtaatcctttgtctcttccttgaacaactaaattattgtcttgtaagaagttattttctaattcttttagtatactaataacctttcttttatatatctttaaaaagtcggccgggcatggtggctcacgcctgtaatcccagcactttgggaggccaaggcaggcagatcacgaggtcaggagatcgagaccatcctggctaacatggtgaaaccccgtctctaataaaaatacaaaaaattagccaagtgtggtggtgggtgcctgtagtcccagctacttgggaggctgaggcgggagaatggtgtgaacccaggaggcagaggttgcagtgagccgagatggcgccactgcactccagcctgggtgacagagcgagactccatctcaaaaaaaaaaaaaaaaaaaaaaaaatttctgtgtgtctttaagtgttggcagtgtttaatgtgaaaggagaattttctcatccttctttccaaaatatattcctatttacaaaagtcaggagtatgcttgtctactgggttacgcttgtttggtagtattaaaacaaggcaattcctttcacaattcgaatgcctgtacgtattgtgaagtgtttctgtgtttttttctgggtttttttctcaatttattaaaagcaaagtgaattttaattattttcataaagtgcaagaaaatgcttttcatatgaaccataaacatatattaacattccttgatccagcttcaggaccactagtgagcaatattctttaattgctagtccaaaacttttccttgcaaaacatcgcttaccatgtgttctgactttgataatgaactgtttatatctaactactcctttaatatggccttgtatcttcttatatattttattctattttataagtctgatgatttcaagtaggataaattctgatttaaaatatgtcctttattttgtactaaaaaatactttgtctaatacccaaccatctaatatacgtgaatatgcaatgctgaaacctgtgtagtcatcagacaaattagtatacagtaattttggtaagttcaactgattctcaagaaatccaagggtcacatttatcttgaaagagacagggatttttaactggaagatgaatggttaggattgagtagatgggaaagaacagcaatgaaaaatactgttatttgatgtgattaaaaacaaagcagaaaatctctgtactaaaagcagattggttttagaatgaacttggttgaaaatgtagtttatttatgcctctgcgatgcagaaattatggattatgtgtcatttaaatatagacagtatatttttccatctgacttcagtgatatgagtataaagttacaagatttatctaatcccctggggtgattcataaaagaggaaaaagcattgcttgaagaaattcatattgttttacataaaagccagtttaaaatgaagacttattacacgcatatttcttattaagtatttaaccatgtatatgctattataatttgcaatagcgtgcaagagatttcctatttatgagaattttagaaatgtgaaccagtagagttgattagattaataacttgttgccccaaactaccagtgtcctgcgtatgatgattatgcaatgcctttaggttgtcagtccccaagcttttacatggctgtctcaacttcgtcaccgatgggaggatacccagaaacactgctttgttaatatttgtgatgcccagttccagtacttctatgaatacttaggaaacagccctcgactagtgatcactcctctaactgacaggtaacaattcaaagtttccgtccagataggaaaaacaacccaaaaaagtcccctagtgtgagaatgaaaaggaaggaatgagaggaaacgatgaacaatgaactatgtgaaagtggtgaagagaattgaattagagaaacagagttacagaagctatacaatgcacaaatgatgaaatcatgagtggattaatatggctcaaggaagcattgttgattctgcctagttatctacaactaactttctggtatcaggatctatcaccacctccctccacccccacaggattcctttactgaaagtgtacaataactaggaattgcctgtgttcaaattcatatttgaggaactgcatacagtgaaaggaagggaaggtgaagaacatagcattcattaaatgattcaacaaatacttctgaagtactctgctaagtactattccactgttgaacagccagggttcctgctgtcacagagattactttctagtaagtgggggtaaagagaaacaataaaaaagtaaattaattattttaggctgtgatatatgctatgacaacaataaaaaaagatcaatatgtttaaaattgtcttgaagggagagcctactattgtggagagcttgagctgggacctaaatgatgaggaatcagttatgcagagatcctggggcagaaagttacaggcaagagcaaggacaaagtttccaaggtgggaagacacttggccagtttcagggatagaaagaaagccagtgtggctcaagtatttcaagggggcaggaggttactattattaatagttcgtttccacttgactccaagtaaatacatacctagtcagaatattgcggagataagaatatgtcacattgacgggaatttctttgttagtattccaatctctgctgacctgtttgatgggagacagcacatttaatctttggcattcatgaagcagaaatcacacctcaaggtcatagctgcatgcccaattatccactatcaccgaagtgtagacaatttcaaatataagtctataaagctggtttgctatggtagtcctgagaggctggtaggattctcccactacatttgtgattgttcttgcacatagtaacctgctcataatcgcgacatttgtgtattgtatagtttctataattatgtctaattcagttcttctaacttgtctctgattaaaagtcagcattcactgtcctcattagttaatttatgcattgctttcagtgagagggattaaaattgtagcttgatgaagtcacttgagaatagtcaaaactgcaaatgtgaagagtctaccgtacgcatgccattgtcaatagagaaggaggaaagggaggcccagggtataggagaaaaagggaagaggcattttaaagtttatcattatgtgaggcctgatagtttattaactttgaaattagaagaatcaccatgtgggttttttgggagctgaaaggaagatgaaagttcattttgatagtgtgaattgtgttggataaaatgtttccatttccatttcattctttgaattatttactaattgtttacattaacaaaatgatgcccttcaaattcttccattatatttcatttgatgctgaccatccctttgtgaggtaggcaggggagatagtgtctccttcttccatatgtggatgggttcagagacttaagtcaactgtgtattgactagaaggatgccggttaagctgctgttagatattccaaacaaaagacaatggctgaaataacacagaagtgggtatctcactgtccagaggtacaggctggcaggtggctgacatgctaaacatggtttccacatgtgttttagccagtgaaaggggaaaaaagagagtccaggtcaaatatctccaaggaagtgttgtaggaatggcactcgtcatttctgcacatacaccattggttggagtttggtcacttggcaactcctgactgaaaggaaggcaggaaatgtagtctctaaacactggcagccatatgcctacccaaaacttggaaccactggagaaaattacaaggcgaaaatctctactacaaaaagtactctgattcctagtctgggagccttttcactcattcattgtaagatacacttaaacatgcaatggatataaaatgcagaaacactgtctgttttcataattaatcgcttctatttgcatagtactttcaattttttaaggcatttacctttggccttctgaatatattcctacaattaacctcatttaatagaggagaaaactgaggtgtgttgatgtcaaaagacttatttaagattagcatctgatcattggcaaaggggacattagtctctcgtctcctgacctccatgtgtatatcattcactagacctgctgtctgtactaagagaaaaacaatttataaatctgaggaaactccaaataaagaatacagccatttgatgtccttgctatttgttttgtcttcttttattaggtattcttgtttcatgattttctaagaacttctgagtctttgctgcaaaaataagtattatggtaatctaagtggatgtagcaacacattccaaaggaatttgtaaaatatatttaaatacagtaaattgcccttttatattttctttgtatattgaaataggtatatgttatttgtatactatgtatttatagaaattacatatctcttaatgtattaagtagcagtttaatacagccaatgtttaattcattcatcatctaagacttctcttctacttttcctttataaacaatagtttggatgttgtctgccatattaatatctttacctagaaatatcagaaatttaatagtgttacaaatcaagtgttatttgtattcaaatacacagctcttaggaaatgagatcaataaacaaagaaatacattcttttctagtatttttagacagctagcctaaaaataaatgtgatagaaaatattctgattcattattgccatgaacaaatcagaagtatatcagtattttatgctactatcacattctagagcttcttaaactttttttctaatgtattgcctctgatgttttatgaaaatctcatattagactgtgatgtttgtgttttctattgcttaaaggtgttatattaccttaactcaatcacttcatctaaccatgagtggggctcctgctggcccagctggtaccgggaaaacagagaccaccaaagacctaggacgtgcccttggcatgatggtctatgtattcaactgttcagagcaaatggactacaaagtaagttagtaagagaataatgtgtaaaactttattctctaacattattcctgattgggaattattcaatataatagcgtaaaaaccccttctgttaaattctgagtgcctcactttatcatttagtccataggcaatatctataagggattggtgcagacaggagcttggggctgctttgatgagttcaaccgaatctctgtggaagttctgtcagtggtggcagtacaagtgaaaatgattcatgatgccatcagaaacaggaagaagaggtgagtggcatgcaggctatctcttgttacaaatagaaaaacatggaataatgcaggtaacctccccttcactgtctattgctacctctccctgtctcatgaaatagataaaggaagattctggtcgatttgggggaattattttgaatagtctcccatttttattagtggtttctaagtgttgagtacaacacatgtatattacattactttaatcacttaaaaaacaaacaacttctaggattggccagacacagtgactcatgcttgtgatcctggcactttgggagtttgaggcgagaggattgtttgagcccagaagttcaacaccagactgggcaatatagcgagacctggtgtctacaaaataaataaattttaaaaattagccaggcatggtggcatgtgcctgtagtcccagttatttttgaggctgaggcaagaggattgcttgagcccaggaggtcaaggctgcagtgagatgtgttcgtgccaccgtgctccagcctaggagacagagcaagaccctttctccaaaaaacccaaaagacttctaagatgctcattccattgatcagttctcagtcctcatctttcttgacctctggcagcatctgatgcagttggttattctccactgcatgatatactttcttcacgtgggttgaggacaacacctctcctacatctctctcccctcacagcgcttcattgctggtttcttctcatctataaaatgggggaaagaagagtacctgccttatagactactgtgatgattaaatgcaaagtacctggaaaaatgcctaccacatagtaagcactatatccgtgtttcctattatgttttattgttattatttcctggccaacccaactcacgttaggcatcacaggccccagtctttggatttactttctctatattttctccccttgttgatttcaactagtcccagggctttaaaaaaactctctctatgctgctgactaccagatgcccaggcttcctctctcctcatctctggactgacctaaacaactgcctggggcatcccaaggctctactggaggtctcccaggcttctcatatttaatatatccaaaataaaaatcttagtccttccaccaactccttctttgctagttgtctcatcccaataggttataccttcatgttcttgcagtaacttgggccaagacctttcaaattatgttcgaaatctaaatgcttctcaacacaatgccacattccaaaaagcaaaacacagctggcacttacgtttgatggcttaatttgagaaataaattagtatagtatgcagcacaattctggttctctttgtaacatttttatcaacagggcaatcttatttatctggcccacctgtgcccccttagtttttagaatatttttctcagctagcttgtccataggaacattttcaatgtcccaaggattatctagcctcttggactgtttacctgttgtagaagtttccaggttatcaggagatacatctggatatttctacattctagaaaatctctcagtccttctgccacgtgggccttgggtcccagttttttgtgttcaggtgtctgtttcctgacctgtcccatctctaaggccatgatagagaggctcagttatttgttcttagatctccagctatattttatctagcttttagtcaaaatctttttatttgatgtaacccagatgtcatttgaggccatcctttcttatggagatttatgtaactgatccatgtactgatttctgaaaattgccgagaatactccttggtagtctcctcttgtctgaatgtctgtaggtctgctctcttcatcttattttagcccatatgcagacagctctgctccttcttgacttcatgagcttattaaattctctgtacacatgaagatttaagagatgggaccatgcctcaattacaaagccttctagtgccttgccagctctaccctctggaggtccacacctttgactgtggctgtccctcctgtgtacaatgggagaagaggcagttattctgtggcaagagccaccgctctgcgtgtgagcggccctgccagcctgtctgccttccctagcctgacattctgggaaatgaagttttctccatttttatcttgactatacaaaatccacctgctcctaattacctagtgtctaaagcacccttagtcctaaacactgtggtttctttctgtgttttctctttcatgatgcagacccagctccttaactgcttcagccctcccctctcagcaatgcaagagatcagccttatattttgtctcgtttaccctcatttgaaagtttccctctacctgtctctcaatatggctcccatagcacattaccattcattgccctggccagcagcaacccacttgggtcctcacagatctttctgaaaatctttcactatttctccaacgcaaatctttcactgtttctccagtgcctttaagtgacagtaatagcattagtcatagctaacatctcttgagtattttccatgttctaggcattatacttttacccatttatatttataatcccttttaaatccttgcagaatccaataaggttggtaatatgattattatttttactagatgagggaattggaacataggataattaacttgcctaaaagggatatgcctggtatctgaatactcacagtctggctccagagctattgtacctctcagtgatatttaatagatttttcttgagtcaatgaaaggtatggagggaaagaggaagagaagttgaagaaatagacaaaacttaagactgagcaggacgtccctttctcctcttagtatgggcattctctgtctatgcagcatcccattcaaggaattgcagcccatgttgaaggtaaaaatgccatcacctccttccattaaatgttaaaatagtcaagtctttatttttatattctaggatactaaggctatgctaaaataaaaaagaatacttcccatttttataattcctccaggaaaagggagggtatttttaataaatatgcttcaaaacatattcaaaatatgtatgggcttatgaattttaaagaaaattacacagaataaacagcttcctaataatttgcattttgcagtggtttgcatttgtcaatgtgcattcatattcaatgaacacatttaatttcatcaacattctttttatggtagatttgtatttcttggggaagctatcacactgaagccatcagttggaatatttattactatgaacccgggttatgctggtcgaaccgaattaccggaaaatctcaaagctcttttcaggcaagtgttatgctttgtggcttagcatctggtgcactcatgccacctaatgttgttggtttgcactgttaagtggtttgcttttacttgaaaattcctaaggaaaatcctatatgatttccttgggctccttttatagacagaactttcaccatgataaattaacccttttgaattataaaaccaggactcaaaatcagtatttaaaagttacgtggtatatttgcatatttactgttagctattttgtaatgcatatttttattataaacataatctttcataattttttttttctttttttttttttaacagtcaaagtgcattttattgccaacagaacacttcaggaggaaatgctaacacaaagccaaggcgctggtgctggctcatttttgctcctcctgaccttggccagtatttggtagcctttccagagcacagggtgaaaggctaaagggctagggctggggtggggggagcaggagggcatggcagctgctggctctgtcctcccagcctggtcccacccctcctgccgctctccttgggctcaagggacacacattcgttcaaatctgacgggcaaagccagggcctagcccactctagccgcagggtcccctccctgagggccctggtccagaatctttcataaattatgagctgtttggaaaatatagaaaagaataaagaaaaagttacatcaccatccagaaataatgattgttatgttttctagcctccttttataatttatattttgtgggattaagatattacagtaggcatgatttttctttagttctcttcatttaatattttgacatattttatcatattattaaacaacctttagaaatatcattttatgtagctctaaaatagtccctctcatgccttgttcataaatttcttaaccattcactgttgtctgttatgtagggtttgtcttttccttttttttattataatgaagtagcaggctgtaaacttctattcacatgaaaaattactcttatttcagaatagatttctaaatgtagaattacttaagtgaatgattaaaatccctattgatgacctgcttttcaaaagtactctgccaatgtatgcacttagcaggagtctgtaagagaacatgtgttgctatacctagtatccgttacgattcacttataatttaagtcaacttcattcaggtatcatttttttggttcagttttccagaaaactctgtattgtaattttgcagaattgaaatatggtttatgttttattagagaaagagagatcaggtttagagataaaattgtaaggtttatcatcataccaggtgatagtaaaaacattcaggtataatttaatacaatcaagtgtacagttggtgaaagcataaccacaatcaaagtacagaatatttccacacccccagaaattctcttctgcctctttgaagtgagcctcccataccaataatgtactttctgtgattatagattaaatttgtcattcctagagttcatgtaaatgaaaccagacaatatgtacgtttttgtgtctggcttctttgagcattgtggttttgagatttatccaagttgttgagcgtatcagtagtttgcccctctttctcactgattagtattctattatatagacctactgcaatttgttgatccattcactagttgatggacacttgggctgtttccaggttggggctattatgaataaagcggctatgaacattcacgtgcgatgtttacatgaacatatatttttatttctttgggacagatatctatggctggaattgctagtctacatggcaattgtgtgctttgcttataagaatctgccagtctggtttccaaagtgattttacaagtttacatcctcaccatcaatgcatgagaattctagttgctcacattcttgtcaaaaattgatactgtcagccttttttatttttagccaatctaatagataggtagtactgtgtcctcctaggtttagtttgcatctccatgatggctaatgatgttgagcctcttttacatacttattgtctattgctataccatcttttgtgaaaagccgtattctgcatacagttcctttgttagatacatacattgcaaatattttttctctcaatttgtggcttgccttttcattttcttttgtccatcaaagatagaagttttaaatgtgatgaaatataatttatcaatttgtttttgtttttaatatcctattcaagaaaatttgcttagcccaagcttgcaaaaatttttaactatgttttcttttataagctttgttgttctatagttttcgtatgggttttctcctttattctgttaatgtgctgaactatattgattgattttcaaatgctaaacagtccttcggtgttgcattccagggataagctccgcttggtcaggaggtattttattaataggtactgctggattcaatatgacactcttttgttaaggaatttttaaaaatctatgccatgagggttattgttctacactgtccttgtaaaatttttgtctggctttggcatcagagtagtgctgacatcatgaagtaagttgacaagtgtcttctctatctgcttaagagtttgtgtagaattgctattatttactcctgaagtatttgattgaattaatcagttaggccatttggacctagagatttttattggaatctttttaataatgaatttaattcctttaatagatacagggattttctgatttttaatttttttattgatttgattttggtaatttaaatcttttaaggaacttattggtgttatctagttgaatccattggcacacactggttcattgtattagtccattctcacactgctataagtaactacctgtgaatgggtaatttatgaagaaaagaggtttaattgactcaaagttccagaggctgtacaggaagcatggctaggaggcctcaggaaacttacactgatggcagaaggctaaggggaagcaagcatgtcttacaaggtggaccaggagagagaacacgcgcgaggtggggaagtgccacgcactttcaacccatcgtatctcatgagaactcactcaccatcatgaaaaccaccattcatgaagaatggggaaaatctgctcccatgatccagtcaccttccaccaggtccctcccccaacattgaactacaattcaacatgagatttgggttgggacacagagccaaaccatatcattcataatattcccttattattattttttaagttttatttttattatactttaagttctgggatacatgtgcagaatgtgcaggtttgttacataggtatacatgtgcaatggtcgtttgctgcacccatcaacccatcatctaggttttaagccctgcatgcattaggtatttgtcctaatgatctccctcctcttgccccccaccacctgacaggccctggtgtgtgatgttcccctccctgcgtccatgtgttctcattgctcaactgccacttatgagtgagaacatgtggtgtttagttatctgttcttgtgttagtttgctgagaatgatggtttccagcttcatccatgtccctgtaaaggacatgaactcattcctttttatggctgcgtagtattccatggtgtgtatgtgccacattttctttttccagtctatcattgatgaacatttgggttggttccaagtctttgctattgtaaatagtgctgcattaaacatacatgtgtatacgtctttatagtagaatgatttataatcccttggatatatgcccagtaatgggattgctgggtcaaatggtatttctggttctagatccttgaggaattgccacactgtcttccacaatggttgaaccactttacactcccaccaacagtgtaaaagcattcctatttctccacgttctcgccagcatctgttgtttccagactttttaatgagtgccattttaactggcatgagatgacatctcattgtggttttgatttccatttctctaatgaccagtgatgatgaactttttttcataagtttgaactcccattcacaattgctacaaagagaataaaatacctaggaatacaacttataagggatgtgaaggacctcttcaaggagaactacaaaccactgctcaaggaaataagagaggacacaaacaaatagaaaagcattccatgctcatggatgggaaaaatcagtatcatgaaaatggccatactgttcaaagtaattcaaagattcaatgctattcccatcaagctaccattgactttcttcacagaagtagaaaatactactttaaatttcacatggacccaataaagagcccatatagccaagacaattctaagcaaaaagaataaagctggaggcatcacactacctgacctcaaactatgctacaaggctgcagtatccaaaacagcatggtactggtaccacaacagatgtatagaccaatggaacagaacggaggcctcagaaataatgccacacatctacaaccatctgatctttgacaaacctgacaaaaacaagcagtggagaaaggattccgtatttaataaatggtgctggtaaaactggctagccatatgcagaaaaaaagctggactccttccttacaccttacacaaaaattaactcaagatggcttaaagacttaaacataaaacctaaaaccataaaagccctagaagaaaacctaggcaataccactcaggacataggcatggacaaagacttcatgactaaaacaccaaagcaattgcaacaaaagccaaaattgacaaatgggatctaattaaactaaaatgtgtctacacagcaaaagaaactgtcatcagagtgaacaagcaacctacagaatgggagaaaatttttgcaatctatccatctgacaaaggtctaatatccagaatctacaaggaacttaaatttagaaggaaaaaaaaacccatcaaaaagtgggcaaaggatatgaacagacacttctcaaaagaagacattcatgtggccaatattcccttattatctgtagtgatgtcttgaattccatacctgatacatgggtaacttgtatcttctctctcttcctatttccttgatgataagctagaggattatcagttttattttggggttttatttagggtgctcaatatgtgtgctcaatactattcagtatgcttttaaaataatattccacttcacatataatctaagaatgtctacagtttttagtgtgatctctttccgttctttccaacttaaagtttgcttgtccatccatctgggtatttaaccatatttcatttgtattttcttctaatttttatagtattactgttcttattaaatttaatctgatgagaacttattttagttggtaatatgaaatgagtgtttaaacaattattttccctaatagttaatcaattgtgctaacatcttgtattgaatgtttttctttcctcataacagctttctctagcataataattttataatgtctaactttcttgaaaaattctagatagagaataaccattctagaaatcaatgtaataactacagaatagctttgtttgaaaactgtgtgcatttccagtatcctatttgtgacccaatttatctcatactttctttcatttgggtcttgaaatttgaaattgtcttgtgaatttttttaataacttttgtttaatgggtgacgaaagcattactcatgtgtggaggccatatgcttgtgcctttggagtattctgattccaccactcaccaaccatgaggcctacagcatgtgcttgaacttctgggaacatcagtctgcctctctgtaaaatgaagataagaggagtgggtacctcatagtgttgtggggattaagtgagagagtgcataaaaagattttagcacccaatatggtatgaagtgctcagtaaaaattagttgtctatattaatgtagatataaaatacatagatatgctagtctttgctctctccatttactcttcatcttctggtgtcatgtgaagagtaataactgtgtgaaaaaatatggggttagtttagatagaagagatatagaataacctagatccaaagatactttaaggttagatgtttaggatgaaaatcaggtatgcatgaagtagactgcaattatatttacaaaaacaggtaggtattattggaatgtatactttaagaagtctaaaataatgagcttatttatttactcttccttctttgcacttgacttcagttgagtggaattttttcaaacgttgctgtgaatagcaattgtctttggagagggactttttggaagtccctctccaaaagaaaggggatttgaagctatgtttttctaaatgtcccctttaaaagtctatcccagttggtcctaggcagtggtgtgctggcagtggctggcacaagctctcagtagctgatggttaagttttcatgaatgttctgagttggttctttagtttaatgaaaactaaattgtatcaacttttgattcaataagttggattaaaaacaaaggtgataaacaccccaaactggtcactttataattatttattttactggtatttatgctcttgaggttatttctgtctattgtgtctgtatggtggtatacttctcagctccacatttagtgatattgtgttggtatcttggaatcagccatggtggaagaatttattccatggaaataagcaagtgctattttctagacagccggttgtgaaaacattaaccagcacaccattaaccacaggtaaagcctcgccccttgctcaaaacatcattattcctctttctgcagtgacaacttacaccagacgtttacagaatgtattcatggattttctttgaactcctacacctgtgcttctgccattccagactttctatcattttttgtgtccagtaatgagtggacatttttttagttgaagtgaagggtcttattagctgtgattgacagacataattatgatctgcttaggaatggttaaaatgttggtacgaaataaccacttgatttcagcaatttgtacttatcaccttgtcacattttaaaactaaaattcttatttactttttagaccctgtgccatggtggcccctgacattgagctaatctgtgaaatcttgttagttgctgaaggttttgtggatgcgcgtgcattagcccgaaagttcattacgttgtacacgctttgcaaggagcttctctccaagcaggtgagggatcatttgttacgttttcttgtttttacataccattgaaaaagcttttgaagtatggattttaggtaatttatcattcaaattacattagacattaaaatttttttgtacttaaaaaaattcaatagtttgggggaacaggtgttttttggttacatggataagttctttagtggtaatttttgagatcttggtgcacctgaggagtgtacacagtacccagtgtgtagtcttttatccctcacccacctcccaccttttctcccaagtccctgtaggccattatatcattcttatgcctttgcatcctcatagcttagctcccacttataagtgagaacatacgatatttggctttccattcctgagttactttactagaataatggtctccacctccatccaggttgctgcaaatgccattatttcatgcctttttatgactgagtaatattccatggtgtatatataccacagtttctttatccactcattggctgatggacatttaggctagtccatatttttgcaattgcaaattgtgcttctataaataggcatgttcaagtgtctttttcatataatgactacttttcctctgggcagatacccagtagtgggattgctagatcaaatggagattcctttaaaaactaaaactaccatttcatttgacattagaaatatttttatattttctataaaattcgaaaaacttattttataatttttatttttttctgaaattttgagatattttagttctgatattttatttgtattaatacttttttaaatcaacgagctgtgtgattttctttgtcaattttgtaatcataaatggaattttatgttgcctccctttcttcgtgaaaatattattttctaataagatagggcaggagtgttcaaaagagtaagataaggctaattttctgaagagtatctcaaggaatgttaaaattattctcatttattggtaattctttatttaaaggtagggttgactggttttttgttcttttaaatttgtgctctacaatttccttgtctctaaaatgggtcagatttacatactctctactctccaatcataagcttcttgaagatctattgaagttgctgataagccacagaaattacatatatatcagcatcaatattttaaaattcagccatatgatcatttttgacttttggtcttttgataacatttcattaattactggtgacattattctgtagtcaaaatgaaagcatcagaataccacagttgcaaccacacagttaccttactgccacgtatttattttaacttgctcattgttagggcaaaatatggaatatgagagtgatttatgttgtccttttagtaactgtgaatttacattgggtgggtggaatcataatttttaacagttgtctctggatagtaagattatgggtgtttttatttttttccttattcttaaaatctttttttaatgagcctattttaattttatcatggtaacaagtcagaagaaaaaaatgtaatagagcccagggaatgtggagtttcaactatatctattttcagtagtaatatttaaacatttaatgagcatctagtataactaataatgtgctttttgctgaccatgttgaatgtgtaagattcaaaacaaatgaaacaaacacccagatttctgactttgaagaatttaggtaattcagtttacatgacataaaaattgggagacaatggagaatgaaaagattatcagagttttcaaggaagaaaggaaccaatatttattgaatgagtactatgtgttatgttacaaaactgtcaaaagaagtttacaaatttgattttattagccctgttttacatatgagaaaactgagcaaaacaacctgtcccaagtccatatagctaacaagggataagggcaagatttgacttcagttctaattctgtctaggacacacctgtagccaattacaagaggaaggtgttgggagtacaggtagaacaaagaaggaaagagtttgctaactcagaaatgtcacaaatgagcaaaaagaaatctggccaggacagaagagctgggttaggaacacaattcaaggataacttcctgtgctacagaaatgggtttgggaaaagaatcagcagacatttttgaccattggaatgatataatgaaaatggtgaagatacttttagctatttgcattgtttaaatgtttagcagaggcaccaagtcctctgaaatctgtggtccaaaatttcttctgcatccactccttttattgttactgcaataacttagccacctcccattgttgccctcaaagttcttattctcagaaacaccatttgacccagcaatcccctttctaggtatatacccaaagaattataaatcattctactataaagacacatgcacacatatgtttactgcagcactatttacagtagcaaagacttggaaccaacccaaatggccatcaatgatagactggatcaagaaaatatggtacatatacaccatggaatactatgcagccatgaaaaaggatgagttcatgtcctttgcagagacatggacgaggatggaaaccataattctcagcaaactaatacaggaataagaaaccaaacaccacatattctcactcataagtaggagttgaacagtgagaacatatgggcacaaggaggggaacatcacacactggagcctgttgggggtggagggctaggggagggatagcattagaagaaatacctaatgtagataacaggttgatgggtacagcaaaccaccatggtacgtgtatacctatgtaacaaatgtgcacattctgcacatgtgtcccgaaacttaaacaacaacaacaacaacaacaaaacctctggttctttcccctccctttcctcttcaagcctcagcctactccatcagtggctttcaaatgatcttttccatggcccacagtaaaaaataattcttctattgtgactcagtgcatacacacatgtacaactgaaccaaaaatttcaccaaacactttttacttttttttttttttttttgagacagtgcctcgctttgttacccaggctggagtacagtaatgtgatcatagctcaccacagcctcgaccttcctggctcaagcgatctttccatctcagcctcctaagtaaatgagactctaggcgtgcaccatcacgcccagctaatttttgtattttttgcaggagtggggtttccccctgttgcccaggctggtctggaactcctgggctgaagcaatctgcccgcctcagccttccaaagtgctgagatgacaggcatgagccaccacactcagccactttttgctctcatttgcatcacactgcagtgtttttcatttcgttcccttttattacagacaaaaatgatggtcgagacctactaaattgattttattatccactagtggagtaaatgggatatttgtaatgtaatattgttttaccgcccacaaaaaatttgtactcatattaattcactttactcctacaaccacttataaagtaggtgggtgcttttatctccctttttatagatgatgattctgaggctctgggaggtaaagtgtctttcccatagacacagctgagagacatttgagagatgggttgttactgtgtgggttgtagctggacggtgaaagagggccagtcccgtgtaagcagttagttcgttaggaatacctttactgagcaccgtgcaatgtgctagccccaagaagacagtgaatatatgggaaataagtttatcatgagaaaaagccagaagaaaaaatgtaattggtcccagggagcatggagttgcaattgtatccaatctcagaagtaatattctgagatcctctaagagctcagaccctgtgggaggagtcttcattagggataacgttgtagtctcaaaaacagataattgaattttaatgacatggtttttattatattatgtgctggcatctaggcagaagtatctgattaagaggtggagtaattggggccattagggatccaagtctggggagaagtagaataccagggcccttgatgaaaccagcacaggtggagaaatgtgcttctggttggaggtgaaaacggggaatttgctgagctactgagttagcaggtctgttgagagagtacagcaagggaggtggatggagccttaggcaaatactgcagttaagcgctatggaaagaagagacttgctgacagaggcaaaaaaaaaaaggtgaaagaaacaggacgacactacagggacatgattttcacagtttcaaagagcagaagaaaatagtattttgaatcattaaagtgtgtatttatctgaactccttcttaaaaactttcagctcttacctctggaatgagaatcttcttccctcatacaatttttgagaaaataaacctgttttgattttaggatcattacgactggggacttcgtgctattaagtctgtcttggttgtggctggatctctgaaacgaggagataaaaatagacccgaagatcaggtactgcaatgctaatatgattttgttgagtgagtagctggcctgcttcacagacatgaaagtatatgcctggatggtggggcatggacagcacaacttttaaaaagcataacatctgttgttaatgcaggaaatttgaggattggcgttccttataagaggtcacaagtggtcttgagtacaaagatatgaatctggaaaagaaaatgtgattttacaagtagttttgaaatagccacaaaaagtattttgacagtcataatcaaataattcagtaatcactgtttgatttcctctgaggaacatttaagaaatctgattgaattgggatattaatcctggaaagtcagcgaagacataatgggagaaagagcatccatttcatgggacctaagatggacatgcagaatgaaacaggaagggtgggtgcctgacaccaatgaaatgcgtgattggttggtcagagctactagagaaatgttctgctctccttcctggggagaaacgataacaacacttcatgaatttttcccttaagtagcgagagcaatggatatgtgttatcagtccattttcacactgttacaaagaactacctgagactgggaaatttataaagaggtttaactgactcacagttctacaggcttaacaggaagcatgactgggagaactcaggaaactgacaatcatggaggaaggcaaggggcaagcacggaccttcttcacatggtggcaggagagagagagaatgaaggggaaagtgccacacacttttaaaccatcggatctcgtgagaacagcaaggaggaaatccacccacttgatgatccaatcacctcccactaagccctcctctaatttgacatgagatttgggtggggacacaaatccaaaccatatcaatacatatcaccatgtgtatgtgcaatatgacttgggaaataacaacaacaacaacaaaaaacccaaaactttactctgtgtgattttttaaattgtgggatatttattacgtatttttgtacttttctttgccaatatttctctcttttcctcttaatttcctcgtaatttagtactaggtcaagattttctttcatttattttttctcttgctttttaaaatttttgttggaatgcttaactcctgctgtagaagttatcctgacgtttgagttactgcttttaaaatctttagcttacagccaagatagaacaacaacaacaaaactaaaaatgtttgagattatcattctaagattctcagagtactttggataaaatgatctgatgggcttgattaatttaaattctggagtttgaggattcaagagagaaggcccttagattgtttctgaagatcaaaacagatcattggcagggaaggaaaaggcctctttgctgttcttattctaaggattgttcattgtatcagttcagccttctcatgttctgatacatcaattttaaacatttaacctccctattgatagaatgccatcttaatggagaacagtaccaatatctcatgcttcacatatgaggagtaaaaataacaaacatctttagttttttaggtgtttgttagaccttgtattggcttttttataaaatgtttttttttctaggtactcatgagagcattaagggatttcaatatgcccaaaatagtgactgacgacatcccagtgtttctgggcctggtcggtgacctgtttccagccctggatgtgccccggaggaggaagctgcactttgaacagatggtcaggcagtctaccctggagctccgcctgcagcctgaagagagcttcatcctcaaagtaaaaggagcatttgcttttcatggcagctgttgggattgtcagtggaaataattgtggctaattgatactaaagcaagatgttaacttgtaccctaaccttaataggatcttaatatatgctttcaagcattttcatatggcaggattaagtaaacataagtaaacatttaagtagcccctctccgtaaggtgaaaacatagatatgattttcatggctttaaatgtaagcatgcttttaattaggttacaaaacttgttggttcttcgagacatgcactaaaaatttactttgttctttcctcctttttagagaacattggaagtaaaatcattagtgcctgcttttaatgagggaagaatgacaacatgtatgagaataacttaagtagatattatctgacatatcaaagcctcgtgcatatttttcaatttgaattcagtgaatgcatggatattgaacactatatacattatccattttagatattttataggatataaatcattagttgtagatagtgattggctatgtacagtgtttgttcaaaactcatgaagagttaatgatttttgtaagtaacccctgccatatactgagtactgcgtaaaatcgtgggttggctttagtctcagccctgtggtctacatgggagatccaggaaaaactatacttttcacttatggtctattttaactttctctgaacatactgttgtcagtgggggctggcttgggtgtaaggaaagaagaattgggcaaaaatggtagattatctttttgtcaccaactccttaaaggaaaccagcaaccagctgtttgctctgcaggttgtccagcttgaggaactgttggctgtgcggcactcggtctttgtagttggaaatgcaggcacaggaaagagtaaggtatagtaaattgcctaatagcttacagctatggaaagaacatttgttgtcattgtggttcggcctattttcaatgctactcaaaagaattcccctccatgaagcccaccataattttgggtcagaatctgagactggaatcttgctgcttgatcaattgacattcttttcctttatattgggtcagcggggggagaacaagaaacaaatagaggattgcattcacataggaaaagcaagccaacatgaagattgaactttccacgtgagatgttcagtatcagatgcaggcatttcgatatacaccatcctaccttatgcacctttcaatacatttatgcttggattcttttatcaaagataaacatattaagagactgtggaataagatatctggctggaagattggattggctctagccacatttatcaaacctattttcttttccaagtcatccttgattctcctccccatatcattcagaaaaacaaaccgaaatattttccttcagtactccctcagaaatataaccctctatatggccaaacaaaacctaaaaataaaaggaagtggcaaaacccacatttttgatgtacctattatgtgctgtgctaggtgcattatgtatgatttactcggcacaacaatgatatactatgggtattattatccccatttttagttcactgcttgattttgtttggtcttactgacagtcctggaaacatacttattttctcggttggcagacggtatatgcagaactgcatgcattttaattcaggatgcttgggtataaacatacttggtagccagcagctaaaaataatcagattgagcatatgagattttagaggatggcagtatatggaacttgccagtatttagatcagaacccaaagtggaacaactgtaagaaaaaaaatctctgtatagacatttttctagtgaaaaatataataaatgaaatattaaagtagataactgatagacctgtaattattttgttagagtaagttacagatgtaggccacagttcaaggaaggataaagttaaattctatactttccagtggattaatggtttctaaaaatataagcttaatattcctaaggcatttactttcttctagtcttcaccagttctgttctactcaacaggtacgtaacccgagatacccggaacactgcagctcagggtgacgttctttagcatcttatcatttcaaagtgtttgccaattgtttatcagtttttcacaacccttgtgagtaggtcagcatgataaatatctaagacaaaagccacagcttttcaaaggagcaaaagggagagttagggcagatatttgagttaaagtattaattaattgaatagacatacactgagcacctgttctgtgagttctcattatcaaggcttttcctcaattaccaggatcagggtttgtcaacctcagcactgttgacattctggactggataactctgctgtaggaggctatcctgctcattgaaagatatttagcaacctccctggtctctatccactggatgtccagaagctccttcccccttcttcccccaagtcaagacagtcttttcttgagaaccactgccctaagtctctaggtctcaaagcatggccagaccagcatcattggcattagctgggcccttgttggaactgtacattactggccccacctcagacctactgaaatagaagctctgggattgggctcagcaatctgtattttaataccctccaaacagttctgttgtaggctacattttgagaaaaaccaatcttgctgattcaggcagggtagattttgtaatcaacataaatgcttatttatgtatggtcctccactttgtacacatgattaaaaatctcaagtgagaaagtgactccctttagtctaaatggttcaaagagtcaagtgaactgattctgtcttgctgagtatttgtaagatgaagcttttcaagatggtaatgggaatgcacacatgtgcatttttccccttctcgatcttagcacacacacagcatctaggaacatataatgaatacggaaaactcttcagaaatcttttactttccatttggcttatgttagtattaatttttttggctctttcctccttcccctcagattttgagaacactgaaccgaacatatgttaacatgaaacagaagccggtttggaatgacttaaaccctaaagctgtgacaacagatgaactctttggtttcatacatcatgctacccgagaatggaaagatggcaagtagtatttcccctttagaagtgctcaattttttttttctatccagaaagccgtttttcagtacaagccaattttagtcatagtcgcagacttactgtttatgtgttggcattattggaaatatagcagatcacaacagcatttataatgtataaattaagactagatttgaataaatacttgatttgcattcagcagatttgtactcagagctgttgtattttatcccacgtcaattatgtcagggctccctgtaaatcaggagtgaagtcaacatgaatgcctcaggaaacatctataaagtacctgatatgaggcactgaagttcaggcagacattattccaggtgccagggacaaaagtcagtagggcatgttgcctgccctgagagtatttgtaagcaagcagatccctttgtgacaatctgttaagatttcctgttacagtaaatgcgctaaccttggcatcatccttgaggcctctctccctcttataccctacatccaacctcacagcgaatcctataggctttgcctttaaaatgtatgtgaattccagttcttctcgccttctccatagatgccacgttagttgaagctgccatcatgtctcgcctgtactacagcagcgtgtaatctcctcctgctggtttccctgcagttcatttgacctaaagcagacagaggggcttcaaatgttacttctttgcttttgatttctagtgggttccaatcacctttataatccaaccttttccatggcttataacgctctatgggattggatccctgcccccgtccccaaatcccaccatccctgacttcatttcccaccacttactataagccattcattctggcctctttgctattccttgaacttgctcccatcacggggcctcagcacctcatgttcctgccgtcggcaacactcttctggatgcccgcatgacttgctcccttatcttatttcagcatctggtgaaatgtcatatcagagaagacttccctgatggcagatctaaagtagaaatacaaatcaaaatcacaatgagatagaatctcataccagtcagaaagactattatgaaaaagtcaaatgatgatggtgaggctgtggagaaaagggaccgcttatagacttggtgggaaataagtttagtcactatggaaattagtttggagatttctcaaaaaatttaaaacggaactaccgtttgacccagcaatcccattactgggtatatacctaaaggaaaacaaattgttctaccaaaaagacacattcactcatatgttcactgcagcactattcacaatagcaaagacgtggaatcaacctaagtgcccattaatggtggattaaagaaaacatggtacatatacaccatggaatactatgtagccataaaaaaggacaacatcatgtttttttcagcaacatggatgtagctggagaccattatcctaagtgaattaatgctgaaacagaaaaccaaatactgcatattcttattcacaagtgggagctaaacattgggtacatgtggacataaagatgggagccattgacactgaggcctattagaggtgggagggaaggagagcagcaggggatgaaaaactacctgttggttactatgcttactacctggacgatggcaccatttgtatcccaaacctcaatgtcacacagtatacccatgcaacaaacctgcatgtgtatcatctgaacctaaaataaaagttgaaattttaaaaatagtaataataaagcaggacacccttcatcattctctatcctctcgtcttgtgtacactcctttttctgtgggacagtttttactgtctcagcctagcttctgtctttttgtaaagaactatggcagggagagaatcgtatctgtttaggctgaaaaactgtggaaactgttcaaatcagtgactattagaaaagtttgctggctgctatatgaattgtggtggcaagttccattagatactgtcacttttggcacaaaatacttcacagaagaaacattctagatatatgcatcaaaacagttttgctcacaatgctattagatttactagagcttgaaaaatttgcaactgttaaatatgtcacatcaaatacacagtgcttagatatgtagtaatggcaaaagggactgtagatttaaaatgtttttgcctatacatcttgttaaggaatgatgagttagtatcccagtgaacacatttctgtaagagatgtatggtgcttctgaatgctttagcttcagaattatgcccttgaaaattgttgtagaaaaatggagacaggtgaaataaacaaatatttgatctaaaatggatactgaacatatgtgtatgaagaaggatcatgtcttcagttggtgtaagttttgagttttaggtacgttaccttctataaatccccacaactgttcatgaaggaaggtttttgttatctctgtttggcatatgggaagctcagtcgtggaagttaagggtccttctcagtgaggtgaaacttacacgttggtaaataatagaggtgaatctggaacccatgtgtggctgaaaaggtgttacacactgcccgcaagaaagaggcagcaaaatcgtttttatttagttaataaaagagcttccaagatgaataatatcaatctatcgtagaaataaacagcactcaactacattatatattaggattgtttactcttattttataggtctcttctcatccattctacgagaacaagcaaatcttaagcatgatggaccaaaatggatagtcctggatggcgatattgaccccatgtggattgaatcactgaatactgtaatggatgataacaaggtgaataaaacctctgttctcaaccttaaatataacatcctgagtgtattaagagttcgattcacttgtcgatgttaatactagtttttgctcattaacctgggattctttatgtaattattattttgataagtgttgctttcctgataattttcttaatttcaccattaaagaatttcaaggaatatgttctctttgtttctttgaattcagccacctttactgagagttagatacagatctaagaatttagtttacagatcttaccactttctaagaggtagccgtaaattattgtatcttgtcatctttgattaagtataaatacttagacaatgaaagaacgggtttgtgccatatgatgattgaaattaactagttcctttggctatggattgagttaaaatgttttcccaagcttttttgccacagttaattcagcattcccagcaaaaacaaaaggtgacggtacaggtctgtgagatatcagtcaagcaacacagggtctgttgttggggtcagcagagagaaatcagtaatcatcattactccagagaagatttagtaaccaccttaaattaacagtaattactgcttactcaactgagacactgttcatcataaaatacaggtttgggatctttatacttgtgtaagtttctttggacaattgataattgtggtatttcagattctaaagaaaagtttatggtattcaggtcctttcatgtgattaatttttacaatacatgtcttatatttggcttagcaataaaaattactacaattatgtaaaggtcgacattcacaagtccatttaggtgagtttgttcaagggtcagtcaggtcatctcaggggtgagcttagatctttattcagactgcacttctgattcaggagagtgagcacacagcctgtgatacttctggtaggggaaagtacttgttgcttctggatgtttgcggcattgcttttgcccatgggtgacagtgtgctgctcactccaggtgctgaccctcgccagcaatgagcgcattgcactcactcccttcatgaggcttctgtttgagatacatcacttaaggagcgcaaccccggccactgtttccagagctggtattctgtatgtgaacccacaagatctgggctggaatccgtgagtatttctttttgttttattgtagtaaattgtatgtaacataacatttaccattttcataatttttgcttaagcacattcatgttgttgcacagctgtcaccaccatccatctctggaaggattttatcttcccaaagtgacactctttatccattaaacaataacacctcattctcccctcctcccagctcttggcaaccttcattctactttctatctctatgaattagactactctaggtaccgcatataaatggaatcatacagtgtttgtcttttagtgacaggtttatttcacttagcataatgtcttcagagtttatccacgtagcagcatattgtagtatttccttttttaaggctgaataatactccattatgtgtacataccacatttcgtttacccattcatctataaatgaacacttgggtttcttctaccttttggctattgtgaacaatgctgctgtaaacatgggtatacaaatatctcttcaagaccctgctttccattctttcgggtagaactcagaagaatttctagatcatatgttaattctaattttaattttttgagaaactgacacattgttttccacagctgctacccatttatattcccaccaacagtgtacaaggcttctaatctctctacacctgtgccggcacttgttattttccctttttctaacagtagccatgctaatgggcatgaggtgatacctcattttaatttgcatttccctgatgatcagtgatgttgaacatcttttcatgtgcttattggcagtttgtatgtcttctttggaaaaatgttcatgtaagttctttaagttctttgcccagtttttaatcggtgctttttaaaattgtgcctggatcttgttaaaatgttggtataaaattctaaatatctatatgctcacttgaaggtattagcagttacatttaaggctaactaattaggctaattaaaagttaattaacttagcactggaatgcctttgtcatttttacttggacattacctggttcacataccttgaagatgttaagaactcagtaaatatttgttgagtaagtgaataaacaatgaaagcttatatggaacacttacataaaaagaaatcacttaggttatgtatgtttgcatgtatgtatactatccatacatgaacagttgtaatgctttgatttagagcaactttatggtgcccagttgcttactcctcaaatgcttacattttctacagttcatcctggttgtaacttgtcacctccagcgtttgcacttcgaactgtaggagtcactgagctctgccagtgaacccatgcttgtgcctggcatgcttcttacatcagaaatcttctgtttacctctctggacacacactccatccttctcaccctcttctgtggtctgtatggaccacattagtgggctccttgccttccggcttctggttggtttggccaatgaagaatcctggcaggaagtgagagggagagaggacagtgaggtcaggctgtttattctccttcccaacagggtcatgtcaggatggctctgtccctctgtgactgcaggtcacagctcttcttatatctctccattaaggttctttccttccaggttctggcagtccttcgttctcttgtccctccaggcatagatacaatacccattccttgtgattacccttttggcatggtactgtcccttccatttcctctacttcttgcccacacttctgtgactagtccttttattgatccttcccttgttatcctgatttagggatgacattggtttcctgccagatgtctaactgatgtacttctccaggctgcctttcctgtgtgtactgacatgctcgctaaaagtctcattccttacctctacagtgtagtagagccatgcacaggcttttgcgttgacagagcctttattggatatgttttggggaaggagtgattttcaaaagtcttaaatggagtgtttttcttgggataataactcctttccacacctaggattctgtctcctgggatgcttctattggttgggagctacatgagggagtctctccagcagccctgactccctctgtacagagaacccaggcaccacagtgcgtggcagcattcatttccttcatgagacctcttacccctcctgggtgtgctctgatttcagcagtgaatctcacagctcccaaggcatatgtaattcagtctcagtcctatcctgtggagatttgtgctaacaaaagcttggtccaaatccctaaagaaggacttctatgcagtacatcaaaggtcacgggttggctaaagagacacccaatttatattcctaagagagttaaacaactctgtcttcaccattagattttacttttgggttttttgtttgtttgttttatccagaattaatgggtagatgttaattttcatatgtgtgaccaaataattcatccaggtcattttccaaaataatggaaatcttctctagaaggcgtttttgtattttcacctcccattgcaataaactttcaataagtcacgaaatggctattttagaataaagggtattttttcctctccatagttattggagactttaacatcttactttaatgtcattatattaacaaaatgatagctttatacgtattaattcatttaatactcagttaccttctgagatagacataattattaacccaattttccaagcgaatctcgtaagtctcagttttcaccagtgttttcttcagagtcaaaactttgaaataaagttcaaaactatagaaaagttggaaaggtagtacaatgcgcagccagagacgcttttcctgcaatcactaaccattttacctcatttactttctctctctctctttctctggcatagaggcacattttctacttttattaatttttgctgaaatatatgaaagtaagttggagacattaagacacgtcatccctaagtctgattacaaaagactagatacttctagatgactcttggaagccacaactttagatcatactctttcttctattacttgagcttaaaatattcttctggctttgtgtcactagtactttcacctgtatcaaatgaccttattgtcttctgtccctgcaatcccactgtctcatcttgggatactgtatatgcttacaaacatgcaacttcagaaataattggtatacactgctagtcagcatgtactgctaacgtctgccatttttccaggccacggtgaatgacagagaacttgaagcttgctctaagggtagacttagagtctgttcaattccttctatcctatacaacaggatccaaccccagaggcctgagtaataaataaaaagttttcagaggtctgagaactttggctactctagaaagtttagaaaccacgcggttatagacttcacttgataaacctggaacagttctgcaggaaggagaaacaactgagctgctgataggaggactcatttgcaaattctggaaagccacaattctctgttaatgacctgcatattgccattaagatgatacattggggcattacaatgtagccatttcctgaggtggggcaccaatgtgggtggtcttttctgtgggcaaggaaagaatatgccattttagtatgccattttcaattgtatgtaatataatagtagtcatgttccacatctatcacatcttttaaaaatcatagggaactttttatatgaagcagtgttgtaagaattgcacacaaatgcagctctgtggcttcagtgtttgctgaaggtaacagtttctccttctaaatttactgtcttttaatgtctattcctaaactatgtaagtttagcaataatttctacataaatttttaaactctccagcaacatagccatttttactctctatcctatgctatgtggtgtgattgatccctagtagaggtaatttatctgatttccccctcccacccccactttttttctctcaagcagaatcggctcttaccacatctcctggtttggttggactgacttttttctggagcacctctcacttgtggaagtaatttgtgcaaaagcatcatttgctagtgggatcggtagattttctctgagactttagttgctgctgatgtgactccatgaaaccgctattacctgcaccctaagtgcaaagcccacttcttccttctgggctatttttttgaagttactgctcctagtaatgcttgcaatggctttctgctcccacagaaacctggaagaaactttgttggaaagtggggtgtgggttttgttatatccaccagaatccaggatgccaactcttgtgcccaataggacgctactgcctttaggagaaacagagggagacggagccgcgatctaaacctgagtttccgaatgccaccaactctgtactaatgagtaacgtttattgagaatttatttgtcagatgctaatgtaagcactttatacatgcaaacttacataatcctcacaaccaccccaggaggttcatattattaccctctccatttacagaggagaaaattgaggcacagagaggttaagtaacttgcccaaggtaacacatttaaaaaatggtggaaccaagtagcatatccaggcagtttcactttagactttcctttccctgagcaatcctctttcacctcttcttgataagatctagatacaaagattccactttccactctggcagctgatatggggtaaaatcagtagttgagatggtggccttcattcctttgtccccaggcactgacacctgctttccattgttccgcggttcccactgtcgctaccacacagggacattctatcaggctactcttatgcaattggacttctgctgaaaaccatttctcttggacctgaaaaagttttgacagttgacattttataaatttcatcagagtgtaacataaccggctatttaataaactctattgtgaagccttgagaaaagtgaaaggagccgtttgtcagataatcatcttgccttaatgtctcctgatgctcaaaatgcaaggtgtagctgaaattgacctgtggtcatactccttctctgctggctgctaaatgtatttattccccatgcttcatccttagtgagaactttctgagggattatttttagtttaacatcatacatttttgccctgtagactactataggtgctactaagtcatgctttgttttactgataagtattattttactaatacattaaggatatttaatgtatcaaattgataacattttatgtttcagattacacacacacacacacacaccccagcacccaagcatgaaacgccatatcagagccacctattggaaactcgttagcagctatcagattggagttacattcagtccattgaaaaaggagacactttgaaatagcccctacggaattttcatctttttattcgtaactgatttcttattactaaataattgatgccaagattaatcaagaaaaatcacaagctgttttcataaataaggcctacactatgggaatagtttcagcccttcaggaaatgacatagtgcacttcctcataaatgctcggtaatggtctacttatattccattatgtttggcttctgagtgctattaggagtttcttttacagtcttttcattaaggtaaaatggccattaaaacaagtttttaaagggccattttaaaatatttgcagtttgaaaaatagaacgaactcactaaacgtgtccttgaagtgttgcaccaagctgtgtcaaaggaggaagcttttgacttggtgaaattctgcttttcaagcctagtgttcaataaaagcttttctgtgttccttttcaggtatgtggccagttggatagacagaaggcggcatcaatcagaaaaggccaatttgactattctttttgataaatatgtccctgcatgcttggataaactgagaacaagctttaaaaccatcacttcaattcctgagagtagcctggtgcaggtttgtcttcggttacgccatttaacgttctagttctgatgcggtagtgtttgttgatcaagacaacagaagatcttgccttgcccaagaaagtgagaagatttctggaattgttagattgctgcaaccctcttgcccccgcccccgtcccccatgttccctggatctttttgcaaacctctatcacattctgttagtgtttaagtttgtgctctccttcttttcacaatcttgtgaaagaaggttagaaccatgttttactgatttttttttagtatccccagatagctcttagcacatagtaggtgccagatatgtgtttgttgaatcactgtgttcctttccagtgtctttgcacagaattagaagaacaaagttgcaatagctttatttatttttctggttcctaagtaacttgcccagagaaggtgctcagtatgttttctaataaaacaaatttgtgcaattaaagatgccagccagtgagtaagagaaagcctctgaattctaccacctaggtgccaccactcacaggcctccccctcccaaaaatattcatggaggagtgtcagtctggatgaagagttcataatatcccagggatatattttttctcatcttcatcttgagacagctggtaagagtgagggttacacataatatgttgtcatggaagccaatgaaaataattcacaacacacagaaatgaaggctgtgatcttcatctcagcatgaagaaaaactatccccagcccttagaagtagaagacttcatgaaaaggtttacaattagaaacccccacaccctttttttgctataagagcaaaattgctttctaagtactttgttaccattaagtgagtgtgttaccaaatttgtttgacgcaaaattagaaatagtcacaagcataataagaagagaaagttcaggtttttggataattcgcacaccaattaaataaacgatagtcttcaacagtaattatctgaggtataatttatttccgaaagcaggtctgaatttgttcattatgaattaattatgtagttagcctaattagactccctctggtgtaatacttgcaaaaaagcattatcgtgttctttctcaagttcacttgtgtatttgtgtgattctctgtggtgtgaacttttccattcaagagtagtgtgaaaataggtcagtaggaattaatatgatttctgctctacttctttcttttgttgtattcagaaagggcatttaatttttagctccttttaagctgttgttttatagagtaatttctcttctgtggttactaataagtatggaaatttgagacaaaaatgggtataagaagatagtgacctgaaatggctatcttgagaaattaatgcactctgttttccgatatatgacgcctctttaagtttggtaaggtttattaactctttcagattactcattaaagtacgttaaatgctgacacagaactcaaaatatatttcaagtactgtgggagaaaatagaagaaacacatggccgtattcgtgtgttcatctcagcagatagcgtcacgttgagacccttcagtcttttttgttttgatttcaacagtgccttagaacaacatggcttctactaaaaaataacaaagcctcagagttttacactgtttttcttaatagcaaattggtgagtttttttctattaaaagattatttcaaattggcaaatgtggcacaacatgaaataatagaagccaagaaagaagattaaagaatataataggtgctcaataatttaaatgaaaagtatttccccatcttctgtggcaaggaaggaaaggcacacacacagtgctgacctgatctgtgatcgcttgcgttgctgtgtgtataatagagatgaaaatctatcgttgcctgcaaaaactgggggaagagtctcttgagtttttaggatctgtaacagtgctaattaatgacgactttctgtgctttagagagctagccccagaacctgttcattactggttattatttcacatggtgaaggcctctgcagcagccgcattcccctcattgctggcgcaactgccctaagcatgggctaggtacatgaggaccgcccagcacgttgccatttcacctggagagtatgaagaacacgttcctgagttcctgaacagcatttctttcaaggttaaatttagttcggtgtccaaaaaactgccacaggcttaagctgccagtccaacattctaaatttatgacaacgggtgggaaactggctgccaaagcgcttaccgaaagtggtttatctgaatgtccaacaagaaggaaatagtaaaataaatgcctcttcatccaatggaatcctctgcatccattccagtggtggtgtagagtaacacttattgataaggaaagatgtcttcagtttttaatcaaggaagtggattatagaatactatttagaaaatgatttcctatttataaaaaagtgaatatgtacccttttttttttttgcttatgtgtgattttggtttgtatactgattattaactggattgtttaaaattttgtttttaaaaaatagtttattacctagatcattttggttgaaagtgacaagttttctactgttaacttagacacccaaggtggtaatttttgtctctcccaatgtagcaaatcacagctgggaaaaactatgtactctcttaaggataaagtggagttgtaaaaatattctttgaacttcactattttaaaaaaatgttgccttatttgactatttctttttctttagactctatgtgttcttttggagtgcttgctgactcctgaaaatgtaccttctgacagcccaaaagaagtttatgaagtctattttgtatttgcttgtatctgggcttttggaggcaccctgctacaagatcaggtatgtttagaaatagtttacaggaccagtttccagttttgtgtgggacagggtcatggggaggttaaaacatgtgatctgtacctttttgttatgttatagatctatactgcttgccctgttctctcctaagtctatgcattctctgggtagtcccatccctgatggttctaaccccagctgacaatgccaaatccataccctccagcctggctgtgtcttctgaactgaaagttctgtgtttctggctgctctggggcctcgccttcagcatgctgttctacaagaagccccactcagtgtgcctgagacagatctcctcctctgccccatactccaacttgcccctgctcttccttcttttcttttgctcagtggtacattcttcccggtagctccagttaaaaacgtggaagacatcactcttcctgatttctgtgtcctgtgatctcagaccctttcagtttcacctgtgaaatagctgccaaccctattccctcttctccatccctgcagcctaaattcaggagcaaagcatctttagattgctctggttatcatagcgtcttagtagctcagatcgccataacaaaataccacaaattgggtgacttaagcaatagaaatttatttctcacagttctggggaccaaaagtccaagattatggtgtcagcatggttgagttccagcaaggactctcttcccacctttcagaccgccactttcccgctgtgtccccatgtgacagagagagaaagacatactggtttctcttttaatgaggacactaatcccatcatgaggaccctgtattcatgacatcatctaaatctaattatgtcccaaggccccaccaccaaatatcatcacactgtggggtagggcttcaaaatatggatttgggggtgggatgtgggaggggggatcacaattcggtttgtagcatttgataatcttcaaattggtctccctctctccagtccctcttacttctaaccagtctcacacactattcccaggatagtcatttgtgaaccatagtcaaccctgggtcaattcctttttcactgatcttttttttagctgaaagtgaaatattcatgcctgtacagattgcttgcatagcccttttgtgtcttctgatttcctgtgggaaaacacttgagacaaacatttgcaccagcacacagatcccacgaactgcttagacttaccaaagtgcaaagtgggaattattcaactttagaaatttgcagatctaattgccaccatgcacctctatgtgtaatttttctcatgtgatctttacaatggttcttcaaggtatcctcattgcacaaataaagtaaagctcagaggggcaaagtaacttgcccaaagtcacgctgatgggaaatggcaacatcaggattcccacccaagtgtgtctttctccaaaagccacaccttccatggtacctcagggcctctcatggttcatagtgcttctatgggtacccctgaatttttacattaaaaatagatagcacacattttccaggcttccttgctctttccaggtgtaaatggggcatttacattgaaaggcatcgcagccaagagtgacctatatttctgttggtttgttcactgtagatcagaaaataaatggttgatataatctgttggccagttccacttctcgccactaggttaccataactcatgcctattattataataatatagttggaattcacttggcctcctagatcttatttcagccattctcagaagccagattccttctgtaatttccaagtgctttctaaagattagcagccaatactgtgtgagagtcaagtgttcgtgtcagggacttcatgtggctttctcagaggcacggtttacaacatgtgtgggtttcttgttaatggaggccacatgcagacagaaggcaaccctccttctccaccaggtatttctttcaatatttacccttttctccctttctgggactgtaaaatcaggtgggatgttgatagcggacatcttccccctcctgctcataacccctcacctccctcccagctgaccctcttttaatctttccagtttccaaatgtatcagccttaccccctagttatataagctagaagctggatatcactggcaccttcccttcgctaattaatagtcaacatgagcagcaatagcagcttaacattttcaaaagggctctaactacagagcatttaaaacagaggctatgaggttggcaatatgcatgaaacagacacaataaatgttctcaggatagccacttggtagcttaacaaattgagtgtctaatatgtgtcagggaatgtgcttagagcttttcatagggcacctcatttactcttcaaaaactataaaactctatatggattggtacaactcttcttttacaaataaggaactgaagcttagaaaggtattttaatctgcttccaggcacaaagctaacccatgtctaagccaggttcaaacagcagcggactgactcaggacctatgttcttcagccattgcagccaacctccaaaacaagtttcaaatcaactttatctgaactcccataaactgccgtcatttctcacttggcttctgaagtagcctcctcactgggctttctatttctgcatttattctgataattcatcatccactcagcagtcagggtgattttttgaaatgcacgtgaaatcctatgatatactccagagttgaaaacacttgaatggctccttgttgcctttaagattacatttcaaattttaattctatttacaaggcctctgaatctagccctgcttagctctccctatttcttcctctgccacttcccccactcccccactcccccacccctccacccccagctacagggtccagtttcttgagcacaccaagttctttcataccacaggaactttgtacatgctggactcttccttaaacggcacttaaagatgccttccctgaacatccaattaaaataggttgcctctgttattctcacttacagcaaactttactttcaaggcaactgttgatgtctgcgtttgttggcttagcctcagctggacgacacatcttcatgttcctctcctctatgttccccataaactctgtgagaggagagactctgttggttttcttttctactttagaacagatgcgttttagttgaattaattaatgaatgaaagatttgtcaccaaaatcattttgcctatatgtagtggttaggtgaagcaaagtttgatatcaagtaaaagttaaatgtagtctgcctgcagagaatggtgtcacataagtaatatcatctgaactgtcctggctcaagaccaacttttgtagggtgaagaagtatcttctaccaccaatctgaaaataatttaaatgaacctaaagtcataactcatgcatggggtggtagaaggatgctctcagctggtttggaagatggtggggcaagctctccctgcaaacaccgatcacctccttctgcccagtttataggccataatccaatgacatagggacgtcaaagtaaaagcaagtttaaaaacttctatggggaaaaatcacggttgaagtcatagatagaaatgagattgctgaaagcagtagacacacacagtatttttaagagttcatcaaactcactattttaggtcatgctatggatataggagtcactgcgccaggtctcctgtggatataagaggtacagagccaggtcatcgtatgaatataggagtcgctgagccaggtcatcctatgaatataggaaacactgggccaggtcatctgtggatatgggagtaactgggccaggtcatcctatgaatataagagtcactgggccaggtcatcctatgaatataggagtcactgggccaggtcatcctgtggatgcatagaggtatcactggaccaggtcatcatgtggatatggcagtgactggaccagatcatcctagggatataggagtctctgggccagattatcctatggatataggagtcactgggccagatcatcctgtggacatgggcatcactgggacaggtcatcctgtagacatgggcatcactgggccaggtcatcctgtggatatagaagggtttttctagttgttgctcacagttgtccttttctttattttccaaccctaatctagcagtaaatggcttatatctatactgatattaaagcaagcacctcccagtaaagagagcctgttccttgccaatataaatctctctggaggctgaaagttgatccctatgcagttttcagctggaccccttagatttggtctggtgggaaaccaagcccatgcgtttatccattcctccatctctcatggcagggattcccagatttagaattccagagatcaacagagtttcagtaatgatgtgtaggaatggtatagagttgccagttgtttacttttctaagcaagagcatttatgaaaataactatcaccataattttataagggaaaaatattttatcattgaaagggccagagaagctataagctcagaacaaaggacagtatttaaatcaaataatgtcattaatttttaaaaagtacgccattcttatttttcccattttcccataaattgatgtgaacattggtagaagtgaacaccaccgttacaatagtgactacctagcataggaatttgcataatacgttgtcattagattgaataacgaacaggtaatctggcgttcacctaactttaccttgctttttaagttaattatttcacaaaatttgtgcttgatgggtatatggcaattttaggtttctacccctatgatattgttactcataatttgtttctttttttacagttttaattactttgagtctgcaataaggatttcttttgttctccttagatttctgattatcaagctgacttcagtcggtggtggcagaaagagatgaaagcagtgaaatttccgtcgcagggaacaatctttgattattatgtggaccacaaaactaagaaattattgccctgggctgacaaaattgcccagtttactatggatccagatgtgcctctgcaggtaggtgtgtggaacatagcaattgtattagtctgttttcatattgctataaaaaatacctgcaactgggtaatttataaagaaaagaggtttaattggctcatgattccacaggctgcccaggaagcatgatgctggcatctgctgagcttctgggaaggcctcagaaaatcacaggggaaggggaagcggacacttcacttggccaaaggggaaacaagagagagtgaggggggaggtgctgcacacttttaaatggccagatctcatgagaacaaattcactttcattagaatagtaccaagatggatggtgctaaaccatttatgagaaactgcccccatgacccaatcaccccacaccaggccccacctgcaacattgtggattacaattcaacatgagatttggtggggtcatagatccaaaccatatcaccgatattcaagtgaagtgtgctgatgtgatccctttttaaaaaaaaagtcttttttttttctttcttgcctgatgaataagttattgtgttaatatgctcagcatatgacatatatcactggcagagaagaatctcagctataagaatgcctagtgatggccaggcgcggtggttcatacctgtaatcccagcactttgggaggccgaggtgggcagatcacgaggtcaggagatcgaggccatcctggctaacacggtgaaaccccatctctactaaaaatacaaaaaattagccgggtgtggtggcgggcgcctgtagtcccagctactcgggagtctgaggcaggagagtcgcttgaacctgggaggcggaggtcgcggtgagccgagatcgcgccactgcactccagcctgggcgacagagcaagactctgtctcaaaaaaaaaaaaaaaaaaaaaaaaaaaaaaagaatgcttagtgagatgtctgttatatttctgcatcctcttttcttttttttttttttttgagatggagtctcgctctgtcgcccaggctggagtgcagtggcgcgatctcggctcaccgcaagatccacctccggggttcaagtgactctcctgcctcagactcccaagtagctggaactacaggtgcccgccaccacgcccggctaatgttttgtatttttagtagagacggggtttcaccgtgttagccaggatgatctcgatctcctgacctcgtgatccgcccacctcggcctcccagagtgctgggattacaggcgtgagccaccgtgcctggcctctgcatcctctttttaaaaaatataacaacttaattctgtaataactataaaatgtaaagaaataataatttttcctagaaagtttgtgagtttgtaaaaattgaaggcatatttctgttcagtgattgttatttctgaacttactgtaaacttcttagttagtacttttcacgtataacgttcttcttataccctccagctatcaaatgaatatgtttaatctcgtctattcacgtttcacagtcatgtgacagctaatgatccaaatgaacctttctctctttcttcactgtttcttttcatagattgctcttctgcatttcccttagattcaggtattctttgatcatcgtattctacctcaatgtgttttccttttcatattatttcttcctcaaaatcatgtcattctgactcattttggagcttattattttgggagtgctgtatgagtggcatataggtgatttctgtggcatttattaggaggcaattagtgccaaataacagaaagcccagtgcattcatttcctggagctgccataacaaaagaccaaagaccaggtggcacaaacaataaaaacgtgtttttctcaaagttctagaggctagaagtccaagatggagacactgaggggttttgtttctcctgcagcctttctcctcggtttgctgataggcatcgcttgccgtgacctcacatagccttttctctgtgcacattcatgctcactgtctccctgtgtgtctaaatttcctcttctcctaaggacaccagtcacattggataagggcctaatagcctcattttaacttaattatctcttttataagtcctattcccaaatacagccacattctgaggtatgaggggttaaggcttcaagagatgaattttggaggagacataattcagcctgtaacaatgtgccgccttgacccccaaaattcaagtcctgttaacatacaaaatacattcacccattccaacagcccacaattcttttttttttttttttttttttttttttttttttttttgagacagagtcttactctgttgcccaggctggagtgcagtggtgcaatcttggctcactgcaacctcagcctcccagcttcaagcaattctcctgcctcagcctcccgagtagatgggactacaggcaacccaccaccatgcccggctaatttttgtatttttagtagagacggggtttcaccatgttggccaggctggtcttgaactcctgacctcaagtgatgcacccaccttggcttcccaaagtgctaggattacaggcatgagccgccacgcccggcctaccaacagcccaaaattcttaacccattccagtatcaactctaagtcccaaatataatccaaatatcatctacatgatacatttcatctatcagttcatttcatgaattgaggtacaattcatcctgaggcaaaattcctctctagctgtgaacttacaaaaccagagaagttacctgcttgcaaaatacagtggtagaacaggcataggatagacctttctattccaaaagggagaaatcagaagaaaggggtcacaggtcccaagcaagtccaaaacttagcagagcaaattcctttagattcttaagacttcaaaataatcttctttggctcaatgccctgtaccggggcccactgggatgatggccctgcctctggacacactaaggcggcagtattgcccttgggggcagcagccctgtccctggggcactgggcggtagcatcctggctcagtgacagaagtggtgaccccatcccctgaaagtgagggggaaatagcctcatctccctgatctgtacctttcgggccggccagtggtggcagtggcagtagatgttctgctgatctgtgaattgcctttggagttactttcccttttcttggaggttaatacattatttgcagccaggttgctaaattgtcttgtcctgtagaatctaagaagtcttaccatccttcattttgtcctgtttccatcctctttaccccaagctggcaatatttctgctggtataaccccatctctatccctggcttcttctgaaatagctgattttgtctaagaattacacccctaatttctttatggagtcgttgtctggccacactttggtgttctctccagaatacactttctcatgttctgcgtatggacaagctgagaatttcccaaatctttaagttctagttcctttctgcttaacagttacttcttcagtatgtctttctcctctttcattttgctagcaataaggagaaactaggccacatcttcaacacttttcttagaaatctcctcagttaagtacttgagttagtcactcacaggttctatcttacacagaacactagaatgcaattcagccgtgttccttgccacattatgacaagaattgcttttctgccagtgtcaagtaacactgaggtctcaccagaaccatctgaggtctcaccagaagcctctttaatgtccatatttccaccaacagtctcttcaatgcaatctaggcattttcttgcctgcaccttaaaactattctatccttttgtcttaccctgttccaaagtcacttccacttttttaggtatctgttaccatagcagcccacttcttagaatcaaaatctgtattaaccatgatgagataccacctcacacctgttagaaagtctgttatcaaaaagacgaaagataacaagtgttgtcaacaaaaatgagaaaatggaacctttgcacactgttggtgaaaatatcagttagtatagccattatggaaaacagtatggaggttcctcaaattaaaaattgagctaccatatgatctagcaatcccacttctgggtatatatcctaaggaaacaaaattagtgagtcagagagatatctgcactcgcatgtttactgcagcactagtcacaatagccaagatatggagttaacctaagtgtccatcagtggatgaacagacaaagaaaatgaggttcatacacacaatggcatacaggttgagcatctctaattcagaaatctaaaattctccaaaattaaaaacttggaggactggcatgatgctcaaaggaaatgttcactggaatagtttgcatttcagattaggaatgctcaaccagtaagtataatgcaaatgtcccaaaacccccagaaattgaaatccaaaatacttgtggtcacaaacatttcagataagggatattcaacttgtacctttcagcctttaacaagaaggaaatcctgtcctttgcaacaacttggatgaacctggaggacattaagtaaaataaatcagacacagaaagacaaatactgcatgatttcactgacttgtgaaattttaaaagttgaactcatagaagcggagagtggaatggtggctaccaggggctggagttaggagactggggagatgttggtcaagggatacaaaatttcagttaggagaaataagttcaagagatctatcgtacatggtgactgtaattaataacaatgtgtagtattttttaaaaaccattaagagaaaaaattgtaagtattcttcccataaaaaataagcacatggggctgggtgcagtggctcacacctgtaatcccagcactttgggaggccaaggcaggttgatcacctgaggtcaggagttcgagaccaacctggccaacatggcgaaacccggtctctactaaaaatacaaaaaatagctaggtgtggtggtgtgcgcctataatcccagctactcgggaggctgaggcaggagaattgcttgaacctgggaggcagaggttgcagagagccgagagtgcgctattggactccatcctgggcaacaagagtgaaactgtctccgaaaaaaaaaaactatgtgaattgtaagcgtatgttaatttgctggatttagccattgtacaatatatacatatttcaaaacatcaggttatacacaataaatacatacaattttgtcagttaaaaattaacttttttaaaaaataaagcatattttagctctgtgatccaaaaaatttaattatagttgtaacctggagaaacccaactgcacatagaaagatgatcatggccatgttgttcctgacaacaaccaaaaaaaggaaaattgaaaaactaagttgtaatatatttgtagaatggaaatctacacagcagtaagaaaaattacctagacctagatacaccaatatcagcatatctcaaaagtataatgttgattgaaaaaagcaacgtacagaataatctctattttctgaaactggttgcataaatttacaaataaaagttcaaacaaaaaagcaaacctgtacagtagtccctcacttatccatggctttgctttctgaggttttggtttggtcaacattggtccaaaaatactcaatggaatattccaaagataagcaatttataagttaaattgcacactgatctgagtagcagaattaaatctcatgccgccccactttatcccaccgaggatggtaaccatcttcatccggctgtcttggtgaccaggtcgattgttgtgtactgcaatgcttgcgttcaagtaacccttattttacataataatgaccccaaagtgcaagagtagtgctgctgacagaattgttctattttactgttgttaatctcttagtgtacctaatttataaattaaactttatcacagatatataggtataggaaaaaacagtatatatggggttctgtaccgtctgtggtttcaggcattccctgggagccttggaacatacctcgcccaggttaaaggaggacaagtgtattagtttgctagggctgccataacaaaataccacagactgggcaacttcaaccacagaagtttcttttttcacagctctggaggctagcagtccaagttcaaggtgtcagcaagtttggcttctcctgaggcctcactcctcgtagccactttctctctgcatcctcacatggcttttctctgtgcatgtgtatccctgatatctccctgtgggttcaaattttcttataaggacacctatcagattgggttagggctcagtccaatggcttcattttaacttaatcacctctttaaagcccgtgtctccaaatacagtcccattctgaaataccggggttagggcttcacgacatgaatgttggggggacacaatattatcagcctgtaatattactccggtatgacttcatcctatctcattacatctgcagcacccctattcccaaataacatcacattctgaggtactgcagatgaggacttcaacatagaaatttgaggaggagacaattcaacccctaacaatgaggaaatttattatttcacaaacaaggaattcagaagtcgaataatcacaatgcagattaattctgtgacctggtggaatcaccaaggattgtgatcatcccatctttctatactgctcttcttaacattgacttcaatttaagacagccatccctttggtctcaagatgtctctagtggttccagaagacaacttcaaaggaggcagggactttctcatatctttttgttaagagtgaggaaacctttctcagaagcctggagctgactgcctcctgcatctaattctgcagactgggccatgtgccacctgtaacccagtctcaggcctgggcagtggggctgccatgatgggctttgatgattcctcacatcctgcaggagccaggcagagcttcccgtggagcacgtggctatgtgggggaggggtggggacttggacaaagtgggggctctcccagcaaagaagaagcagggaaggccaggtgcagtgactcaagcctgtaattgcagcgctttgggaggccgaggtgggtggatcacctgaggccaggaattcaagaccagcctagccaacattgtgaaacctcttctgtactaaaaatacaaaaaattagctgggtatggtggcaggcgcctgtaatttcagctacttgggaggctgaagcaggagaattgcttgaactcaggaggcagagtttgcagtgagctgagatcgtgccactgcactccagcctcagcaacaagagcgagactccatctcaaaaaaaaagaagcagggaaatgggggtcccaagagccaaaagtgcctgctccctccactttatgtatttggaaatcttgctttttgttcagtctgcctagaattcagctacctacaagtatgatctagctggttgaaggctgagaacctgttatcaaccaagactgctgaagacctgaaaactggtatcacaagattgatgcaccttagcgatgatatcttgtattcaacagagaacctatgaggagtttgtactctttctttccacacagttgtaccaaatgtgattatttaattaacagcatcttaatatagtagaagagaaccatagaaagtcaataataatagcaaatacaatattatgccattatatgtcaggccctttactgagtgctgtacgtaatgcaatccttacatcaaccttctaaggcagggactgtcgctagccttttttatatatatatacggagaaacaggcacaaaaagaagaaatatatccacagctatatgggtagtaagtataggatgaccaacagttctagtttgactggaattaaaggagttttgggaacattggactttgaattttaaaactgggaaatcctgagcaaactaacaagagttcgtcacactaaaacaagcaaagcaggattcacacccaggcagcctggctccagagtccgtgctctgaagagcattctatgtgtagataaaagagaggtcaggctctgtcagacttgggtttgaatcgaagtactgccacttactagtagctatgaccttgaccgagtcagttatgttctttaagctttagtttcatgacctctgaaataaaaataacaactctctttataggtttgttatgggtgtcttatgacattatacatgtaaagtgcttagcatggtacctgccacatactcatttccaagtaagtgtgaattattggtattaatatgtgggaaaggccagcagacaaatttaaaagcaaatgatgacaactagcagcaagaaagggaaaaaatatgagatgcagctcgaatattttttaaagagttgtctaggactgtttagcacagaacagtctgtcttttagtaagccctgagtatcactgaattaaaatgaagttctagagtaaatgttcagacatgaagatgatctagaattgtgtataaaatattcagttgagtcaaccatggtggctcacacctgtgatcctagccctttgggaggctgaggcaggtgatcacttcagcccaggagtttgagacgagtctgggcaacgtggcaaaatcccatctctacaaaaaatacaaaataattagctgggcatggtggtgcatgcctgtagtctcagctacttgggaggctgaggtgggagaataacctgagctcaggaagtcaaggctgcagttagccatcatcacgccactgcactccagcctgggtataggagtgagaccctgtctcaaaaaaaatagtcattcaaaaaactcacaatcaaccgggtgcagtggctcaagcctgtaatcccagcactttgggagcccgaggcgggtggatcacaaggtcaggagatcgagaccatctggctaacaaggtgaaaccccatctctactagaaataaaaaaaattagccgggcgtggtggtgcacacctgtagtcccaactactcaggaggctgaagtgggagaataacctaagctcaggaagtcgaggctgcagtgagccatgatcatgccactgcactccagcctgggtaatagagcaagacaccgtctcagaacaaacaaacaaaccaggctaaggcattggtcccgattttcatttgtgtgtggcttgacttcttgaacattttctcatctcctgaaatgttgtagatagtttcttatatggttactatattcccttctgtgcttaccccaatgttgggcagagagtaggtattttggaattaggagccttgggggctagtacttaatttggaaatgataaatcagttgtttactttatggtactttgatggcattatccaattgctctcctcaagctacaatgtctgaactctaaccattcaaaattgaaaataaggtggaatctctcctgttgggtgctaatctgaactatgaattatttggatttcaattataaagtgactgtgttgagtttgatataaaattttggaatgcctctctctcgcacgcactctctctctctttctgatctttgtctcattctgtttctcctcccagacagttctcgttcacacaacagagacagctcgtcttagatatttcatggagttgttgcttgagaaaggaaaacctctaatgctagtaggaaatgcaggagtgggaaaaacagtctttgtaggtgacacattggcaagtctctctgaggattacatagtatcccgtgtgcctttcaactactacacgacatccacagctctgcaaagtaagtgcacctgtttattttctagaaacaagggatcaaaaatcatcaaggcgggcacatgcagcccaaaagactaataatgcctttccctagaatttagagttgttgcttgggccttagatgaatttgtacttatcatccttgttaaatatacgttgtttaaatattgttgtgattttggctttttatgtcactcatggctttatttgggtgattatgctttagaacagcaagaatatacatcaatagtgttaatgtgttacctcgaaaccactggttgcttttaattgcatggagtcttaccaatataagggtatactcaaggagggatgttctggttactttttcaagtaaaagattaatttaggagaaattcattaaaactgtgttgagtaaatgacagagccaagagtcattaatgaaatcttaaaatcactagaactagttttgaactattgaataactaatcaacgtaatcaaaagaaccacacagatttggggcattcccagagttaggtagggtgagcaaaagagacatgggatgtagagaggaaatcaccgaaagagctgatgtcggaaggccagtcaatctccagcagggaaagggggctctgttggggggcaaccagactctctgatatccggttgtttattaaaactgttgagttgccttgaatgtgggctcctggggtatctgtttacatgtggatatatgttgtttccttagctatatcagtggagactaataataaatgttcttactcattgacatcattaacagccaatagtgatttttccgtcatcttttttgttaatcatttggtcttgtctttatgaatggaacccttagaaagccaactcaagccaggtgtggtggtacatgctggtaatcccagctactcaggaggctgaggtgggaggattgcttgagcccaggagtttgagtccagcccgggcaatgtattgagatacctgtcccccaaaaagagccaattatttcattcatctattcagaaaatacatattatttacctactttttcccaagcattgtgtagggtatgtttttcatttgcagatatgaaagaaagactctatgatttataaatggaagattaagctacagttcagtagttgaacaaattacctatgatgtgagtgcatcttgctatttcctaaaaggaatacaggcatgaatacgatttagagatggcctattagtgcgaggaatagaaagagctgtagttgtcagtatacttgtaaagagaattatgatttcaaacatttgagctggggcaacaaatgggcaaagaagattaggatagaaggaccagcttaagcaaagacatggaagagagagaattgtgggacacattcaatgaattgaatatgatgactgaagcatagtgattgggtgcaagatatggaaaaggctaagctactgatttggagttatactgcagatagggtgaccacctgtccagttcaccaaaagaccaaagtgttttctggaacatgggacttgtagttttaaaactgggacaatcccaggcaaccaccgatggttgatcacaccaactatagagaatgctgagatgcaaactgaggggactgtatttcatttgatggaaaatggtgaaccattgatagggaagcaaggaactgacaaggtgggcactgtcttttgagaagagagatctgagttggggagatcagtccccctgagtagtataagagctatatgtaatgtgaccctggaccagaattgtagaaaaggaggtggcaagttgggaacatatggaaatgacatgaagtaccatttataggctgtggttggacaaacatgggaccaggagagagagactactggaggctttgcatctgcctgactgggcatgttaaccccctaagcaggaccacaaaggcaaaaggaaagaggtgaattgcgagtgagggagagatgatgttaagctgagttggaaaagaggcagatttagtgttggctgaacgttggatggtaatggctagtaagaattaatgcccagcaagtgtttggaaatgtgggtctgcttcttggaaaaggtgtttatttatttatgattctttgttcattcattcatttatttgtttgctcatttaaaaaaagtacttattgtggccattgtcggtggtatagcaatgaatatgacatagttccttggtctcaaaatacttatagtctgtttggagagtcaacaagtaatcagatactacatctcagacacgcactgttctggattttcttcacccaggactttaaaaaaatagacacaaagtcatatagacacaggaagaaatgtaagtttatgtattcacggatagtgactaccttgtggatagtgtctacacacactgttcttgtgcctctgcactccagcggcctaagaagacaggtatgggagactttcctgagctgttctcagactcttccgcagagatgacagagaagagaactgagagaccaggccatagctggactagcagtggccacatagaatgggtacgggggaggaagtacgcagatcagcaattgggttgtttcagctgtgatgacaatgtgatgtcatgctgcacgtgctgcagtctccataaaaggtgaggtggaatgacttctggcaacaggagggagattggcaggagagcacgacacaaaaggaggggccagagacacatcccgggtctcttaacctatgaaggggcgatacctgaaaccacagggtggatgaaatcgacagaagaagttaagaacaagagaaaaatgactaaatgaacatttacattctgttgatgggtggacagaaatatatgtttatttcagaaattcttgagaaacccctagagaaaaaagctggtcataactatggtcctggaggaaataaaaaattgatttattttatcgacgacatgaacatgcctgaagtggacttatatggcaccgttcagcctcacaccctgatccggcagcatattgattatggacattggtaagcaagtctctgtagtttactctctcccaaaatctaataattattatggataataattactatggatgaataattattatgaataattattatggatgaattattatggatgaattcaagtgcaattatccccagtttcttctaaggaatatcttttgggtttgctttgtatctcttttcatcatattaagtgtaatagtttccctttgtatctttggaagattggattgaaaagtgtctcagaaatgttaagactgtccggaaatcatgtcctctttaagaattaactcacacttaattatttaagagaaatttgatcttgtttggcagggtgtaaatgtttgggcactgtagtctgcaatccctgacaattaactacagggacagcccccagcacatccatggagtcttgctatgggtacaagatagtttctacagagtaacatgagaatcaataagcagtaatagtttacattgacgcagctccagatcttgatttttgtcatcaaatgagctaagtcaacttcagttttttgagcttcagttttgatgtctctcaaataaggctcactaggtcaacctcacagagtgattatgaagataaggaggtaatctgcgatgaagacctttatgaactgttagattttgctcttttgtcatctccagtttttggatttaaggttctgttttctgtctttcaggtatgatagacagaaggtgatgcttaaagaaatccataactgccagtatgtcgcctgcatgaatccgatggtgggcagcttcaccatcaatcccaggctacaggtagggtgttgaatactgctctcaaaaactgtaggtctgtattgtattgttttcgagtacagcttaggattcctatgggacatcttgttaagcacgtttctcatggcagctgtactatattttattcccactaacaacagacaggggttctaataagcctttttgttttaattggtagactttattttttatatcaaagtttatagcaaaatcaactggcagtacaaataattcctatgtactctcttaatgcccccacttgttttaccctattattaacatcttgcattagttacaatgatcagccaatattgacacattattattaactaaagttcagagtttacatcgggattccttctttgtattatacgttccaggggcttttgacagacatataatgacaagtatcagctgttaacagtatcatatagaatagtgtcactgccccaaaatctctgtactctaccaattcattcctctctcttttccctctgagtccctggtaacaattgatcttttgtcttttcttttctattattattgttgtaaaatacatgttacaaaatttaccacattaaccatttcaagtgtacagttcagtaatattaactacatatgtaatgttgggcagccaagatcaccacccatctccataactcttttcatcttgtgaaactgaaactccacccactgagctcccctttttctcctccccactttcccctggcaaccaccattctactttctgtgtctatgattttgactattttaagtacctcatatacgtggaattatccagtatttgtctttttgtggctggcttatttcacttagcataatgtctagggttcatccagttacggcatattgcagaatttctttcctatgtaagaccgagtcatattctagtacatgtatttaccacattttccttagttattcattcgttgatggacacttgggttgcttccacactttagctaatgtgaataatgctgctgcgaacatggatgaacaaatgtatcttcaagaccctgcttttaattctttggggtgtacacccagcaatacaattgctgcatcatatcggaattctacttttaattttttgaggaatcatcatactgttttccatgacaactataccttattttattccctaccaatagtgcatcagggtcccagtttctctatatcctcacacatatttatttgctgttttgttttgttttttgacagtaatcatgctaatgagtgtgaggcagtatctcatagttatgatttgcattttcctaatgattagtgatgttttttatgtgcttattgttcatttttgtatcttcttcggagaaacgtctattcaagtcttgtgcttatgtttaaattgggttattttgttgtcattgagttataagaagcctcaatgtattctggatattaatcccttaggcactgatattttctctgtttctataaattttgccttttccagaatttcatatgatgagaatcatagggtgtgtagcctttccaaataggcttttttttccacgtagcttaactatgcatttaagatttctccatgtctttccgtggcttgatagtgcgtctgtttttattgctgaatagtggtcactgtatgaatgcatcacagcttgtttatccattcatctactgaaggacaccttggttgctttcacttttgacaattatgaaagaagctgctataaacatttgtttgcaggttttgtgtttgcgtagaagctttttaatcatgacaacagcaacagctacccccagcatacattcagtagcatacagtggttgcttacgcatctggactcagctgagactgagctcagtgactgctgatcttggctgggctcatctgtgcatgttggggataaactgtcagttaatttgatgtggctttggctggagtgactgtgacaacatgaccctgctttatgtgtccctcatactttagggcctgcagagtttatggcaaagtcagaggcttaacaaagtaaggagaaatatacacctctgacaacgagtggcacactgtcacttccacctcattctgttggcttaagtaaatcacatggccaaccccagagtcagagtggagcactaaaaagctacatggtaatgggcctggatacagggaggagtgaaaaaaaatcaggtctttgcaattttctggtacaattgtaatccttacactcttatatttgcttttcttttcagagacatttcacagtgtttgcattcaattttccatctttggatgcactaaacaccatctatggccaaatctttagcttccatttccaacagcaagcatttgctccatcaattctcaggagtggccccactttgatccaggcaacaatagcattccatcagacaatgatgtgtaactttttacccacggctattaaattccactacatctttaatctgagagatttatcaaacgtcttccaggtaccttgactgctctatgttatgcctcttgagtagagaaataatgataatactatgtattagcccattttttatgtcactatagagaaacacctgaggctaggtaatttataaagaaaagaggtttaattggcttatggttctgcaggctgtgctagcatggccccagcatctgcttctggtgagggcctcaggagctgacaatcgtggtagaaggtgatggggagccagcatttcacattttgcatggcaagagcaggagcaagagagggagtggaggcaggtccccaaacttttaaacaaccagatcttgcatgaactaactgagtgagaattcacttattacggaggggatggtgctaaccattgatgaaggatctgcccccatgatccagtcacctcccaccaggccccacctccaacactgggaatcgcatttcaacctgagatttggagggggcacacatccaaaccattaccatactgttaacggtgttcctttataaaacagcttaaaactatgctatatacttttgtatgtattctttaactttactcataaacttctcaggaagtaagtatggcaggtttattatttccatttcatcaatgagaacggtgcttctcctcaggtcatataatgtctttgtctgcgcttccgtgacaaaatacccgagattgggtaattcataaataatagaattttatttctcacagttctggaggctgggaagtccatgattaaggcactggcagattcagtgtctggtgagggcctggtctctgcttccaaaatggtgccttaagtggtgcatcctcacagggcagaaaggacagagcaaatcgggcaaatgcccagcacccctttcattagatcacgttgccctcatgacagtcacctcctaaaggcctcacctcttaatattgttacatgggcaattaagtttcaagacatgaattgtaggggccgttcaggccatggcatatggtgacttggcagtggaagcaaaggtagatgtctgggctctttagattgagtgagtgagtgcttactgttttgagtgccaagtaagaaggataaatgatcatgtgtttgcataaggcacttatgtgtgattttaaacatatatgaagagaaatagcaacttttaaatagttggatcattttggtttaatattgaaaattaccttgcttacctggtaaaaggacagtgtttatgtatttgacttaggaaattctgaaggggaaattgaaagtctggaattatttttttaaatccgactaatgtggtctaccctgtacagtaaaaatggatggctgaaatttcttttgtgacagaggtggtatattgatgaaatacgaaaactccataggacctctttatatttttgtaaccgtcttttcagtatcactccacaactgcctcaaaaccataacacagcattaggcagtagcttcttatgaacacggagcaattcttttcgtgtctgtgtatctagctcctgccagaaagattgcttaataccgtgctgtttaaaagcagaattttaatctcagaaggaaagggaagagaggtcataggtgaaatgggacgagaggactgcctgctcacccttcatatcctgcctgtcagctgcacctgacactaccaaataattttttagccttttgcagctcagttctccacaactcccttactgttctcctgtgcatccagagtaagctgcctctctccatgaggagtgagtgcgtgtgaatctaagatactgaaagcaccatgagtgagcaagggagtcacaatgtgttggtgctagacccacatctacccatgaagtatgagtctgggcactttactcttggtcttgtattcttcatctgtgaaatgattagactgatatcaagtgattttatagtaaaaaaaatatgattctgtgactttcatgttagctgtttgtactctggttttgtaaacttagtccattgtaaggcttaataggctcaagtactcagatgtgatatttagtgcctgtgctggcacttgaaatggtcttactcgcatacctaaaaatgggtataagcatactaaaattttaaaatattgcacttatcaaagagtaaacctacttttatacacgaacacgcacattactattgatgatatttcttttaaccatttgctaagttcacattttagtttaaaaagtgttaaactcatttgacatgtcatcagcctctgaattaaaggtattttccccattcttgccttgtaggggattttatttgcttctcctgagtgtttaaaaggtccacttgatttaatacatctgtggcttcatgaatctgcccgtgtttatggagacaaactgatagacaaaaaagattgtgatttgtttcagagaagaatgctggaaactgcttataaatattttgaagtaagcgtatgaatgtcagaggtcactacttactccaacaccaactgggtattgggactaaagttagatgagggtatgagagaagtgcacaagggcttacctttttgcaatggctgtgaatccagaatacacttggtctatgcttgggaacattccacccacctacccatgtgtgggtctgcaagcttttcccttgctaggccatgctgcctgcagctggacctctatggatggttgacatgccatatttttctctttctcatcctgcagggtatagatagtcacatgctgcttcaacagcccctcatttattgccactttgctgatagagggaaggacccacattacatgccagtgaaggactgggaagtgctgaagacgattcttacagaaacgttagacaactacaatgaactaaatgctgccatgcacctagttttgtttgaagatgccatgcaacatgtgtgagttaactagtcacgatgcttttccacaaaaggaagaatggctggatatccactactgtcatttttcaatagatcatactaagcactctgaaccatcagttcttatctgctgtttgacatataattttaaaatataaaagggtcgctttttaatgtcacaatcttaataatgtcttacataggcacactgttttccgagatgccatcatatccattattttacttgaatattaagaaagtggaaacataaattacttgttcaaagtcacatagttcataagggacaaaggactaattttcattgattaagcaggttttgttgagtgccagataggaacattgccagcctttcagcaattttgtgcaaattctttaaaatgggggagggctcatgctttcttggcagaaaattagaaaaaggcatctgtccttggatagagcatggctgacaaggttctcgctcacctcctagacctggtacctcatgtagtgcacagactgtgcaaccatctgcagccctcctatgggacattgttctaggtgctgagatacagcagcagtgaacacaatccagtcccctctgtagttgagcttacatgttagcgacgaaaatggacatttataaggacatgaacaactaaacaagagaataagcaagaaaaatatcagaaagtgatgtgtcatgccaagaaggaaaataggttgattctgtgagaaatacaataagtgaatttccaaagagggactgggcatccctgtgaagaggtgacatttaaagcgagacctgaatgataagtaggtgctaagcatggaaagatctggaggaagaacattctagacagagagcagattgcatctgaccctaaggcaagaatgtttgagatacagaaaagaagatcagttaggctgcagcatagagaaaaatataacaaaaatggagaggcaggaactggccttaccaatacgaagtatttccttgtaaccagaataaggaactttgattttattctaagtgcagtgagaagtggttggatgggttttaccctggggatgacacagttcattgtgtctgggctaaacagcttaacattgccactgctgtgtagaaagttgatcacatgtttacatccgatactgctctcctagtccaagtcaccttcatctgtcattgacaccagcaggaagacttcaataagtgacaacagccaaagacttaaacagaaaaagaaaaaagaaatcattgaaaacaagaagaggctgagtgtggtggctcacacctgtaatcccagcactttgggaggctgaggcaggaggatcacttgaggccagaagtttgagacctgtctgggtgacatagtgggaccccatctctacaatttttttttaatgagctgggtgtggtggtatgtgcctgtagtctcagccacacagaaggctgaggagggaggactgctagagcccaggagttcgaggttgcagtgggctaggattatgccactgcactctagcctaagcaacagagtgagaccctgtctctcaaaaataaaagacaagaagaaggaaaaatccagagaaaataagatgtggagaattcagtttttagaagaattaatctttaaaattttcttaggccctagaacctacaaaaattgtagagcccttcctgtcaccacaactaactgttggtagttttattgatccctttgcagttgtgatccttcctctgattgtgcaaaggaagtttcagttggaatctaaaaccatggtgttaaatcaactattagtaatgctgtctcgggttgggttaatatacagtcattgtgtatgggcgtcctggctgaggtgaaacagaaacctcccattgatactgaggaaaagagttttcccatataatccctcaatacagaattttcagtggcctaaaaggtaaggctgtttctttgatcagggattatgagctagaagctgatttactcagcattagaggtgatttcagagcgtgtccttgagtgttatagaaagggactttgccacttagtgaatcttgtgaggttaaaagcctcaaagcatacattaaaatgaaatgaaaaccctgttttatagcttggggtatctctcatgtcagagtaattttatagctttccccaaggttgttttgttgtgtggtcatgtgaagtaaaatttaatgtgatgactgagcttgtaaaaataacctatcttctctgttactggaggttttcagaaaatgttcacatgtgctggtcctaatataagtgatcccaacttagttttttcaaaaagcactatttaaaacaatttatgcagtttgttcaggttctgaagtttaagttcatttcagaaaagcaccctagagcaaaatgatggcatcaaatttggggtgttttactatctacatgcctatattttgttttgttggttttcttaatatttataacataattatgaactatttcttcaaacccatcttttgctaaagttaaagcgagtttatttatagctgtaaaatatagcataatataaatagattaagcattcagaatgccttggatattatagaacaagggattagttggccttggtggaaatttaactttgtgttactgaatggcttcagcaaattattctacaatggtgtagttacaagggaaggctttagtgtgaaggaagcaagaatcacattaagaaacaagtgcttgatttgctgagtaaatcacacagagagatctgttggtctaaacaaatccattctttccaaaataattctacagcaaagatttctggcacaaggctattccccctttgatgtcctcatacttgggtgctgatgtggaattcggatctttcttgctaatcaaaatattttgaagcccttaacacaaggcctttgcatatattttctttttggacttttggtggtgacaacaaagctctaagagaatccaaagtgttattagcagaggatgatttgtcttgggagcagttcaagggttagggtgaaggtagcgtctttgtttgatggggaaacaaatgaacaaggactagaggtttccagtaaaaactggaatttagtctctcactatactatttatctaaagaataaacaaaacagacccaggccaggcgcagttgctcatgcctgtaatcccagcactttgggaggccaaggcgggtggatcacttgagatcaggagttcaagaccagcctggccaacatagtgaaaccccgtctctactaaaaatacaaaaatcagctgggcatggtggtgagtgcccgtaatccaactacttgggaggttgaggcaggagaatcacttgaatctgaatccgggaggcggaggctgcaatgagccaagatcgcgccactgcactccggcctgggcaacagagcaagtctccatctcaaaagcaaataaataaataaaaataaacagaacagacatagtcccggggcattttcgattttgtgccataatgggcgcttcctttcctcaggtgtcgcatcagccggatcttacgaacccctcagggctgtgctctcttggttggagttgggggcagtggcaagcagagcttgtccaggctggcagcttaccttcgtggccttgaggtctttcagatcactctgaccgagggctatggaatccaggaacttcgggtgagtcaaggggacaggcagttcttctgacccttctgcttggcagataaagccgaggctcctagtgcgcccgtgtgggctgtgactcccagatttggccaaggcctccccaaccacgggagagcgggagctctttaaagcagtaattgacctttggcggttttgcctttatggtcaaattagtaataataaatttctacaagttttgtgtaggtttaataacatgtaaacctggctcagaaaatatttacttaaacacttgcttacacaaatgtctttctgttttctattaatcaaacctgatgcgtattgctgttagtgttcctgtatgataggttggggaaaaaagacactaacttcacaagtaaaaatagatttcttccacattggataagaacaggagaagaagatgcaagaggaataacacgtttaggaaactctcgtgtgtttttcaagctttgctttttaataacaatagtacttacaaaatagtacctacaatttgtgccaagtgatattttaagttttaaaaaatcacatatttttaatattactaatgaaataaacccgttttcgaaaaaataggacagttgttaaaatgagcaggcttctttttacggccctgcctgaaaaaggcgtcgctgaattcacttgtacacagtgagaagggagttggtgatctgtagcctgttttcatccctctgctccagtaagccagaaacacgacactcaaccttacgagtcagcaatggaggtggtgtcacagtgctgtcccctagaatggggtctctcagagaaggaatatgtaaaccagggaaaggcaccccacagtgctatggcgatacagttactgagttctccccagcactcacacacaacctctcaacgccgcatcagcattttaacaaaacatgagtgatggcctttccttacaggtagatcttgccaatttgtacatccgaactggagccaagaacatgcccactgtgttcctgctgacagatgcccaggttctagatgagagcttcctcgtgctgattaatgacttgctggcatcaggtgattaaaccaacacatttcttgaaagatcttccccaatgacaaattatctgtagtttcagtgaactttaaagagagagaattcgtctttgagatgtttgctgggcagtctttggggagaaacctataaacctaactaatttgaggtgtattgctttcttagtctgtttatggatgagaaggccttcagtgaagtaaatgttattcttacacgtacgggtgtagagggtgtgttcaccatggctcgtcttcaacgtgttgtatgtctcgtaaataaaaaagaaacatgacgtttctgattttaaactcttaccatttatgctgaactttgtcttgtaaaacatttcaaacgtttaaaagttatatgtaaaatttaaattgcaatgatcttttagtaattctactcattctttggggcaggagaaatcccagatctgttcagcgatgaagatgtggacaagataatttctggaattcataatgaagttcatgctctgggcatggtagactccagggaaaactgttggaaattctttatggccagggtgcgactacagctcaaagtaagaaatacttgcttaatttgcatgttagttaaaacctgctattgcaactctctggttctattctgagttttttattatgagtttgaatttcagtcatgcattttgaaaggacgtgtgcatttttacacgcctgtatctggagcgtaccttcctaaagtgtcccatgatgctgggctcctgcaaagcattgctgagcggtgtgtgcagtcctcagctgaagtgcatgtggtctgtgccattgaggaacttacactattgtagaacacaggagacatcacaaataattatcatacagtataaatataaacagtgctgtgggattgcagaggagcgcagcatccttcctcactggagctggtcatcctggaggaaatgatgggccacgtgtttagcatggagaagaattcaaggggaggaactttcagggacgggaaatggcatttatataaaggtcaactgcacggtacggatttgcagaaacccagattacctctaaaggcctggaacatagagttcttatagggagagtgagatcagtaaatctggaaaagtaaattggaagagataagaggtttctaaatcatgaagtgagtagtgaggagagttttgaattaagaaagtgatgatgatgtcagtgacttcagggaaaggaatttagaagtaacactcagatgggccgggtgcagtggctcacacctgtaatcccagcactttaggaagccatggtgggtggatcacctgaggtcaggagttcaagaccaacctggccaacatgatgaaaccccatctctactaaaaacacaaaaattagccaggcttggtggcatgtgcctgtaatcccagctacttgggtggctgaggcaggagaatcacttgaacccaggaggcagaggttgcagtgagccaagatcgcgccattgtactccagcctgggtgacagagtgacactctgtctcaaaaaacaaaagaagtaatgctcagatgttctgaaggattaccccagtgttcttcctcattggctgctctgtgctatagtgtatcacataggcagataatataaccagataatagatcagtaaaggtcaagtatcacaagaaaacagggagagcctccaaactcatcaggaagccaatttaagaatgctgctagggaaaattcaggctttctagtatggaaactaggaaagctgctactttactgttgcttctcatattgttatgcctgtcaagttagtggcaggctgcggcggctatagagctggagtatttaaggataggagacgggtactggcattggccctgaatatgccttagattggaggttaaggagcagagtcattaagtttctccaacattctgctatttcaagtttcacgttaatcttactgagcaattctaggttagaaggttagaacttaagattcagttgcccaaagagctttttctccatcaaaaataggactaagaatacatttgtcaggtagtaacaaggccagggatttcttcctgttccatggtgatatactaggatcaaattttctttatagaatgggaaaacaagtacagtgttagaatttgaggtagtaatagtataaatcaatgattatcgtaatctgttgctcagagctgcagaatcaacatcaacaagcaactttttaaaaatgcattttctccaactccaagccagacctcctgaagcagaaactttgggtggccccagaaatctgtcttaacaaggcctccaagtgattcagaggcatgatgaaatttaagagccattgttataaatagtgctagaatgagcattgtttgtgtatatctttcatgctcaactttgcttgcttctacaggataaattcctagaatggatattgctagattcagtagttacagcttgtggtagttttaaaacatgccttcaaatttttagatgctcttcttacttacaggtgacatctagatcccctcttcttgaatttgggtgggtagcttgtgactgcttcagctaatatccagtatggcagaggtgatgctgagcaacaactaaggctgagtcataaagggctcacttttctattggattgtacatatttttgtaagagttctatgtatttaggcaattattcttatatatgtgtctcatgtatatttttcctattcttttgtttgtcttttaaatgtacttatggcacatgtttgtttataggtctgtaactttccaattttttaaaggtttacatgttaatcagtgttttccttaatggatcctcagatccatttcttgtaaatttagaaaagtattttactcttcaagataatcttttttattttttatttttatttatttacttatttatcttttgagacagagtttcactcttgttgcccaggctggaatgcaatggcatgatctgagctcactgcagcctctgcctcctgggttcaagcaattcttctgcctcagcctcctgagtagctgggattacgggtgcctgccaccacacttggctaattttttgtatttttagtagagacggggtttcaccatgttggccaggctggtcttgaactcgtggcctcatgtccacccgccttggcctcctaaagtgctgggattacaggcatgagcaagataatctttactagaagcagtcggaactcaaattgagctacagtaagagaaaactcaacagtttcttaaagcctctcacaatagcaagtccagactggctcagtattacccttagaggccctttagaagagatgcttgtctcatctttcccttctgcctgctttcatcgtgatgcctcttgcctcctgatcacaggtgggtgcagtatgttcatgttccaggcagggggaaggaaggggaagaggacctggagactctgtaccaggaaacctaagctcctcccccaaaccctaagctcatgtcttactggccgcaaatgcttcccatgctgcctccggctactaaggagtctgagggagtaaatatttaatttggggacattgcctttatgagtacaatttgaaatggattttggaatagttttaaaaaggagcagtatcagtcattccagtgcctatgtgctttcatgctctttaaaacttttctacctctgaaatacattttttattaaatacggtaaagtgtgagctgagaggtttcaggttatttttcccaaaaagatgtcttcttgtctaaacaacatgtatttcttccttatcagcttcaaataccatctttagtgtatgtccaatagccatattaattgtgtctgtttctaaattctctgttctcttttcttgttaactgtctgctactgatttcagcattgcactataaattagtaaagctttatcatttattttcatttccaattgctctttcttgttaagctttttctacttattctcctgtgtttatatgtttggataaggattagcatcattttgtcaaattctaaacacactccatgtcaattttgatcgaaatcatgctgaatgcttattttatattagaatttaatcttcagggtacaatgtcttttattgcttttatagaaggatttcgtaaagttttgtaacggtgtattatttgtatataggagagctgttgatttttaactttataaacagctaccttactgtctctcttatagtttataatagttggttgatatcatatagcctgcaggtaaagatattttgtctctcctgttattctgtttttctgttctcctccctcattgcattggtaaatattacagaacattaaataattttgataatagtaggaattctgtcttgattcttactttaatggggatgtgtctaatgtttcactgttaggtcttatgttggcttttgattcagaatatgtatcttgtcaaagaagtatctacctagtaaattcattttcaggatctattgagatatgtatatgtttttctcccttggacttactaatattcatataatacagaatgatatacagaagttttacatttttatatttttatatccatcagcctttttctttgtttcctttgggtctgtgtgtaggcagaccttactgaaactgagatcagttttatattcatctctattgttgtctaatcctttttatggtctcattttttatttaactcaatacaagatggaatttatttttgagttagatgtggataatttccccccccaccccatcatcacaggactattaattgaatgacctgtctcttccctactaaaatgagtaggaagttggttttttttgtttttgttttgtgctgttttgtttttaacatcaagtagaaataggatatctctgtcagaagggatcccacttctgatcccctttggccttgtcactcagtttgatccaccctgtggaaggctaatggtcagcaccatgacctctttaccttgagggagaaatattacggtaaaaaatgggcagtcttttagcctgaaaataccagcttctttcttttaatttatgtatgttacccccacatccttggaattttaaagaattccaaattgctctatgttattttcagatatcatgatattcaccagtgtgtactaaagactcagaatttctgatgagctgatatctcctttgcataagttccaaaccaggcatcatggaaagcttaatgtgttacagggggttggtgaacacacctggcaggtcgagctaaatgatgtgaagttgccaccccattacccatgctcaccgcccaaagtcagttcccacttggaatgcagagacaatgagaacctgttggcatgcaaaatgtgacctctgaatgccagagggcagttcccattaacaaccatcagatgtgtgtccttggattgcctcaaataaggcaatgaatagcaatgccaaatgccttctctccttcacatttgtctatatgcatcttttcccacacagttctcatcttgcagctcgaatatagaactttcatctcctctccagtggaccttagttcacccaataatttttctttcttactttccttcctggccatatgatgctgtagggcaaaggacacttgatttatgtagcagcccctgattccatcccaagattttagatatttgcctcattatctttctaagtatatatatatatagttatccatttctgataatttaaaaaatatgtgttcattggagagaatttaaaaatacaaaacaatgtaaaaaatatttttaaattacccttaataatattgtctggagataacatattggtatgtttcctctcagtcttctatgtgcacataaacatgaagtatatattcagaactaaaaaatttctatttacctctcacgcagtcttctttaattaccttcccatttgtctttctgattagaaggctcccataggaggtaaaaatcaaatgatcaagaatttggtgtatggaatgaactatttaattgaaatatactttattctaaataactatttgtagaaaatgtcctttatccacttatagctttttccaaatttcctgttggtttgctgtaacttcttattgttggttataggagcactttatataatcgatgttatttatatgtccagaatgttctggttttaggtgtttccagttttaatttatcataattctgctaactttatgatgacctcctgttttacattcatatttattaaaaatgttaaatttttattttatggctttcatgtgttaaggcttttttaggaagcaatttttgcactccatggttataaaaactattattctgaattttctttaaattaatttataatatttttaatgttcagccatacagttttgtgtaaattataagatggctttcctactgttccacccctgaataccctcaacaccgtttattatataatctctcttttatcactgatttgaaatgatgtttatctcatatattaaatgcctaaatatataagattctatttggggctgtctgttatgtcccattaatttgttcctgcataattgccacactgcataataaacacagataattggtgtgtttattatagccctatagtatattctggaatctagtagagcaagatcaccttccttttctacatttacttagttatttgcacctttaatttcctggattaactatgaaatcagtttgatgactttttaaaaaattcaatgaaaattgaatttaggggataatggatataattacaatattgagtatttttgttcattcacctacactgttttccttgttataatttaaggttttttcttgatagtgtgagttctttcccaaaacaaaggatatttttccagatatcctttgattttcttactcgtttttattctggctgaactttaaaatcactttgctaaattctgctaatcctgttgggaattattagaatcgcctaaaatttgttaatgaatgtgggaagaattagcatctttataataattgacctcttccgggaatgtggcacgtgtcttcctttagtcaaagtgtctttaactgagctttgaaaaagcagttaattatcttcaattcattttacacatttctcattaagttcttttctcaatattttacagcattttccactcctgccaaatttctaactgatcattgtggacataaaagaaagccattggatggagggaaggaggaatggatggatatttagttatgtattttaccaaccaattcagtgcacacattaattccactagcttctgcattttgttctttagagtttgctgcgtagacagatcatcttttgatttttaatcctttataataatcaccactttcctacatcttgggacagccatactttctgaacaacatttaaaacttttaagtaactatagtgatcctctttattcatttatttatttatgcaatgggaatgccattaactttccatcattgagtatgggatgaaatgttggcctgaggtattttaaatattatttttttaggaaaaggtgttgcagtttatcctatccgtttttatttaaacccccttcttttaccttctttcttcatcttggcatgttctctgactatggatttctattattttctttccttccagccttttgagagtgctatgcaagtttttattcctttcttcaggttcttatattaaatcaacttcggaggaattatctgcctttcaatctgcaggatgcttttctatttttcttggttttgtaaagtatttcttcctctggctccacttaggtttctttcctctttgcacgtagagacagtaattcacagctaaagtctggcgacagacaaggtgggtgatttcctcctggctcacacagcgtcatgtgcagggacctgagactctcaacaaaaaatgtcaagcaccacttgtatgcaagcaacagattaacagacacacacatgacataagccaaaaaacttagtggtaacgcaagtaattttcagggtatgtttctcattttgtgtaaaagctcaactactcacctggccagtggaaaatcagatatcgcagaaccttatccttgcaagattgtaaagtcgagtctcttcaaacctacctctggctgaggagcagaacgtttggcttctttctcttatgcagatagccatctcgacggcttcatccatgagagaggcactcttcacccctcctgcagcacattctgacacatgcactaatgagaaacaagaaacactctaacaactggcttgcccagcactggttccagagctctgtaagtctctatgctgccaactgtgttttgctttgcaggaccacatcgctctggatacagtgctctagtctctgtcctccattttctgttattatttgacataagtagaatgaaaagaactttagagaaagacaaaaggtgcaaccttgtactctgtatctgaggtttaccctctttgagattagataaaacagcaaaacctcaaaagaattaggatacaaatatcaatgttttattttacccagaaaagtttttttcaaactgctgtatatttactcattcatgtagccattcatcattcagcaaatatgtactgagtgcccgtgatgtgctgagtccttggaatgtgacagggagcaaaggccaacccagccactgcccacctagagccacctcattcaatccaataatcacacacaaaaagtaaaatcacaacgatgtacttgagagataaaggttatgtaagataacagaagacagggcaagaaagatatcacgaaaaagtaatgatcaagaagagaattccaaagagtgagtagaagtctttccattattttatattgtaaaagaaaatttttgcagcagaaatccagtgcttaatcccttgagtaagaacatcactgtacgttgaatagcctttgcattttggaaagcatgtcgtgcttttctcattttgctagcattcagctgtggggtttgctggtagagtctgaggcctgttcttgcaatggtgcatgtgtgtagagttatcccattgcgtcagcagaaacaccatctactctaacagagcagcgctgatcagaagccagaaacttggcatgacacaattcgaatacggggctatccagaagaaagaaaaataggcatctgattttctttaaaaacaaaacaaaacttatacgttgttatggggctagagactggcttggaacgcagtctgtgaccagtgcaggccctggtgacaagcatggcagctgagacgagggctctgcttcctgtctttcccctcaggaataggtttgctctttgctatctattgggattccacacacaattttcttcttgaataggagagttttgttcagaaaaagaaagaaaaattaactaaaactcgctgatgtcaaacattacctctagcaaaaatctgtgatgtccaatatttacacaagtcaaaggttatgggaatgagtttattgtgtgctatctaaaagggaaataaataagaaaatgtactgagtgtgcacatgttgaagctattggatcttttaaaaacaaattgaaattgaaaggtaattagatggggtggtaatacaggaagatacgaggacgatgataaagtgacaccgaagcagtcaaacctgggaaggttttctgcactaaacctccattcctgcgagggtttcctcaggtttagacttgattattcttgaaaaatactgaggcttttgaggataaatgcaaatgtaagtgatggatggaagcttctgaagtaaatatgtaggagggttactaccatctgagaataaactatatcaactggaaaaaaaatacagagtgactgtagcaattcacattttcattaccagatgaaatggactgagccctgttagtaatatacaaataaatatgtacttacgatgagatcttatctaaaagaaacgaaaacatattacaaagcacagggaaaagtggactcctgcaaatgagtcataacacctgtgtgggcaaaagaaaaaaagaatagaaaattctatggtatgaattccaaaagcaagttcctgacatccaaatgtgagagctgcaggaagtacgtagatggtgatttctgggtttgctttttacttgtgagaatttgagaaaagagcacagctgccagaggcgtttttaactttattttttcacggactttctaatcccactgttggaaactaacttaagccaatttgctcacttgcaattgtcaagaactttctggtgggggtgggaggagaagggagggtgtagttcagtgaatttaggtacttcgaggtagatgacatctgttgagtgagggagagggctttttccccaaatgtcccaactcaaggtatgcttccaagaaaggatgtctcagactgaagcctcctacagagagttgattggtgataataaggagacgcacacaccaagccttacaacctgctctatagatgagtttagtgtaatcccagctctgttcttttggggacccgacttgcccatccttggaaggtttctttggggcacatgtggcaatatttccatggaaggattcagctgacctcgtaatcacatcaaaagactagactcttaataagcattttaccacatgactggtcaagttccaaaatcccaagggccactgccccaaatgtaattactgagataccttgatacttagattttgaaattttgttgatacgttggcagagctatgcacacatttttgatgggggaggttttgcttcatatatcttgagcactacttatttcatcagtgaaaaatcatgtctaccatccatgatgctgcctaaccaaccatttatgttgatgagagaagtagttggctaagagcttctggtagctggatctgcagtgtgggcttccattagagtccatgaaatgctggttagccaccttcccaccagtctgtgtagcccttattggtgtattccagatattaaccaacagcccctaaggtgtaaataaaatgactattcacgtgcatattatactagtaattaaattatagacaatataacacccttttaaaatgatttattttgtttttatttcttataagccctttgctatattaagctttcattaaattatgggaaatataatgggaaaattatttggaatgatttttccctcacagtaatgttccttgtgacaactggggtttacttcaggttatctgtaaagtcgtgtaaactgtcttagaaaagagcagaataaccaacggtttccagacattaccatgggtttctggaaaaatctcacatgacaccactagcaaggaaagctggatggcaggagaaattttatgctcaatttttagcaaaactagaaattattgagcagtgagttgggtcaataactgcactttcaaggctagcgtgacactcccctttcccttcaaaagaattactaatgaacaagtatatgtctataatttaattcccagagtctggtttagctgatagaatttagattacatgtaattatttatttaaaattctctaaagttttcatcttactctgtgtgtagagacctagattctacgcgtatttaacaaactgcaaaaacattagaaaagtctatgtttcatttaagtattgctgtagacaatttaaaactattaggctatcactgtgggtgtcagaatcaccttagagtgtttgcttaaagcacgcattgctgagtcccacctccagagtttctgattatttatgtctggagttggtccaaggatttgcatttccaaccagctcctagacagttctttgacaacaactggtctccatgccaccctcccaggcccactcacaatatgaaattttacatagtgttgtgaggatccttatttaagcaataatacataacatgggagaaaatatcttcaatcataaaattgtagaaaagaataatggttctctaagtgaccattctgtattatttttcaataaataattagtccattctcacactgctataaagaaatgcccgagactggataatttataaaggaaagaggtttaattgactcacagttccatatggctggagaggcctcaggaaacttataatcatggcagaagggaaagcaagtaccttcttcagatggccgcatctgaagtgcatgcaggggaaatgccagatgcttataaaaccatcatatctcatgagaactccctatcatgagaacagcatgggggaaaccacccccatgctccagtcgcctcccagttggtccctccctcgacacatgaggattatggggatttcaactcgagatgagatttgggtatggacacagaggcaaaccataccaataatgaggccttatcactcaagtaactcagggaaagcatttttgcctgaggttgaacaaatatggttcagatacagtattttctaacacattcctaagattggatactatgccagttacaagtgtggaaataagtgtagaagtgatggaaatatttgggatcttgtcaaataaaagatgctttttttcctctgcctttgctaacattatgtgtaaatgacatttctaaaattggcacaaatgacagatgagttgggtgtgggaaaccaacttcttgggaagaaaggagaaatattcaagtataaggagaaagctgataagaaacccaagaattgagatataggtaaaaactatgcattttaactaaggcttgttaagttagcacatgaaatattacagcaattatttcgtttgtaactagagttttacataatgaaaaaatgattactcagcttatgcaacattaaaaaatgttaaaccacatgcaaaaaaatgaaattggaccttgtcttacaacctatggaagaatcaacttgaaataaattaaagacttaaatataggggaaatcttcagaagattcatcttggcaatgatttctttgacatgacaccaaaagccaaggaaacaaaagcaaaaacagacaagtgtactacatcaaactaaaaagcttctatacagcaaaggaaaggatcaacagaatgaaagacaacctatgtgaaatgggagaaaatatttgccagctgtgtatttgataaggaattaattaattcacattttaaaatctgattttaaaatgggcaaaggacttacgtagacatttctgtaaagaagacatacaaggccaggtgcggtggctcacgcctgtaatcccagcactttgagatgctgaggcaggtggatcacgaggtcaggagtttgacaccagcctggccaacatagtaaaaccctgtctctactaaaaatacaaaaattagcctggcgtggtggcaagtgtctgtagtcccagctactcaggaggctgaggcaggagaatcacttgaacccaggaggcagaggttgcagcaagccgagattgtgccactgcactccagcctgggcaacagagcaagactgtctcaaaaaaaaaaaaaaaaagaaaaaaaaaaagacttacaaatatccaacaggtataggaaaagatacacaacatcactaatcagggaaatgcaaatcaaaaccacaatgaagcatcacctcacataggttaggatagtcattatttaaaaaagcaaaagcagaaaataattgttggtgaggctgtggagaaattggaacccttgtacactattggtgggaatgtaaaatgctgcaactactatggaaaacagtatggtcgttcctcaaaaaattgaaaacagaattgccataagatccagcaatccctcttctaggtatatagccaaggacattgaaaccaggatcttgaagagatatctacactttcatgttcactgcagcgttattcacgatagctgagatatgcaagcaactaaaatgtccatcaacaggcaactagataatgtgctatatatacatatacatatacatatacatatatatacatatatatatatacacacacaatggaatattttcatctataaaacaaaatcctgtcatatgtcaacatggatgaacctcgaggacatcatgctaagtgaaataagccagtcacagaaggacaattactatgtgattctgcttatgcgcagtattgagagtagtcaaactcctagaaacagaaagtagaatggtggttaccaggagctggagggaggggaaatagagagtttccattcaatgggtgtagagtttcagtaatgcaaggtgaaaaagttctagagatctgctgcacagcgctggacttacagttaacaatcctgtatcgtacacttaaaaatgtaagagggtagatctcatgttttttgacacaataaaagaaaacattttgatcttaatatttatatagcttgaattgttgaatacacatggcatataaaataaacaataaaacacttgttaaatgagatatgggtgcacgtatgctggaattttttatgacatggattttttaaatgctataggtaaaaaaaatcacatcctttgaaaaatgatttcatcaattgcctgatctcaaagtgttagagacttagaggcagccacaaagcttgatatcatcaggtctgagccatttctagagaagaggaaaccaagattctccctcttagaccttactccctgattgacagttctcttcccagtgtcctcacgtacgcagggacttgagaataaaagcagagaaggaaaggatgctcactgaacacctcctttgttttagcactttacacagggtgtctctgatgaaccctctgaagcacacaggagctgaccaggtgctcctctcactgagtttctgtgacctactgtcatagccagatgtcacagccaccctcaggactccgacagaatcccttgtgtccctaaaaaaagtacggaagtatatttagatttaaattaacttttaggtcattacatagctacacaaaactttagatttacagcagaaacttaaaaaattctcagcaggagaatgtttaaactgattttttttcttaaagaccagtgtgatggtataaacagaatttttaattcctttaaaaatctgaagcggaagctcaagtagatgtatttcattttaaatggaaacacaaacattaaagatgataagacattgtttttaaagtgtattatgcagctttatggaacctgatgaattacaaaatggaagaaacagaagatgaaaacattggtattattgtatcatggtgatttcttcttaatttttatttttattataatgttacttgtgtaatgtaaatgaataaaattttcccctattaatgataaccaaaaatgtttaagcaaagagagacaagttttaaggaaagtacacagcagtgtttctgtgtccagtggagcagcctctttggacaggtttccactttgattagcaaggaggttaatgttgctgtccactctctagggctttagggtagtttaatgtcacagttggctgcactcctttctctcattgtctaagattgcaatgtaattctctgctcattcatcacccgcctgtttctgccttgcccccatgtctccacagatcattttgtgtttctctccagttggtcgcacgctgagagttagagctcggaagttcccagccatagttaactgcacggctattgactggtttcatgcgtggccgcaggaggctctggtctccgtcagcaggaggttcattgaggaaaccaagggaattgaggtatgccgtgtcagcctgcgtcacacacacacacacacacacacacacacacacacacacacacacacactctgaaaatcctcagtaggtaagtgctttccacagtacatctcctatcagaaagctatcctgatttgtttaagatgctaaacttatctgttagtttacattctaaggaatatgatggctgaccttttttccaccatacatactgaggaggatgtgcacacgtgcgtgaacacgggcacgcacacagcacttgagtatgttctcactcatgcactgactcactggaagcccaggatcattacttccttgaatcataatggggcttgctgattataaatcctttaagtccaaactaaaagcccaaacagaaatgtagtcaccgtagccacgcactgcttgcttcttaaccaagtaaggcaatgaattgtggttattctcatagtagcaatagttgaaaaatcagcccctgtatcccataaccactaagtcaaataatatatctacttactgttttacagatttatgttttatgggttatatttgtcatttcttcatgatgacaaatttaaaatttaaaatcaaatttaaaatcccatggcattttaaaatggttgtacaaaacaaaacaacaaaagcttcaagcattcagattcagagggaaaaaggatgtagatatgaggttatgatttagatttcctggagatgaagttttattcatgtctagtgcctttctgattacatagcttggaaaagtgattgtggacatttcccagggagctttgtcttctcattccattgagtgataaggtgaaaggttcctagaataggtcagacactgaaagtgactctcagaggcaaacacagaactggagatatgtgaggaatgatgtctgtttctagttgaaagattatcatgaacaggtacaacccattgtagccccaccgttacccaaaaggcataactgccacctttccaaagcaatccttttacattttgttgtatattgtatcattcagcggccatatggttaaaaatctggtcatatttacatatttaattgtttgtatgcagctagctttattgttcataatatcattttcctttgcttctacaaaaaaaaaaaaagcagctatagaggtaagtacacatgcaagtattcaccaacacctacagaattttgtggagggagacctcttctcctttagtcttttcctgaaatgtttattaatctaattatttggtggtggattgctagggaagagccgtcaagcaacatctaacttggaagatatatatatggtagaggccttaggatattcatatacctcccctgtccttctctcctctacacttgcacttaaaacgtttccacaaataaatgaaaataagaaatgatctcttctaaagtctgccagaaacattttgtactctaacatctggaaaatcattaaatgtgacaaataattgtcataaatattaacacaaatttcgtatgtgattgccaggtctgctgcatttctggaattttctagggcatcattttatcttgtgatagttacaagaagggttcaaaatgctgctttattaaagggagagagtcagtatgtatcttctgatagcaaatttgtgtttcatcaggctggtttggtaaggaagagaaaggggccagagcactttgtttctgcatgttactttgtcaaatggtaggaaattagagctagtagcatggtttaagttggcatgtggcacagtgctttttacagtttcttccctttgctactctgtgcaggctttttcctgtccaggtgggtgccactttgaaaacagctaaaggagtttgatatgccgttgaccgttgacatctgctggatgaggcaggacttgcatcgtgttaagtccagagggctcctgtcaggtgctaagctggatctgatggtgtcataacgcctcctataggatgctgagtgccaaataggaattttaaaaacactttcccatttctcttgaactgaattgtgcctcaaaacaaatgagtcagatgatttcatttcagtgcaagctgcttatttaactttcccaccttcctaatttgttgcgcaggagcaataattataattcagagtacaatgtgtccatggtcttctaaaaacctgtggtgtcttttctgtagaggtcaaaaacagcttttaagttttttgaatgagcactaatttgatcactttcttagttttaatttccttttttaagactgaaagttatcagcataatttaggcacttcttaattattgacgtcatttgctgagtgtaaggtgcttacacaaggtgaccccctttggccacagagaaaggagtcgttaaaggcaagcagttttgtgtgtgttggcgtgtaattttccatcagtacacactcagcacccaggggtacgggttgactgcatctaaattaatgtttgtgctatttttctgttgcctaatattgaactaaatgacagctgacaaataatgaccaaaacagtttgacacttaagtatttatctgaagactttgtgtcaacgcacactacctctccaaggagattttgaaatggagatgggaggaggtgtgtaaggagggagagaaggaaaagccatctgggtaaacctgggaacagtgttggaaaggctgtgagaagctcgttggagagagaactgtgtgaagagcttagtgattagtacacggtttctacaacgaaaaatcaagagaagctgcggtgttgaaaaacaagtgatgtttttgcttttcaaggtaaaatgaatcatagacatctttgaaagcagagccagatgaaaggagaagttactgaatggaaatgaaacagtgagctgtctggtgaaggagtgagatgtttgttggatggtgtagagtagatctgagcaaggtgaaagaggtcatctttgggggcatgttgaccaaccgatgagttaaaatcctctgtccttatgtggtgccacttaaaagtaatgacacaaactccgtatcatcagctttttcagggaaaagcagttattccccatgcaaccacctcttcaattgttgcagtttggtagcttgtgaaggacatattttactactgttttccacaactgatggcgagaaagtccactctaagaggaaagttattttactgctatatttaaagacttgtttccccaatggtctgtaaattcatttttaaaatggcatgccaaacacaaagggtataagacaacattttgtcagtgatagctatcttagcagagtttctatcatattaatgactttaagcacagttctttatttgaaatataaattagggtatacatatgtaactaacctgcacattgtgcacatgtaccctaaaacttaaagtataataattttaaaaaagaaatataaattaggattattcaatatgaataaaaagtagaaagataaccttatgcagtagaaattgtgtgaatttgaggaaaataatcctctttctaaggaatattgaagccatttaaaaatattaagacaaatataaatgcaaccacatttatcttgattctgcttaagtcttatactggcttaagcatatcttcagatggctgaggaaagacacaagtagttgtaaacatccttccccattcttcaagcctcgacctcataagtagggtccagactttgtagctgcccaggaatctggacatgaatattcagttgaaggtgtaattgacttaaatggagctatccctataagtttgtagttttgtggcttttctctaggtgctgaccttaccagaagcagccacaccattcacaccatctcctgttctgtcctcttgctataaaagaggtagctggattgcttttttattctttggttttttttttctttttttgagagggagtctcactctgtcacccaggctggagtgcagtggcatgatctcggctcactgcaacttccgcctctcgggttcaagtgattctcctgcctcagcctcctgagtagctgggaccacaggtgcacaccaccacgccctgctaatttttgtacttttagtagagacagggtttcaccatgttgcccaggctggtctcaaactcttgacctcgggttatctgcctgcctctgcctcccaaagtgctggattacaggcatgagccactgcatccggcctggatttcatttttcctccactcctcctgagtcttcagttgcttctttgtttcaactttctggcagagaaccattgaaggtacctttttcaatgactgcaagctcatctaggaaattgttggcttctgctggactttgtcttgcctctgaccagtagttgagctccagaattaaaggcaagatacaaaaagcataagcaaataacaaaataatgcactcaccagacaactcaaaacaaaaaaacagcatacaatttagaaaactgtgcttggtgctacatttaacacttgttgctgccctgtgtaatggcagtaatcttactgcaactgctgttggtgctactgctaccacagtagcagaactgatagaggttcagtatcccttacccaaaatacttggtaccagaaatattttgggtttcagatttttttttgattttggaatatttgcatttacataatgagatatcatggggatgggacccaaatctaaacacaaaattcatttttgttttatatactccttatgcacatagtgcaaaggtaattttatataagattttgaagaattttgtgcgtgaaacaaagttttgactgtgacccattacatgaggtcatatgtggaattttccacctgtggtgttaaattcacactcagaaagttttggcttttggagcatttcagattttcaattttcagattagggatgctcaaccagttcctgctgtgaatttgcactgcttaccacctctcatcaccagcctcatgaggagggaccagtagtttcccctgggatggaggcccaagagtaaataatgccgctggtaaggggtacatctgcagtttgacaccagagcccatagtcttaaatccttcttttgactattgcatgaatgtttgactattgggaaagcagtaaaagaagaaaggaaacagaatttttaaaggagcaattttgtgggcaggaagaagtacaggagggtatgcagtatcttaccagatttttcagaactggaaatctagcccaggtcctaggattcaaaccctttgtccctggctccctccggaatcttcttctcagagcaaaacagcactatgaagagcttaggacaagtgttaaaatgcaacactgcccattttatgcattgtaagttttctttctttaataagccaccatgcaaccacaaatatcttattaatatattcttctaccagccctaaaaggagcaaaaagatcaaatagattgtgtagcacatcagtttgacatatttaaaatttaacacagaaataatttctgagaaaaatgttcaagacttactgtaggtatatggcatttaatgtgacaaaattgtcccaagttacacttcaaaaagagagaaaatagattctttcacctgcccctttctcttttgcccttcctccctccctcccttgaatacagtgctcttgaaagcccaaatttagtattacagaccaatgtagtcatctttgctggtcttgggaaggtataaaatcctaaactgatttagtgctgacctctgggtattggtttatattcaactctgctgtttgtcattttcaagaggaatatactgggcacttgcttgaagtgccaggtggctggagtacttggtgtggcagagactactcctgcccgagaactgtcacaccaaatagcagagatctgtttatgtttttgtgttgacagtgagccaactgagagagtagaaattaaacacgttttcttaatgtgagggaaagcagtttcatctttgcatttgattatgcgttggagacagcatcgttttccagagcatcttagtggggaaaccttgagtttataaccattcgatactggcactctgcttatttttatttttgccatcatcatgattagctgctaaatgactataagtggttatcaactggtttttattaagaggccaaatctagcaggaatgatattctcccctcacgtctctcaaagtgaaaaatacagcattgcgtagccctcgctgcggcagcaccagcagcaactcctctcaattctcccccaacgccccccacaaaaaaaaataataaaataaaataactggagataaatgaatggcagaataaataatttatgctaatgaaattactgcaattagtagttctacaatgacccttttaaaagccacagctgttaatgtcaggaagtgctgtcactactgaccttatcataagagaaagtgacaaattgagaatgcagggaagaccagtcatcaaagaggtctgttctggaacgattagagttttctgaaaaacagtgtgaattacaaccagctgctccctggctcagcgagtctcccatgctgtgccattttgttaagcctgataacaatagttattttgccccattgagacaagttgtctcaggccactttcagctctaccggaaaccacttcttccatccccgatttacaaatgaaactgttgttaaagagagctttcagcgcctccaaggagcctcctcataaggatcatggttgggcagaggccagagtgttttttttttttcttctttctttctttttttttttcccttcctgtaaggaggttacacttggctgaggaattatttatctatattgtagaaaggtatgtgtgtacctttagttcccattaaaacaagacaggacaggagtaaattcctgcacatgtctgtattgaagtcaagctcttgtaaaaataaagtctccaaaggattatgatttatatgaagtttatataaacttcttcataaattttatttttctgagttcactgtttggaaatatatttgtatctggggtccactagaaaccaagaatatttggaatttatatcacgttatttttaacttttgttttagtaatacattatttcagttactagtgagatggatttttaatacgcagcacaatgcaatatgtgggtattccaaacccactcgggaatttgtcgtgatgttggaaagttgattgtttaaagacattgttcaggagcagttgtttttcaccaagaattggctggtctctcttcacacctctgcttgtaatattaatggtgcaggtttgaaatgtttgactgcatcaccagccacgtgtgtgcaattttcccaaagacgtctgagcattattgacaacactttggtaaattatgtgtgactttcctaagagttggtgtagctcatttaattcatattaattgatttgtaggcttcccttgattaactgaacctggttcatcttgtacagaatgcaataaataatcattaaaatgagggagatgtgactctgcaaattaaaaagttaactacttcagaagtcatagaggacaaaatggaaagaatgtatagtggggggtcttccagtaactcattgaaggagagttgctctttttgtgggttttctttcccaaatatgaatagaaatgatcatgatatttttctcccagaagcagtgacatttataccctactatccagtttgtttttacatgagttctcataaaactgtgagtttctaagttttggcttttttttttttttcagtgactttgcagggttattgcttctctttgtctaaagcttagtttgaaagcaatggcagaaatatttctcaggatattgtgtctgtttctccaccttctctttcacacactcggtagataaaaatcaagttgtgaagatctgtatatgctggcttttgtatttggtatgtggagcacataaaaaccctttgtcctacttggcaagaagaaggttactcaagctgaatgctttattgtaatctcccaaatcctgtggatagcgcttaaagattaaataagttttcgtaggttatactatcatttttttttctgacttttagaaaaaaaatgatcatttacttgattttttttaagttgtatttttaatttgagaggatttcacatgaactgtaatgtttgtgttttcagccagtgcacaaagactctattagccttttcatggcacatgttcacaccactgtaaatgaaatgagtaccagatattaccagaatgagagaagacacaactataccaccccaaagagttttctagaacaaatatcactgtttaagaacctgttgaagaagaagcaaaatgaggtatccgagaaaaaagaacgcctggtgaacggcatccaaaagctaaaaaccacagcctctcaggtatgaccaggatgtgttattactgagtaatatttatgctgtttaacagaaaaatatatttccttttgaagcactactaaatccatttctataagatgccagctggtgaaatttacagtttcatgacaccaagaatacactgctactgctttcaaaagcctacaatgggattggccgactcacagctggattagggtgaaacgttctcttcctggcctgactcagtgtaaggtagtgtgggatattgaagggagcagacacagcggattgcctctcttgtctctgacttcttcagtgcacggtacttgtcgtcaaggttcttatcatcctaggatggaccagtatcttttttggtctcagattctcaacctccagtgagggcatcattttctggctaatgactgtggcgagatcccaaggtagagctgttcctcccttagtgacttgtctgctcctcttacacatctgtgtcctcagtcctgaggcccctgctccctcgaagggcgatgcctctaacttgcaggagtaaatcaggagagaatcatcacaggatgttaatcatgtgtgggtctgtacacatattatcattatttcgttgttaaaaaaggatttcatgaagtagttgttactactatagttttatatatgaggcgtaaagagtttaaggccagagagccagtgaggttgggttttagacccaggtctgtgttgctctgatgcccatgagttgtccatggcactgtgctgcctctctgtggctggaaagaagagattggaatgagagactctgaagactttgaagagtagcccagccttattctgagccagtcaggacttagagctggagtgagaagaatcctcactagtgatcacctcaagactagaaatactggtggccttctcagagtcatgtcatcaggtcagactctcatatgctttacaaggattggggcagtggtttccccgagtggcctgggtaacccacctgtggctaggctagaaatgaactgagacccgaaggagggagcaccttttcaaatgggcaccttttcactctgaagggctctctggccatgtccttcagtcactctgggccaaagcaccacttgcctctttttctcttagttttctataccaagaatgactctgtgacaaaacactgtgatctgtactaatagtgagtagatggaccacaattaggaaagagaaaccagggtgagtaggtttccaggacggttgggatcaagtgatattaagaatagtttctaggaaacccacaaatagcatatccatatttgtgcaccttctcctttcctctcaaagaacgtctgtctaggccaggcacagtggctcacacctttaatcccagcactttgggaggctgaagggggaggattgcttgagtccaggagtttgagaccagcctggacaacaaaatgagacccaatctctacaaaagaattttttaatgagccgagcatggtggcgcacacctgtagacccagccacttgaaaggctgaggcaggaggatcccttgagcccaagagtttgaggttacagtgtgttgagtgggtcactgaactccaacctgagcaacagagtgagaccctgtctcaaaaaaaaaaaacaagtctgtctttcctgtctctttttattcacagcttattttactttcttaacttttgcccctctccatgtcagttttcttctatctgtctatcctcttctgtctcatttaaatcaagacccctttccataagaaagattttccctggagtcctgttgggctagataagacgaggaaggagctctgtttcacaaagcatttatatccctttgaatgccgtcctaaactgaacctgttgactttgcccactatcaggaaatgatagtattgtcacccaaactgagctttcaatactgtgggggcatccttagcaaagagataagtgcttctgccatacttaaaggttgtgagctaaaagcaagtggggtaccatcctggaccattccagtggtggcagcatctcagccacaggaaaaaagaagaggagagagactgtgatttcttaatagtcacctcagttacacattgatgagtcagggggatgggcaaggagagagacgggagggccgattcactatgtctgccaagtccagggctgcttgggtctctttacttccccttagctaagaaccacaggcagaaagtctgtaaagacacaagacatcttgattgaccatgaagtctgatggaaagactgacggtgatttcttttcattaggtatttgtgcatggaatgctcttactatcaaaaaagtggttggaatattcaatagctacatggcagttttagaaataagtgggttataaaaaggggatggtttcctatgtggagaattggagaaccatattgcagaagatcaggttgtatggagagcgtaatgcctgtatattggggcatgtatcctctaagggtctgccttaaggaatgccacatcatttgaaaacattagcaatgttccttctttacagtaaagctgtaagcaccttttatagccaaataacctctctctagatgtcagcttaggtcatcacagatagtcctagtgacctttcttcatagagaaagccttgcttccacggcttcagtcactttgaatatttcagagctaacagcttccttagaaactgaaattagggcttgaaataacataattttgtcctagtctcttgggtgattctttttgctttatttctattttgagatgataatagattcagaagaaattacaaagcatagtacagacaggtccctgtcacatcttataggttcaatggtagcatcctgcataactagtacaatgccaaaaccaggaaagtggcattggtacaatccacagaccttattcagatttccagttttatttgtacgtgtgtgtgtgtgtgtgtgtgtgtgtgtatgttttatgcagttttatcacatgtaggtctgggtactcactaacacagtcaagacacagaaaacttccatctacagaaagatcccatgttgccattttataaccacacctacgttaccccccacttcttccccacctcctgaatcctagttcctggccatcactaatctattctccatttctatagttttgtcatttcaaaaatgctatacaaatatgtaaccattgggtattggttttcttcattcagcataattcccctgagatccaaccgaggtattgggtgtatccataatttgtccttttttattgttgagcagtattccacagaatgaaggtagcacaatttaaccattcaaccactgaagggcatctgggttatttctgggttttggcaattataaataaagctgttatgaatacccgtgtacaggtttttttttttgtaggcataaatccacaaacaaccaaaaatgaaattactgaattgtgtggtacttggatgtttacatttatagaaaacaggcaaattctttccataatggctgtgacataatacattactaccagcagtgtatgagagagccagtttctcagctcgcttgcaataatttggtggcatctctaatttttattttaaccattctaataggcgtgtagtgatatggtggttttacttgaattttcctgatggatgattcttttgactatggcctaatctaatactagtttcatatggctaaaaagaactgagaagcatgtcactatgcaaagttaccctgaatttatagacaggctgaaaaatcagtcatagcttaatctataatagtacaagtagcagccatagtagtaatcatgctttttagatagagtgtgaatatactgtgttgggtggaaactacaagattacttggatatagtaatggggcgtcgttccacaagatgaaaccactgaaatgtctttagcatttgagttaaaataaatgtaaatggttatgattgttctttgctgctatgattttttaatggtaatatttatacttttggaaaagaagtgcagtggagagataattattgtgatgtgtaaagctgctttcagatatttctgagaactgagtcatgttttttttctctagtacctcacttctgcttttagttacatgaccctcaaactgaggaacctagtaatgctttctgaacctgatgaaattataactgaaaaaaatggacagttctttttagcagatgaattcatggattcctcggaaggctgagttctccaagagctgagtaaggttatttagtgatggactgatgggagacgtgtatgcctctgaagctcactgagttttggccacagcatactaataccccaaacacacagtttgctcttcttagcaggtattaagttgaatattgggttagcttcatgatcataaatgaggtgaaaaaaatcaagaggcctattttctgtttgatgggaagaggtgagacctatcagtgggcattttaatatgcagccaattaatctgcagtcaggcaaggagcattcatgtcgtcaacttactgaagcctccagcaaccttctgttggacagtgagaggcatagttcttccagctcatcaccaagtatgtcttcccacaacctctgcttccttgagcccgagctgcctaggacccaaaagcagacgtgggtaaaggagcatgtggtcagacagagggaagagcaacttccctacttaacctgttagtgctgacaaaaattaattatatttcctgcaaaatcattggaaaatattattctgtttgttctcatgtggagaaaaacaatgtggctgcatttttgcaaatcagaagacagtgaaaatcagggtagagacagatgcaagatacaaattgttagagatccctgaattcattcccagcaataagctctatctgggatttgttgtgaacaaggccagtgacgtaagaataatgacttttgctttaggtgggagatctaaaagccagacttgcctctcaagaagccgagctgcaactgagaaatcatgatgccgaagctctgatcacaaagatcggccttcagacggagaaagtgagccgggaaaagaccatcgctgatgctgaggagcgaaaggtcaggctaattccaacatttagagtgcggagctatatttagcacaaaataaaccttggtaggtgaacaattttgaacaacttcctctccagggagcataaagtctaaagaattattatagttacacatgtaacagcatttcacaccgtgattaccacttgacctttctttacattatgcatttccccaaccttttagctcttttaatgatatgaaagaacaataaatactgagctcattcaagcatataatggatgtggatcttgaacatcaggcctatttgtaatacagtaaaggtcaggaagtcacctctgaggtttttaaaggtttccactttttaggcaaattgaacaactcaattgttaacaaagcccattccgtcactttgcaagatggttttcaaattttgcattttaataatacaactggagtttattattaagtcctaagctaaatttgttctttttgattcgatcgaggccctggcattctgtattatgttttattgttggaaataattccctttaagattatatagattctgctttctttctactcaggtttctagcaattctgaaataagtacactgtcttttgtcatcttcttttaccaaaacgtcagctacaaatggaagacatagttttgtacatctgatatctcaaaagaaataccatagtaaacagaaaaattttaatacatacttgtttaaaaattgagtgtatatgtgtaaggtaaaaaattcttattttagacaaaaaagtataatcagggcctaattaataaaaagttataagttgctaacattctcacagccattgaatcggtagtgattatgccatttttcttgtattttatgttacctgaaaatatttgagtttttccagtggtgttgccattcatatacaattgagttgattttctttttttttttccaatgcatattgagcatgttttccttgcacaactaaaggcttgaaaagtatattgaacatcaaaactctaaaaggacagttttaagaaataagattatggcattaaaattgaagataaggcacatttggcatgccctatgtgatcagcgggcatgtaattcctaatttgggttgtaaatgtttctgttgagtttcagataagtggagaatgtccttaaaagtatattattgggctgagtacagtggcctgtaatccctgcacttagggaggcagaggcaggaggatagcttcagcccaggagttcgagacctgcctggacaacataatgagaccccattctccataaaagaggggcaaaaaagacaaagcgtgttattccattgagcaattaggtatcacacatgatacagtcaccgttagctaattctacccagggaatatttttcaggcattacacaaacatgtgatgttctagtaattatatcataacctatcatcacagatactttttggaaacttaaaatataaatactctagagatttttttttgcatttttacatttgaattcccaaggaaaaattaccctcataaaaggagaaagaagttttagcaaattagaactcatctgacaggttgtttagtgaagttcttcaaacacaaagaagggacatactattttttatgtttaatccataccaagacataaaaataaaacttctaaacattttcattttatccatggagctggatgttaataacaaatattaacatctattttgtcaccaggcagtgttgtagactattagggatatttgacaagcaggggtctctcatgtagattacattgcagtggaaaagaccgacatgagacaagtaacacattgagaagctggatattttgagataagtgctctgatgaaaatccagtagagagacatgatggtgggaaggaactattgtaaattggatattcatggaagaaagttcttttgtaattaaactagaaagcatctagaaattcatcaatacctgaatccatgctctgtgttcacatttgtcatatgttcagcaatgtgctagatactatgctatgccatactaaagggggtgaatatggactgtttctggtcctatgaaattgggatctcaagtcttcaaacatgagcagtaatttaaaagtaatgctgcataactcacaaagtacacagccacgtttaacatgactaaataaatgttggggttagagaatgtcttgccgtgaaccttgacagcccatgtagagaggcaggttgaaatcattgcttcaaatctataaggtaatcaagggcgatttgaaccactgggcattgccagcagtgacttccaaatcacacaagcatcatcaagcctgtgaaaattagttcttcttccacctttgtttggcttctcagctccaaattctaaaatgctgagaattctctcattgctttcaaactgtgttctcccttgagtagagtgtaaacctttatgagtagaggcgccttctaaattgaagcgctaatatcatctcttcaaaagttgagcatcaatcttgatttggaatggccatcagtttttgtgtgtgtttctgttctgaatgtgggtgggcctgggttttagaggatcataaggaaattcttataatctaaaggcagacaagtgcactgtatccacttgctaaggctgccatgacaaaaataccacatggggtattttgggagattgggagggttaaacagtagaagtttattttctccaaattctggaggctggaagtccaagatcaaagtattggcaagtttggtttctccttctgtgacttgcagatggctgccttcttgctgtatcatcacatgatcttttcactgtgattacttctgctgatgtgtcttgtgtgtgtccaaacttctcaccccagtcagtttggattagggctcaccctaatgacctcagtttaacctgatcaccttgtaaaggccctgtctccagatacagtcacatggtgagcttgggtcttcaaaatatgaattttgggtggacacagtttagctcataacaagcagttattgggacttcattctctttattctctccctgtgatcaccactaatcttaagaacatctgcaaggggctgttgactaatgcaaggcagagaatttctggtctacccaagggtgaaactgtctccaaattcctgctttaacttacagttgtagggggaaagcacactctctaggcactccctgcaactcttctcctgttttataggttgagccttgctgaccactgcctaggagccactgggcaaaggaaattgtacactggcttaacagcttactgagatatacagaattttcactcttctagtattgtcgcaccttagggtaaacggtattgagaatgagaaatcagttgaccaacctgagaatcctgttcatttgtataagtgagtttttatttaatgttcaagattgttttgtttataaaaattacccaaaggaaaaatactccattaatagtaaaggagtcagaaaagagtagcagctcctaggctgatagaaatggcactttagcaagacgcagtggcccatgcctgtaatctcagcactttgagaggctgaagcaggcggataacttgaggtcagcagttcaagaccagcctggccaacatggtgaagcccctgtactaaaaatataaaaaatcagccgggtgtagtggtgcgtgcctgtaatcccagctactggggaggctgaggcaggagaattgcttgaatccaggaggcggaggttgcagtgagccgagatcatgccactgcactccagcctgggtgacagaacgaaactgtctcaaaaaaaaaaaaaaagaaagaaagaaagagcacttaaaagaaatactctttaaggttttatccagtaccaaaaatctatgatcctgattccaatttaaaatgatttttttaatgatgccattataaatgttaacaaacagcatttatagattcactgtgtccttatggaaaataaataaacctgagatgataactccttcactcacataaactcttttatctgtagcagtgttctgtagcatacagaaaattttcatggtccattcctggcagcttttgagggttgtggttttggagtagttctcagtaagcatgcagggttctccgatttacattaacaatagctgtgtgtgtattagcaggaggccacatatctaccccgaaccaattatgtttataaaaggtacagtacacagcaaaataatggttaatcaggagaagggtaattactgctaataaagctgtagtagacaacataatttgttgtgagcagtgtttaattttatggtatagttaaacctgttcatttcaaatacatctgaagaaatatacttttgttcacactttatattccacaatcaccatcaccacgggaaccgtctcccatggtggctagatcctggtgcccagtgccacagctttgaaactcaaatttctactgaggactaaaaattcactcttcctggcctttcagattctataggtatcttaaggagaggaggataagccacttcccacccccgccctgtcttctcattttggtttggttcaagtttaccagcatgactttcctctatattatatatcatgtcagaaggctgatgcagcaccctctgtgtcttgggaagaggtgccactggatccacaagaggagagtgggtatcagtgttattgttccaataccgaaggcagatgtgggctcttgcatctctggtttcttatcatgtccgtggagaaaccagtaattcgtcttcactaaaattttatttatagttaggcatgcgatccatgaccacagaatagaatatcttctagccagttgatcaaaagagcttcagatctgttctttaggaatagccaacatggcttctaagcaaaagttagcaaaaattagagaatcctaggaagaacattttgtggtctaggttactaagctagcccagatgtttgttaatccaggactctctgaaaaagaaaactgaagaacagaggaatcacttaatcttgcttttactattagtggtaccttataattgagttagtcaaagcttttcttggagcattttggaacttgaatccatttatgttgagatttgttactgtgtgttttttacatgtacaaaactttgtatatatactatgtctaaaggaaaattagtctgtttaacaaattcctcacctgttcaaagtacagagaaatgaattatttaacagtgcatctgagtcaacctccatttttctttagagatatctgtgataataatttatacgggtttgtgtgcttttcctctttaattaggtgacagccattcagactgaagtgttccagaaacagagagaatgtgaagctgacttactcaaggctgagcctgcactggtggctgctacagctgcactcaatacactcaacagggtaaagataatttattggtccctgagtttcctcaaagtaatatttaaaggttattagagtttgaataactgagctgagagagtagcccattacagccaaaaagtattttaaaaggaaagaagcacccatgaaatattaaagttgaaacaaaccattgaggtcatcattatagttcaacttcttttccccatccaggaccctgttctacggcaccccaataagcagtctccttttgaatatttccaacagtgtgggatttatactcttaggaaaggcaactggattgttggtaactggatttgacccaaatccaatttttcatatcatgtgttgctttaagaactaggcgaaggattctttatttcctctggaatataaagagtagcattgatgagagaccctcatggaaagaacaatgggagcaaagatacctaggtttggtccccaccatttcttcgagcttcatgttgtttgtgaaacctccctaagcgttcacattcttataagagaaagtaagctgtgttcatcactagcatattgttagggaaagtgaaatggggggcaatgttcttttaagagcctgcagctaatctcatcctggggtcttctgccagacctctggggagagctcaggaaatcactgggcctgagattcttaagattccatttcaaaaaggaaagaatcgagattttcactgttcttcatagaaatcctgaattcgttttgtaagtattttttgaagaaaataattttgactgtgactaaggagatacttacatgggtatttcttagagtaccataaaactgaaaaattttaaatggaaacataccatgacagaactctgattattatgcattcaaatagcctgctgccgttaaaataatattgttaaatgctaattagcaatgtgacacattaaccatgatatattaagtgaataaagcagattataaaatagggtattttatatgactaattcttttggtaagaatatgtgcacagaaaaagattggcaaaaagtaagagtaattggtcgtctctgagtaatggaatatttattttctttattgtgtttctctaaatttgcaaatttttctctgaataattactctttactcaggcaaaatagctccacttaaaatatgaagctgtgtatatgtataagttataaaagaatcttggttagccagctctcaattcttactagcatattttaagactttgtttttgttcttgctttcactctgtttccattctttgtaatcatataccaaataaataggcagcttctgataagggagcagaatcaggttcaacatttgataaggttttataagcaagagtgtattatgtagcacataaagtatcacaggaaatacctggttggttgtttttgtttttcaaatcatgtattaaatatcataagcctacatgagcttcttatatgtgctattacctgcctcaaagtgtttgccctgatacatataatttatactattaatatcatctgttggattaatcagtggcatcacctgaggagacaaaggagtagagaagaaagttcagcctatcttggccctctcctagttgagagttcctgtagtgtaatggaagatatttctttcttgtacatgtaagacagaaaaacaaacctaagagacactgaattaaggaattatgtgtctgggaggggcttggttaagatgcaaatctattacatagtgggatagaacctataaatatcttacaacatatacacatgtgtgtgtgtgtgtgtgtgtgtgtgtatcctggcctcagtgagcagggctctgcaggactgatatatagatatatagatcatttttcttgaaggcaagaaagggcagtgatgtctccagagtatcagagaagtgcccagcaagaactgaacctcctggagttccaaggtggagtccccaggtggcaaagaattgccaaattgagactggtttgataaggagaagtgggagtccactaaagccttgcttggcaacttacagagcttctccagacttccgctaatcctgtctgtgtacgtgtttctgtgtgcttttcttcaggtcaacctcagtgagctgaaagcctttcccaaccctcccatcgcagttaccaatgttactgcagccgtgatggtccttctggctcctcggggaagagtgcccaaagaccgaagttggaaagcagctaaagtcttcatgggaaaggtatcagcccagcctggcaagatgaaaatcctgataatttccatactgttttcagtactgtggttatgcttaatagcaaaagatgtttaagtcagaagaaatcatcttcatagttgctgaatgtaatctactgtatatgttctctagacttacagcttttgtttgccaagttggaagttagcttggggttatggcatacctaagtcaatgccagcagcaggtggaaggttgctaattatttgcaaaattatgaaagcagttaagtgtaggagggagaaaatgacatggatttcttaggctggaaaaatgttgctaatgtataggaaggtgaagcacaggggatttttggtgtgttttttgctttttattttctgcctttcttttcttcaaaatgtgaatacctcctgtgctgggactgaatattttaccctgggatagaagaggttttaaaagtgtccattgctaattctgacttcgtactataaagactgaaaaagtcaaacagtaggataaatgcagcttgccaattttgcttttgtaatgtgagtcctaaaagctgattttaacttttgatcttggaattttctctgcagccaaaatgggttcattgcaataaatctttttgctttgcaggttgatgattttttgcaagcattaattaactatgacaaagagcacattccagagaactgtctaaaagtggtgaatgaacactatttgaaagacccagagtttaatccaaacctgattcgaaccaaatcttttgcagcagctggcctgtgtgcctgggtcatcaacatcattaaattctatgaggtatcaatcctaaattgattgtttacagatgttctccacaaagggctgcaaacacatcaatttctaggtcagcgagaagagtaaaatttgttatttcattttctgaataaggatatgtagttctaagactaagacatgagcatgttagagtaaacaattctctacaggaggatatttgaaatgttagaaactatctttttttgggcagagtgattggctcctttagattaaagagcagtaagtaattagatgaaaacttttatatgaattttacttatttacatttaaatatttaattcatgttgacttgaaacaactgcaaatctgaattcacatcaaatgaaatgtagcgcctgctctcaaagcaaatattcacaccatctgtattgttgacatagtgagatgaggaaataaccatttctttgctttagtattttaatgacaggtaagttttgtgcctatatgtgatctaacctaaaatttgtacttttcggcagtgtagagatagattatactttcatgtagtcatttatttatcaaatatttatcaccgaccaactgtatcccaagcactttgctgagtacttgatctaataagggaacaatgcatggctcacaactctgaagaactctcatttttgtcttagagggttgtatgttatattcaaatatggaattactgagaaaaagtcagtgtagtcaattcaattcccaaagtaattttcataaagccaggttatttcctttatactgtggggcccacagggataggactctcttgatctctctctctctttagtggcaatcttcataaggcaagagtttagacaggttgtggttgatgtacggcctctctgcataataaaatgtctcagccccgtcttctacttgtacagtaggtgaaaagacaagcatagagcttgactgtggctgcattctgtgtttattttgctataaaataggaaagaaaatttaatttccttcctctctccccaccagcagaaaaaaaattgatccacctaaattctcagatggtccattcaaacaacatgtgcttaaggtggttgggaacttagacaagaaagtgacaatgtggttgatgttgtgtggatatctcccaccctcctttctgtgttgagaatttttccacacttattttctgccttaaaggccagacatgatctcagcattggctatagttcctgcacaatgcaatttctagtaatatgaggcgtatcttcacattttatgacaaattgattttaatatcttaatggtgtttgacttatatcgcattttatgcaagtacttgtaactctaaggtccagattaaataagtaaaataatggtggaccagagagaatgtggaaggctatgtggattgtgctctgcctttaggtattaccatgtctgaaaaataacaggccaggtgtggtggcatacacctgtaatctcagcactttgggaggctgaggtgggaggatcctttgagccccagagtttaagaccagtttgagcaacatgagaagaccccatctcaataaaaaaagagaagttgctagatgaattagagattttaattgtaaagcatccatcctatctgggattgaatgattacttatcctctttgtatctgtattaattcatgaattttcaggtctactgtgatgtggagccaaaacgccaagcattagcccaagcaaacttagaactggctgcagctactgaaaaactagaggctatcaggaaaaagcttgtggtgagtgcaaactatgacattgaaaaggttcccaagaggtggtcgctgcctccaccttaggattccaccctcagacagcaccatatctgagccctatcaagcagaaaggaattcgatcttccatgagtgtatttccttatataccattcagtaggtatttcttatctgctctgtggtagatgctgaactgggaaagtgcaaatgttcatggtttctacagctaagaaacatttgcagtctgatagtggaaaggggagggcagcacatagtgattccaggtaaggcttctggagtcagactatctggcttatatcttggctccactgtttactgttgcatcccgtacaaggtagttaacctctatgagcctctgttttctcatctgtgaaacaggtattataataataagcatttctttctctctttctttctttctttctttctttctttctttctttctttcttttttctttctttctttctttctttctttctttctttctttctttctctctccttccttccttttctttctttctttctttctttcctttcccctccctccctccctcccttccttccttcattttattttaagttccagggtggatgtgcaggcttgttacacaggtaaatatgtgccatggtggtttgctgctcctatcaaccaatcacctaggtattaagcctgtcattcattagctatttttcctgaatagtgtccatttcttaggtagaactgtggggatttaaataagagtaattcatattaagaatttaccatggtacttggcacatagtaagtgcttagaaaatattttcggctcggcgcagtggctcacacctgtaatcccagcactttgggaggccaaggcgggcagatcacgacatcaggagatcgagaccatcctggctaacacggtgaaaccccgtcactactaaaaatacaaaaagaaatttagccgggcgtcatggcgggtgactgtagtcccagctactcaggaggctgaggcaggagaatggcgtgaacccaggaagtggagcttgcagtgagccaagatcacaccactgcactccagcctgggcgacagagcaagactccgtctcaaacaacaaaaagaaaagaaaatattttcaatgaatattgtatgtactactaaataccactactgtttttacaaatatgtaaaccactcatcctagtccagcattatcaatatatatgtggctatatacagaaaacaccatgaaataccgagcccgaagaaattagaggaagttctttagtgaaggtggatcgacatgggctttagatgttggttaggaaccaccaggataactaggatgggaaaggtgttcctgacagaaggcaaggaaaagagggaaggagcagttgggacacttgaagtgtccagcaagtcagagccctgcaatgaatgttttggcgagtatgagggaatcatgaacagggaaatcatgaaagatgaacttgcaaaggtgagcataggctttctttgcctttcacactacagaatttaaattttatccgattggtgatattaagcctttgaaagattttaacaagttaatgatacaaccaaagtgaatggatgctggaagaagaaaagaacctagaggcaggcagacaagttagaaagccactgtcgtgaatcctgttatggcctcagctcaggcaggagcagtcatgatggagggagagagattacgttcaaggctggctgatgagatacagagagacgggaggaatacaggagcaggatgaggagcgtgaggtgcctggcagggcagccagcagagtgatgaggcggcacaaccctggcagtttacagaaacccctggagcttcagtttctcatctgtcaagtagtggtaacagcaactctcaaggtggccatgtgtgatttggggctacccagcttccagtctgccacctttgagtgaaaacagcttgattttctttagggaagaatctctctgcattggatgcactcaggtgaggcttttagcaggagtgaccttgccttttcaaggactagatatatgatccaacctttcgcaacttgatcccccatctctagagtttaagtcatgagcaaaaggaataaaagactgaaaacagagtgcatacattgcaaagatagtgtcctgatgagacttgtaaacagctcctgctcccaagaccctctggagcatcttggtgcctgtatgtggttctcagcctttctttccctcttaagagctcccccatctacttcgggcaagctccttcagcttacattagctagaagggagtaggtatttctttccatcattcccacctatgattcctgatgcattaagatactatttagtgtgcaacatacagtagacacttcataaatcttagttcccaccctcttcctatagaaaaatccatatgtaagtgtgccgcagtcatgactggagtttgagagaaaagtctgggtcaggaatatatagttgggaatggttggtgtgttagtctgttctcacattgctataaagaaatacctgatactgggtaacttacaaagaaaggggtttaattggcccatgattctgcaggctgtacaggaagcatagcagttcctgctttgggcggggcctcaggaaactttcaaccatggcagaaagcaaagggggatcaggcatcttacatggcagaagcaggagtgacagatgggccttttttgtgttgaggtatgtgccttccatacctagtttgctgagcatttttatcataaaggggtattgaattttgttgagtgtttttttagcatctattaaaatgatcatacagtttttgttctttattctcttaatgagatatatcacatttactcatttgcatatgaactgttcttgtatccctgggttgaatcccacgtgatcatgctgaataatcttttcagtgtgtgttgtattcagtttgctcgtattttgttgagaatttttgcatctgtcttcatctgagatactgactgtagtttcttgctgtgttcttgtctagtttttgtgtcaggtaatgcaggtctcatcaaatgagtgtggaagtattccctcttcaattttttgaaaaagtttgagtagaattggtattattcaactgtttggtagatttcaacagtaaagccattaggtcctagggttttctttgatggagactttttattattgcttcaatctcattactcattactggtttgttcgggttttctatttcttcatggttcaatcttggtagagtgtatatgtgcaggaattttttcatttcttataggttttccaatatgttggcatatacatgttcatagtagtttctaatgatccttcatatttctgtggtatccgttgttatatatccattttcatttatttttttatttgggtcttctctcctttttttgctttataggttagttgattttgtttatcttttgaaaaaatgaacttttcatttcattgatattttgtattttttagtctcagtcatttatttatgctctgatttttcttatttccttctaaaaattttgggtttgatttgttcttattattttagttccttgaggtgtatcattagatttgttatttgaatgttgtttatttttctatgtaggcatttgatgtattgctgtaagcttctctcctagtattgcttttgctgtattccatagaccgaatatattaggtttccattttaatttgtttcaaaatatttttaaatttccttcttaatgtcattgaccaactgattaggaacatgtttaattttcctgtgttcgtatagttgccaactttcctcttgtttttcatttctagttttattccattgtgatcagaaaaggtacttgatatgatttttacttttttgaatttgtagagacctgttttgtggcctaatatgtggtcagttctggagaatgttccatgtgctgatgaaaagaatttgtcaggctgggcgtggtggctcacgcctataatcccagcactttgagaggctgaggtgggcagatcatgaggtcaggagattgagaccatcctggccaacatggtgaaaccccgtctgtactaaaaatacaaaaattagctgggcgtggtggcacgcccttgtagtcccagctactcagaaggctgaggcaggggaatcacttgaagctgggaggtgaaggctgcagggagccgagatcgtgccattgcactccagcctggatgacagagtgagactctgtctcaaaaaaaaaaaaaaaagaatttgtattctgcagctgttagatgaaatgttctataaatgttgcttagacctatgtagtctagtgtttagtttatcattaatgtttctttgttgatttcatgtctggatgatctgtctgttagtgagcgtagggtgttgaagtcccctgctattactgtatttcagtctatccacttagatctattcatgtttattatatatacttctttctttgaacaagctttctacatcttgctctttttaaactccctcttgaactccagtgactgttagatgtgctcttttgaggtcattctctgtagacatttgtttgtttcatcatttttccttttttcacctctgtgtattttcaaatagcctgtctttgaaattactgattctttcttctgctttactcattctgctctttaaagcctcaaattcattttttacttcagcaaacgtatttctcagttccaggatttttaaaaaattatttcaatctcttaaacttctgataaatttctgaattgcttttctgtattatcttggagtcggctgagttttcttaaactactattttgaattattgatctgagagctcccacatcatcatctcattagagttggtcattcgctccttgctttgtttatttggagaggtcatggctccctgtttgctgctgtctcttgtggatatacttctatggctttacattgaaggattagttatttatgctagtctttgctgactggcttgttttggtctttctagagtatgtttgcttagaggttatttgtagtcacctgttgagttccttaattctagatcactgcttccttttcagcactatatggaacattaagctcaggtttgccttgactcttagaaatgcttgaagtactgaccatcctgaattgagggtaaggggccccaagaagatactctggctttgtgtgaaagctagctgggggtttgtgcccagaagacccatggagtgtgccttgtacagtgtggtgctgttgaacagccactctgatttggcatctcctttgactgagatgaagaagagaatttcatgggctggagttgctagtctgaccttccctctttatcactagatgctttcagggatttttgtctctgtaggcacttggaatacttcctctgggttacggtaaaaagcagttttcttgcaagggaatgtaagatggctgagtgggaaaaatggctgtccacctcagtctcactttctccagtgtaggaactacgagtctggggggcattttctacgtgcagtacctgagtagattttggtaggggcattgcaaatagggacgttctttcttctgctgctcagagttttttacctctctgtggctctgggtagtgtctctgagttccaggatgttgctggtgatagtcttagcactggatatttgttttgggttttctgtaggggagagtgaagccagattacttccactctgcctttctggtgacatccctttgtgttctcaaacttttgcacaacgattcttaggtaaaggttaattttttttacatttaacatttaaaaatgtaaaatccattctttactcataggccacacaaaaccagttggctgctaggtttggtgtgcggatcctagtacctagtacctagtgggtactgacctttgctgtgtactaatactgaaagctatttgggatctggtactttatcatctgctaattctccctgttctcctagatcaagcttggactttaggggaactccttggagaaaatacttgatcagtttccctgttattccacacaccctacacatcagtgtacacctcatcctaacatgcgaactctcatttcctttctgtcttccacactatgagctccttaaagtcttttaactttttatgcctagcacctgacacatgagaggaactcaaaaactattagttaaattaacaaacagaaccatattttatattttaattaaaaggtttatttgttctagttgaaggactcactttccttttagcaatcaacgaacgttttgtaacactggactaggcactggagtcagagggacacagaaggctcagtccctgccctgaaaaatcttacagatttactaaatgctgtttaatttgccaagtgctgccaagggaggttgcattggctaccactggagcacaaagaatggagttggtcagttctgcacgtgaggatggggttgggtgctcaggaaaggtttggaggagcagtttcctcttgaatccagtcttaaaagatgaataggttttcacccagaagatagggaaagggcatttcaagaaagagggtcacgtgtcctgtggacagtgagtacctcaacatgactgaagagtagagtataaatgtcagtgtgtggggtctcttgtggtgaaaagtgaggcagggacatgatcacacgggaaattgcaaggtgttggttaagaggtaagtgtttgtcctataggccagaatatactaagctccctaatattgaagactcttcttaatgccaaaaagagtccctgacagtcatgaatagtagttgtattttcttttaaccgtgttatagacaatgattaaggcaaacgtagattcagtgggccctagcagaataaactagccccagtagggatctgtgagccatatatgagaactgccactgtcagacagggagagcaattgaagaactgcagttgggcacaggagggataaatcgatcacatttgccttttggaaagatagctgtgggccaatgaacaaaggggaagagactggaagcagaatgaacatggatgagggaagcagaatgaaaacaaaagaaagtcaaggagagaaacttgggttataaacagtttataaactgggtacagaatgatgatatctgaaagagcaagaaaaagagatggttaggaaggtgaatgaggagccagaagagattgttatcatggcggccaagggagggaagggaaccatcacctggaacaaatagtaaagaggccagataccacagtgcatctgagcataggctgtggggccaaacatcacgtgttacatcttagcccagtactttccatctttgtgagcttgagtaacatttttgcctcatggactctctaatttcctcacctataaaatgaaaaaatctctctgagacttaacgaactgatcaaatgcattaacacatgtcaaatacttagaatagtgctgggtgcttgctagaggatcaataactgttagttgttatttttttattttattttttttacaaacaatgattagtaacttgagagaataaagtttgtttatcagatcacatgtttcagtaaaatggtagagaagaacaaagaaaaaagtgataggaatgaaagtcagattaaaatagatgaaggagagaatgggtggtgagaaaagaaaacagcaggaatagagttttctatagagaaaaattttttgaaaacaaggagaaaggtacaaacaatattaagagtccctcagaaaatattttggaaacttaatcttacttattttagagtaaaatcatcttgatgattatatatttgctttgaacttttttttttttccttttgagacagagttttgttcttattgcctaggctggagtgcagtggtgcgttctcagctcattacaacctccacctccgaggttcaagcagttctcctgcctcagcctcccgagtagctggcattacaggcctgcgccaccatgcccggctaattttgtatttttagtagagacggggtttctctatgttggtcaggctggtctcaaactcgtgacctcaggtgatccgctcgcctcggcctcccaaaatgctgggattagaggcttgagccaccacacccagcccttgaactattttttctagtacatgtacagtttacatatttatgtttatattaactgtattcatgtgagacactagtgctcctttcaaatctctgaatacacataaaacagtcagtgtaagctcaaatcaacaattagacattcctatgaaagtagtagattgtcacctttaagcatgcttggaatcctggctattataccaggttagtacttattcctggtgaacattcactcatgcccttaagagttacatgccaagggccaacttttacccaaacatttgccattaagttacgttttcattcaatgaaaaaaaggaaccaaagtgaatttgtatcccatttgaaataaactccagtgatatttgcacaccaagctaacttaccatgtgcttgctgaatgtgctgtgccatattttacatgcattaagacacattttattccatagcacacctacctatgaagtaggtattactaggagtagtcccattttacacatgagaaaatgtaaagctcacataaagtgaaaaatgagtccacaccaccagggtcagtaagaggcagaggaactagaaccaagacattcattcattcatttgagacagtgtcattccgtcacccaggttggagtgcagtggcacgatctcagctcattacaaacttgactcctaggttcaagcaattcttgtgcctcagcctcctgggtagctggattacaggcttgtgccaccatgcccggctaattttttgtatttttagtagagatggagtttcaccctgctggccaagccgatcttgaagtcctgacctcaggtgatccacctgcctcggcctcccaaagtgctgggattacaggcatgagccactgtgcctggcagaaccaagacatttttaaactcgaagatggatactcttaactatacagtataccatgtgtgatttgactgggaagcctggaagtatttactctgtctcttcacaactggaacttctcaaacatctattttgtgaaatgccttccattaagttggtccaggactcagaaggtttgggttcatagccttgttttttcactcacttgctagtgaaactttagcaaatcactcaactgatctttgtctcagtttcctcacctgcaagttatataaggcattgtctgctttattcaccttcattctccagcaagcatacagcagagtttttcagctgctgtatgacatgcaacacctcaacagattgaatgcaatagcaggtataagaatctaacagtcttctgttaaataagtcattaaaattaggtttgcaaaaatctaaatgtcatttttaattatttttgttttgttaatattgttattttaataaaattatgctaatacatggtgagcttattaatattaaataaataaatttttaaatttttttcagttttaacttctaataccacaaatattacttgatatcatctgtatgaaccagtgccctttagggttctgaatgtaacagagttttgaaaccaaaaattttgagaaccattgccttctactgtcctagatattattctataaatcatcaaaattaatcctcaaaaaaacaccctttgagctaggtaacattattaattccatttttaagataatgaagctgaagcatagagaaggtaaataaatagccccaacttgatactgcttagctggtagcagcatccaaatatcaacccaaggagtctgataccagagccttcgtgtgcttctgtgcttggtaaaactataagtactcttaataacccagaatagacctgtaatatttttacttcaatcttatttcttttttttttttaagacggagtcttgctcttgtttcccagactggagtgcaatggcatgatctccattcactgcaacttctgccttccaggttcaagcaattctcctgcctcagcctcccgagtagctgggattacaggcacccgccaccacgcccggctaatttttgtatttttagtagagacaaggtttcgccatgttggccaggctggtcttgaactcctgacctcgtgatctgcctgcctcagcctcccaaagtgctgggattacaggcatgacccaccgcacccggccatatttcaatcttatttctaactggtgatgtataatatctccatcaattctcataaagttaatgctattttgcatattaatcttaaatttgatgtatatacatatttgtgtatatatacatattgctttagcaatataaagtaatggtgaaataactgggtcatcgacaaatatagtctgtctctaaattattaatagattatattctgtaagttttcttgttaaagtttcttggaactttgcatgcatctacaaaagcaatgctataaatcttattaggtttcttggaacttaatatgctagcaagataccatagtgaggagtctcacaagcatttgacaacttagtcaagactttttgtctataagttatatgagctcattcaaaataccttagtcaaaaaaggcacaaagacaaactcatggacaaaaggtgaccaggggacccaagagatccaggaaacaagaagctgccatgaacttctcttggagtctctagggctgtgtgacttctcatcttgcttctcttttacatccctttcgtccttctctctttctccacaatggttttctctggttttttctgtgccccagtggaaggtgttccctctttaaacgcagccctgtgattcacacatcctcccaggtctttcaatgctaaagacaatggattatctctgagtttcagtccctacgtccagaagagaaaaatatgggtcaggcacagtggctcatgcctgtaatcccagcacttggggaggccaaggtgggtggatcacttgagaccaggagttcaagaccagcccggccaacatggcgaaacctcatctccactaaatctacaaaaattagccgggtgtggtggtgcacacctgtaatcccagctactcgggagactgaggcgcaggaatcacttgaacctgggggacagaggttgcagtgagctgagattgcaccatcgcatccagcctgagcaacagagcaatactcattccaaaaaaaatgaaaaagaaaaatccgattggcgaagctgggtctaaagggctcagtaattaacacccctcttcactgcctgaactatgaacccaaagagaaaagaatccgtgggtggagaaaccaaacaagtcactgttgtctttaataaagctggttggaggatgaggcttgggtgcaagagcagagggggatgatagtgcacccacggcgtatttgcatcttcagcgcacatccattcaccccagtcgctccctgcattctgcccagtggaggcagaaggggagagaagaccacatcgtgaactgttagttcatggtggcactgatgtgtttatttcattatatccttcttttccttcttccctaaaatacgtatggtaaaggggcaaaggttaatggggggaagaggtttgtccatttaccttacagtaacagatgttttaagatgatggtaatctctctgttttaactaaaaatgactcaaaagttaattcaactctgattcaggatctggatcgaaatctgagcagactcacggcttcatttgaaaaagcaacagctgagaaagtccggtgtcaagaagaggtgaaccaaaccaacaaaaccatcaaattagctaacagacttgtcaaggaacttgaggcaagttaaaccttttcttccaaacattctaactaaaatgttcagatcagcttgtggggattttattatttgccatcaataataactaaatagacatggaattaacaacaaaggataatatttgataatcactcatcctgtggctctaactcaccagaaggaagaaatgttcaagtacatatcttttaatttatagtcctgaactcaatgtgccatcagtctgatctccaacgaaaacagggaagacatatactttatcagaatttagtggtcttgtatccactttaagacaatggagtacatcagctgtgggtgggttatgtacttattttttctactttctctcttcctttctttcttaccacattgtgaaatcctttaaaaacaaaaataaagcatgtttttcttaaaacaagttataaaactcaggatggctgctagataattatgaaattgaactgtttgttgtctgatccttttaatatacatttgccattgaattctaccagcaaatgatttctttcaagttaaacctggttggtttatgtttttgttgttacatctttttatgggtgactgacatgctaatgttaatagttattccattagataaaggttttttataattcttattgacattctcttgcttgaacatgagtggtagaggaacatacgttctttgatatcagtattcacagattttatttgctccacaacgtggcatttaacagttctggggaaatcactgaacgtcttcaactttgttttcttgtatctaaaacagggatgtggataacgtttcccttacaaggttgtgatgattctcaaaagacataatgtacgttcaagtatttcctaacaaaagtcaaagagataaataaccaaattttaaaataagaaaagaatttgaatagacatttctccataaaagatatgcagatagccagtaagcacctgaaaagatgctcaactccattagtcgttagagaaatgcaaattaaaaccacaacaagataccacttcataaccaccaggatgactataataaaaaatatggacagtaatagtattggcaaacgctatggggaaatgctggttggaatgtaaaattgttctgcgtctttggaaaacagttctgcagttcctcaaaacgttaaacataaagttaccacatgatacaatcatctactcataggtatataccctaaagaaaagaaaataaatgtccattaaaaagctcatatgcaatgttcatagcagcattattcataatagctaagaatagaaacaacccacatgtcccttaattgataaatggataaataaaatgtatatccatataatgttaatagcattcatctataaaaatgaatactgagtcatgctacaatgtatgaatcttgaaaatatcatgctaaaagaaagaagccagacacaaaaggccacatatcacatggtatgtgatatcatgtgatacacaggcagaatgtgcctgtgtatgaaatgtccagaacaggataatttatagacgcaaaatagactaatggttgccaggggctggacaagggtgtggggtttggggagtgactactactggatacatggtttctctttggggtgagagaaatgtactaaagttagctagaggagataattgtgcaagtctatatatatataatatatatatataatgtagtaaaaaacactgctgtatattttaatgggtgaatttcatggtatgtgaattatatctcaataaagcagttactttttaaagtataaagtctgtaactacactattagaaagcatataacatatatatctaaaaagtaataaaatgtgtaactaaaaagtgtataattgcattattagaaatgcctttagctgacaagcatagaactgcactaaaatatgtaactgcactattagaaatgcatttggctggaggtgatagaaaacttttacagtggctcaaacaaatgggagcttatttttcacatattacaaaaaatgctaaggctggaccattatcagtgttgatcctggtgattagtgatcagccacctaggctctttgttgccctctgcctctccacgctcagcaagtggacattcaccctcatgcattttgcctcatggtctcaagatgtctgctacaccttcagattcaaagagacagtagagaaagggaacaatctgtatcagctggggttttctccttttatgagaaaagctgatgtttttctggaaatgtctctgacagactcccacttaagtttctttagtcagaactagataaactgctaactccaccccacacctcctgcccaaaaaaaaaaaaaagtctggaaaagtggggaatggggctatcatcattgaagtctggaaaagtggggaatggggctatcatcattgaagtctggaaaagtggggaatggggctgtcatcattgaagtctggaaaagtggacaatggggctgtcatcattgaagtctggaaaagtggggaatggggctgtcatcattgaagtctggaaaagtggggaatggggctgtcatcattgaagtctggaaaagtggggaatggggctatcatcattgaagtctggaaaagtggggaatggggctatcatcattgaagtctggaaaagtggggaatggggctgtcatcattggcttagcaagccaccgttcatctcatgggactgggcacacgaccatcctattcagattcagggttctcttagcaagaaacgagggggtacgtgtttcgggatggctaggtgatagcctcatttcttgtagtagttttttttgttttgttttgttttgttttgttttgttttgttttgttttgagacggagtcttgctctgttgcccaggctggagtgcagtggcaccatctcggctcactgcaagctccgcctcccgggttcacgccattctcctgcctcagcctcccgagtacctgggactacaggtgcccgccaccacatccggctaatttttttgtatttttattagagacggggtttcaccgtgttagccaggatggtctcgatctcttgacctcgtgatccacccgcctcagcctcccaaagtgctgggattacaggcatgagccaccgtgcccagcctatagtacatttttaaaaccctaacttattaccacaaatttaactaattcaccacaagtttaaatacactatctctctgaaatgcatagttcattatgcaaaaactcataattcaccctgcaaatcccctctctccattccatctcaataactgcaattctgttcttccagtttttctggcccaaagcttttgaatcacccttgactctgtgtgacatcaaatccatcagatattctattgaccctgcctttcaggttcattccaaatcctagcacttctcattctcttcaccttaccatgctggtccaggctgtggcatctctcccctagggtacctctgcaggccccaccattacctcctaaagcttatttccctcattgtagctgggtgatattttacaaacttaagtacattcacatcactccttcactcagaactccccaatagctaattaatcactcaaagtccagcctaaaggctttactgacctgcaaggccctacatgataatctgtctcctggatacccctctgtcctcacctctgccacttctctcttgccccatcttcactggccttctgtctctccctcatacttccaggcacgctccttctttgtgcgttagcctttcccaggcagtcacatcactggctcttcactttgtcaggccctgctgaaagttctcattatcagttggttttctctgacctccctacataaaagagccttcatccaacacacaagacccccactcgttcacacgcacacatacatgcacacatatgcatctctattttctccacttgctctgttaacattttttgatagcatttattgcatgaacgtagttgtccgtgtatgcatacgcacaaatactttttttggtctttttttccccaactgaaatatgagcttcgcaagaacaggaaacttcaccattttttgtggactgcttgatcccaagcatatagaatagtcctggcatgtcataggcatcactagatatttgctgaatgaatgagttactaaatgggtgagttttgggagcctcctgtattaaaattctggagccttttgaagacttgctcttcttaggtgagttgagaaatttcaccagtactagtacttaaaactacttccatttaaagtagcaagatttaagcagtttgaagagttctccatttgtgaggtacctgagaaaaactgttatataattagactgttttccgggactagttacagaatgtctgaaagttttgtcaagggaaaagtaggccctaccatgtgtgtctaacatatagcaatatttccaaagactttacttactcatgatgatttagacaaggaagggaaaagaaaattgtatcatgttaactaaggaaaaatatatatttttaaaggattaattgaagatgtcagatctttttctttcaggataaattctttctgactagaacaggagacagttaacttctgaaaaacatcaagactgatgattttgtctatatcgcattgacctggaagctcagccattcagactaataaatcaggcaatttatatttaatcattaactaactcctgagctgagcagctgttcaaaattagaaatgggtcaccccagccaggatgacattacaggcaatctataatgcattagaataaaattatagtgatttttaactgtcttgaaatttattacaggacatgttccaactcttaaacccttgttagccaatgtcagtaatgatttatgttgcatggatactatagcaaaattattgacgatttcgatagccaatcagtctatgtttagtgaatcttcaaatctcaaagctgttttggagaatgagttggatacattttattgtttatcctttacaaaccaaaaacaacaaagatagagggtaggtgaatgagagattcctcctgaaaattaatgcatatgttgtctatggctgaggaacaaaagtaataaattttataaagagggctagagagctgaagttccttagtgtttaattatatagttaacttggggtgatctttaataagcaaagcagggagatgatcttgaaaccactttgataaccattttcacatgctaatttcatgacctccgacctcagggttgtagatattaagatagcttgcagggaactggcattccaatccattctgacgtcatttttgttttctgtggtcaatctactttcatggggaaagcaaaattccatagggtgcttctttgcttgtactaacaaattgctgattttttttcaggttctattaatttgcatgttcttaaaatgtatttttagcgtacattgaaacaaaataaattagtgaactaccctgcagttcagtcaatccatacatatttattgcagttttattcaaatccaatattaagggcttcacatacttaacctgtaaatcagattttaaatggccatccaactagctataaggacttcaacagcattcttggggagtattgtgaagtcctgatttccacctttttatataggtcatagcttcctccactgatttaatgattatattagaaaactaacctgagtttagtaactaccaatgctactctttaattagtagaatccaggatagatggctatttcagctttatgttttaactaattaagtagagttgtgtttgtcatttccctttgtctgtaatcagaccattgccagcatgttaaaaataggtaagtaaataaaaagtttgactagggcagtgtagtgggaagaatggagagcagccaggctgacattaaaaatcctgacatcaggccaggtgcggtggctcacgcctgtaatcccagcactttagaaggccaaggcaggtggattgcttgagctcatgagtttgagaccagcctgggcaacatggtgaagccccgtctctacaaaaaatacaaaaatttgccaggcgtggtggtgcatgcctatagtcccagctacttgagaggctgaagtgagaagatggcttaagcccaggaggtaaaagttgcaatgagccaagatggtgctatggcattccagcacgggtgatagagccagaccctgtcaaataaataaataatcttaacatcactcgttcttggccacagctcttggtcatcttccattcccagagggacaggggagagactgtcagcctttcaagaaggacctcaatcataatggaagagttgggatgtccagtgagaagagatgttaaagaactaatgtcactttgtgataaactccactgaggagagtatgagaactccatcataatgatggatttcaaacacatgaaagattataacagtcacaccaacccgttacactctgttccttatagtgactgtgtggaaggacgtaaaccttgccataaggtaattgcattaagcatttgtggagttgacattcagcctgcaattacagctgagtaatttcatctttcagtcagagaagattcgctggggtcaatccattaagtcctttgaagctcaagagaagacactctgtggagatgttcttctcacggcggcatttgtgtcttacgtcggacccttcacaaggcagtatcgccaggagctggtgcactgcaagtgggttccctttcttcaacagaaggtaagttcagttccttaccttgtcagcaggtagaaagatcacattgaaatttcagtagtaaaacccacatatatgccaggcgcttttggacgtctgtaatgagaactgaccagaaattccatggtgaaattgtttctcatgtgctgcagtttttcttatttttacaaagttcataataaatatttcattatttttaaaaatgtttttattgatctataatactcatatatatttttggggtaatgtgatagtttgatacctgtatacaatgtgtaatggtcaagtcagagtaaataagatatctatcacctgaaacatttattttttctctgtgttaagaacactataattcttcctttctagctgtttgaaatatacaataaattattaactacagtttccctactgtgttattgagtactggcacttatttcttctatctaactgtagttttgtacctactaaccaacttctctgcatcccctctcctccacttccctccctctggttctctggtaaccatcattctactctctacctccataagatccacctttttagctcccacatgtaagaacatacgatatttatctttttgtgcctggtttattccacttaacataaagtcctccagttccatttatgtggctggaaatgacaggatttcattgtttttatggctgaatagtattccattgtgcatgtatatcatgttttctttatctgcccatctgttgttggacacttaggttgattccgtgtcttggctattgtgaatagtgatgcagtaaacataggagtgcaggtacctctttgacatactgatttcctttcttttggatatatgctcagtagctagattgctggatcatatggtagttatttattttttttgaggaacctccatactgttttctgtggtgactgtactaatttaaatttccaccagcagtatacaagctttcccttttctctacatcctcaccagcatttgatatttctgtctttttgataatagccattctaactgaggtgaaattatatctcactgtggtttggatttacatttccctgatgactcggtgatgttgagcattttttcatgttacctattggccatttgtacatcttcttctgagaaaaatatctattcaagaactttgtccattttacgatcaagttttttgctttatttgctattgagttgtttgagttccttatgtattctggttattgatgccttgttgggtgaatagtttgcaagtattttcttctgttctgtagattatcttttcactctgttggttgtttcctttgctgagcagaagcctttagcttgatacgatcccacttttgcatttgtttgtggtcttaaccaaaaaatctttgcccagatgtcctgaagcattttcccaatttttcctatagttgttttatagtttcaggtcttatatttaagtctttaatccattttgatttgatttttggtttttgttttgttttttgtttgtttgttatattttgtttttttgagacggagtttccctcttgttgcccaggctggagtgcaatggttcagtctcagcccactacaacctccgcccccgaggttcaagtgattctcctgcctcagcctcccaagtagctgggattacaggcacccgccaccacacctggctaatttttttgtatttttagtagagatagggttttaccatgttgcccaggctggtctcaaactcctgacctcaggtgattcacccgcctcagcctcccaaaatgctggaattacaggtgtgaaccactacacctggcctgatttgatttttgcatatggtgaaagatggaaatagtttttcttattttagtgatggtttcaacaagaacataaaaattaattatgtaaactttagagttatagttggaaaagtgctttaaacagaagtgataactgaaatcaaactcagatcatcatgttattgaatagcatgaaactttttgttttcttactaatattatgggttatttgttaaagatttttaaaagactactttcagacttaaagtgtagcattttatatgtaagtataaagtagcttaccctaaatttgaaaattcaaacccataagcaaagtgaagtaatagatttgcacgatgtaaaatcatctagtttaagatactccttgtacaaatgagaaaactgagacagacaaatgactccacttctgtcatagagaatagaaaatcagacctcctgatttccaggactctattttctatacaacactgtcatctcagttgattaaaacagattcttagtttatatatccagccctttctggagtatggagacaaagatggacatgggcacagatattattagaaaattgaagcactcacacctgctggtctccgttactttagggaagtaggaaaatgcagtgcaagctggccaaaccaaaggaaattgaaatcaggagaacagttttgaggagagtggtaaaaatatcaaaaatacctgtgaagggcaacaggggagtagatggtaagagtcgccacacagctttaagaaacccaagacgtatttggacaagataagtttataatcacagtaataaagctttcatcagaatactcaaagtctaggagtaaaaagagaggaaagagaatgccaaatctagccaggtttataggcaggtaagccagaaagaaaggaggtgaggaaagtcaagcagtgactagcagaagagttaagaaatggaaggagcattttaggctgaaaagagatgggaggttagccagaagttagtgttaaaatatggtaaagtttcccaaaaccttaaacacagaattgccacatgatccagaaattctacttctcagtatataccccaaagaagtaaaagtaggaattcaaacacatgtttgcttgccattgtttatagcagcactattcacattagccaaaagatggaagcgattcttgtgtccatggacagaacggatttttaaacatacggtataaatacacaacagaatgttattcagcctcaaaaatgaaggaaattctggtatgtgctacaacatggatgaaccttgtcaatattaggctaactgaaattagccagtcacagctggacctggtggctaatgcgtgtaatcccagcactttgggaggccatggcgggcagatcacttgaggtcaggagttcaagaccagcctggccaacatggtgaaacccccccccctactaaaaattagccaggcgtggtggtgggtgcctgtaatccaggctattcaggaggctgaggcaggagaatcgcttaaacccaggaggcggaagttgcagtgagccgagatcgcgccactgtactccagcctgggtgacagagtgagatgccatctcaaaaaaaaaaaaattaagccaaaaggacaaatacttcaaactttacgagggacctagagcattcacattcacagagacagaaagtggaatggtggttaccaggggctggcagagggaggaatggggagttattgtttaataggtatgtttcagtttgggaacatgaaaaagttctggagctagataatgatgatggttgtacaacaatgtgaatgtacttaatgccacttgaactgtacacttagaatggttaaaatgacaaattttatgttaagtatattttaccacagtaaaactgtaaatagtagggtaaagtcctggtgtcttaatagtatttagagtaagtgttatgtttaaagatgtgaaagagatgtagacaatcataatcaaagagttgggtacaggaattttaggtttcaatgatgaaataatttcagattgttacaaagcctgggactacatttcccatcaaaaaaggaggtactctaatacccctccaaagacatatcaccatcatggggggtggggatgtgcatatcggaagccagggatgggggtgttgtataatcttcccgggtgattctgatatcatccccttcctcccccaattcccccaactggaatagaaaggaaatacagtgctttaacatgaaagatgtcaaggccagagagtggaatcatcatctacatgggcactgaggttgtcaaggattgatagcagaacttggaaaggcgagaaagaccaatagctatatcattcataagatggggaaatagattggagattgtatatctggagtccatgggtcttaaaggtggcattttgacttaaggatggaagaatcatgatttgggttgacttgcagggaagaaagaggaatagcaactctttcccacacccacttttcagtaatgggattaagaaaatgaactgtccgccgggtgtggtggctcacgtctcccagtgctttgggaggccaaggcaagaggatctcttgaggccaggagtttgataccagcctgggctacacagtgagacactatctatatgaaaaaaaaattttttttaaacccagccaggtgtggtggcaaagaggctgaggagggaggatcacttgagctcaggagttagaggttacagcaagctatgatggcaccactgaactccaggctgggtgacagagtgagaccttatttcaaaaagaaagaaaagagagagagagaggtgggaagggaggaaaatgaactctttccacttcagaaggccctcaagtgaaatgagactctagaacaatggctcttgcaccccagcctcctgttaaaatcatgtgagagggaacttttgaaatgcattgatgcctgttgatgctgaatcacttgggggaagggccaggcctgttggcagctttttaaagctctctcataagtccagtatccagcctggggttgacggccattacccttgggggagagcctggttttgcttaagacaagcaggtagagaagataaggcaatttggtccaaacaagactaagatactgaagggtatgggggaagggttgtcagaaagtacaaccatggggcatgagtttgagggatgggacagggagcaaacagtaacacagagggtagtggctgaaaaggacaggggctgtgggcatacatggccttgagggttcaaattacactgttttccaaagttgtttccatccaaagttgttgtttccatccaaagttgttgtttgctgggcagatggacagagtcataggcaagttcaaggcagcctttgcactccactcattgctttgacccagcagtttatagacagagcaaatacatggagttattagtgccaataattagttattagttattaattagttattacaagcactaatgctaagcctctgtgtcctaagcaataaaatagagatatctaccttgcagaactcttgtaagggttaaatgaaaaaatggaaagaatgaatctatatgaataaattttgtgaacaggtaaagccttacataaacatgagttgttacgttactgtaacattaggagaaactggcagtattacctccacaggaaattacccttttttcttaggaatatgccagttggtcagtttttagaggccagatgggcatttggtgttataactaatttcactttggctcgtggcgtgtgcttccagccttgtcttttctctctagcaaatgcttcttttccaaagagtgagcctccttttttgtttcagctccacctcatagtaacatcctgactcacaacatgttgacactacttaatagagcaattagatggagccttacaacagtctgactctagaagcagactttgaacttaaagggttccctctttgcacgtggtttccaaacccattttccttgctgcagactccaagaaattctgaaaagacaagttaattgtaataaaaagaaggtatactctaatatgtcacttaatgaaggggatatgttctgagaaatgtcttttggtgtacttgcatagacctagatgagacagcctattacacacctaggctacatggcatagcctattgctcctaggctacaaacctgcacagcatgttattttattgaatgctgtaggcaattgtagcacaatggtaagtatttgtgcatctaaatctatccaaatatagaaaagatatacaaaaaatatagcataaaagactaaaattggtacacctgcatagaacacctatcgcgaatggagcatgcagaactagaaattgctctggtttagtcagtgagtgaatgtgaaggcctaggacattactgtatacaactgtagactttgtaaacactgtacacttagcctacacaaaatttattttatttatttatttattttttttttatttttttatttttattttttatactttaagttttagggtacatgtgcacattgtgcgggttagttacatacgtatacgtgtgccatgctggtgcactgcacccactaactcgtcatctagcattaggtatatctcccaatgctatccctcccccctccccccaccccaccacaggccccagagtgtgatgttccccttcctgtgtccatgtgatctccttgttcaattcccacctatgagtgagaatatgcggtgtttggttttttcacaaaatttatttttaaaataatgtaattgtactacagcattatgatggctacagtgtcactaggtgataggaatttttcggctccattataatcttatgaaaccactgttgtatatgcagtccatcattaaccaaaatatcatatggcgcttgcctgtatatgaaatgatgcttattttcctcaccctacacttaggttaatattaatgtgaaaatgatgcctgtattataactatcaaaaaatatttttatgaaaaaaattctgtatgtagctatgctgctggttatttggacacaatactatcgaaacatcctaaaaatttgagtctcaaagtagtcactatagttatgatattctttaatgtaggtgtcttcatttatattaagatgggttttatttcttcatttatattgaactgggttttatttcccctactgagcaggaaaaaagggggagattggtattctgtttgatccctggctctctactctgcacagagtaggtactcaaactatggattttggatatgagatctgcaggtgccccttctgttagtccttttagcttcagaaatcaaagttacagcccccaattgtttcagctgtttgtattaagtagaaggtaacaaactaaagcacatacctcttgcagatagaagattgcttattctaaaagatcaaattgcctatgtctctaagggaactatgtatcaagtcagatatcaagacttgttcaatatcactcggagatagggtttgattcatttttaagataacattgtagtcagaggcagtaagaatattgtgctacttttcctatattcgtatcaaattgcatcccagccttaatgtgggaatcctttcagcattttgttttgaagctctgtgacaaaccaatgaaccaaactgttaatgctgatacagcctcccctacctactacaggtagggttcttactacagtctcttatggaggcatgcttccatgttaaccaccccaccaagctagggggctagctaggttttcatcctgcacattttggtgtctctagacagtgtttcatgtacgtagaaaatgctcaataaatgtttggtgattgatgactggcggagtgaacatatacattctttaatacaatttttgccacaacgttatttattgttgtcaatttttataaagaagtatccttattctttaaaatggattgctctctccaccccacttgcccctccctcctcgattgcccctccccaaccccttactttgcaacgcaatcaaggcatagataatttcctctcagcctagaagtgacatcctaagttcctttgcacaactgaggagttgatggagttccagtgaactgaatactttccattaatccatcccagagagataggtcatctctttgtagcactggtctgtagaaaaaaaatgaagtgcctgagcaagatactgaattttagcattgcttatgtgggggtggggggcatggattgctccatgggcaaatatatttctggtgtcctgccattcttcctggggtgtaaattcactcttacctaagtgtggggcaaagtctctctcagttgaagcccagtagatgcagttgataaaaccgatgttgaatcccacagttcacagaattctgagatgtaaatactggatttatcaagtcaaattgcatctaatgatgagttgtgtttggcttctgagaatccacagaaaattatcatgtgtttacctagggttactttctcatgactttgttctcttcttttcttgtctgtcttctctctctgccacatgaccaatttgttgcattcaactctgattttaaaggtttccattccactaaccgaaggcctggacttgatatccatgttgacggatgatgctacaattgccgcctggaataacgaaggactgcccagtgacagaatgtccaccgaaaatgccgctatcctaacacactgtgagcgctggcctctggtgatagatccccagcaacagggaattaagtggatcaagaataagtatggaatggacctgaaagtcacacatttgggccagaaagggtatgtgaagtttgaagagactggctttctgtttacctgctgtgaagtgggtctgatttttataaaggcgtgatgtttcttagacctctccaccacattgatgtattacaatttggtgctatttgtttatctgcctgttcatgtttcatataaagtatctctgttgaaaaggcattcttgttggatggcacccaattatctgaagaagagataagattgaaggttagaacaaacattgggtctgtgggggaaaatatgtaaattttctaaagccaagaatggatatatattatattccttctctggagtgtttggatagtaacacaagaattgtcaagggtgcctccgggcttcatgatgtttacggtcatatttctaaatctatactccgcctatagaaggatcttaacatggctacaagtcccaacattgggtgcctgaagttaatttattatcttagtcaagatttacatgtcacttttgagacctgaatctactccaagaatttctgttactgagtcatcatgataatactgtctgatagatagaaagctgtcttgtatgcagttgctattcagttaatgttgaataaattattttagaactatggatatttcacttgacccttccatcctctttttatatgtagagtgaaataagaaatttctgtagttatacaagtaaatgtagttcttaggccaggtacagtagctcatgcctataatcccagcactttaggaggctgatacaggaggattgcttggagccaggaattcaagaccaccctgagcgacatagtgagacccccatctctaccaaaaaaaaaaaaaaaaaaaaaaaagttgccaggtatggtagtgcctacctgtagtcccagctacttgagaggctgaggcaggaggatcacttgagcccaggagattgaggctacattgaatcataaacatgccactgcactccagcctggacaacagagtgagaccaccatctctatttttttttgatgtagtttttgtttgtctgaatacttggagaaaattatttttggtagggagatattttgtggaaagtaagaccaaaataaaatgatagctcaccattttaagtgactaaatgtaaaggtttaaaaaaataaaagtttgatcaagtttaaagcatttaatacatgaaactttacttaaaaaagagccatcaaatgaatttaaatgtatgatagttggataacttacacttatttcaactacagttgctattacaagcaactaatctatacatagatttattagttcaaactattaaatttcacttcgaaaatatgactaaaatgtatcttaaaatctcatctttaatttctgtgtaatctagtggaagggaactactactttataaaatagttttctctaagtttgtcccatttagaatatctacattaaatataatttgatcatttaaaaaattttgaacattttgtgccaatttacattttattatctcaaatcccactgaattttaaggtttttgaatgccattgaaactgctttggcctttggtgatgtcatcttaattgaaaatctcgaggaaacgatagatccagtcctggatccactacttggcaggaacacaattaaaaaaggaaagtaagtattcttgaatttttaacatatatatcttgctaaatgattttcagcagcagcatctcttagcttcatagtcaagcagtctattgaaatcttagtgatatttctgagtttccatttcatgcacctacactccaagaccaaagcaactgcaacattatccagactttcagactatttatttgatggatttagatttgttttatccaattcctgatttatgggccaaaaaatgtattgttataaatctgagaatcgttgcctctttttaaatttataccaatgtttctctaacttcagtaatttgcagaacaccttgaatagggctgcctatctacatatcacttgtaccctgtttaatgtttttctttaattagattttaaatccattcactattttttaaaatcagcatgggtttactgtgctagctctgttttttctaatatacttaaaatgtaaccattcggaaaaggagagttcattagtgggtccctgaaatcatcccttatgccaacagtaatggattgtcaacaacagagaaatacttccccctacccctccaggagctatatgtgactttctaagagactgccattcccccaagacaatatactttccagaacattctctcaggggcattgaagccatttctgaggagtcatcatgtcactttcctatgaatgtgtgaaaggtcaggtgcagcaattgtgtcttcaatcaagtctgggtgggcataggggaaactggcactcaagagactccttatgcctcttcacacaaccgacattcactagacttaattcactgagtttccttccctctcttctttttttcttcaaagatatataatttcagaacttcccccaccctgttctttcttaacgcccacgctctgcctctaaggtatctgtcccctttttcatcactagattattcttgtcaattttaagtggaaataggcctacatcagggtgactaacttcttggtctctaactgattagtatggtatttatcatacaatcactaagtaaatccatttagagtgactgacaacttataattgtttaataaaccaaaatttacccaggcacacatttagaacaatctaacaagccacttgacaaactgcaactcttaacataaatataattgtagctgtgtctgatgtgttaaaaatatagtgtaaaatcttgaatgtcactgaagtgaaatccttgttattaaggttctgactctattatgaagacttaaaatttttatcagtgaaatgcatgttctctgagcttcaatttcaactttcaatagcacaatttaggtgtaagcaatttgatgactcttattacatatatagttggataatcagaaatttccaaaggctgataaatttgagtcatgattctcagtatggacgtagttaactatcagtgaggattctagaggtcttcaattttagaaacagattttacatagagcttcaagtctttatcacaaaatatcaggccagaacagtttaattcaaattaataatatttactgaatatgtactctctgttaagccttgatgaattgatcatatcattcttgcatttcttttaaggccaagaagattaaagataatctgttaagaatgtaacaaatggtgctgattgcatgcagttcttaccttaatcctggctcctaaacccttatgtgtgggaacaaccacttgtttgagggtgaatctcaactctctatcatcagctgttcctccttccctcttccatgcagatgtttttagactatcttcacccagagactatgagtgccagtggagtccttatatatcctgtcagtcattgagtaaaccttctctgagcactgctatatgccaggtactatactgggggctgcagatttagtgtgataagacacagaccctgcacttgaggaagctacacttccataagtaaagatagacctataaacaatcagtgaatgtaaagcagaaccgttggtgtggtgatagacgtatacatggcaaggagttgtcagttccatagtggagacttggaaagacttcttggaaaaaattacctttgattacattttgtttaatgcaagactcaaaagttaagtaggtatttgtgaggtagacaagtgggaaaagagaatcctggacagagagccctaatttcaaatagtaaaacacacaaaacaatccaacagctttggggaactgcaaatagaatccaaatgggtggagagtctgtgttggggaggaagagagaaggatgtggactgggacagatgagactggagaggagagcaggacccagagcacagacttccttggttgatccctaggttggccttttgctatgtgttgataatttccaacccctcctaaatacactcaaggggcctgtttttatcagttacactagttggtagtaccaattgtttttaactaagggaccatgctttcctggagtctccatattttcacttgagaatcatgatcataagtcagtggggaagctagtaagaactcttgggcacactggaagcaatgtgatcagatgaatgtttctgaaagtattgactgaaggggcgtggacctagagtcagagtctagttagtaaataattgcagtaatccatttgagacatggtatgagcctaaacttaggcagtgacagtggaaagagtggaggggacaaatcagtgtgatatcaaggagttaataccaccagtttatggtaattaattggatattatggtggggaaaaaggaagatttaaggatgttttcttctgccttctgtcaggtaaatgatactgtgctttatggagagatgtatataggaatgagagtaagtgtagggaaagaactaataatttctcttactagacatgcaaaggttgaggtacttctttaacactcatttctaaaacagaagtctaaaaagcagttggatatctgagtatggagcttagtaaaaggatgttggttgaccacgtagattggggaatatctatctggcgaagcagttatgctatcatggtggatgtgattatctagggagactctgtacagccagaaaaacagagggtaccctgtcttgcctctgctcttttcccatgagaaaaatggggacccagagacattaattaacgtcctcttgcataccttatcgctatatgaagtttatgtgaaaacctagtttcttaaacaggtttttctcttttttatgttttttaattgctacgtcatagttgtacatattttgggggtacatgagatattttgatacatgtatacgatgtgtgatgatcaagtcaggatgactgggatatctaccacgtcaaacacttttctttgtgttgaaaacattacagttcttctcttctagctatattaaaatatataataaattattggtaactataactttcctactattctattgaatactagaattattccttctaactgtatttttgtacccactcaccagcttttccttatcttccacctcccccgccagcttctcttcctggcctgttgtaaccaccattctcctctttgcctccatgagacccgattttttagctcctgcatatgagtaagaaaatgccatatttttctttctgtgcctgacttatttcatttaacataataccctccagttccatccatgttgctgcaaatgacagcttcattcctttttatggatgaatagtatttcactgtgtatatataccacaatttctttacccatttgtattcatctgttttgcattgctataaaggaatacctgagactgggtaatttatttatttattttttttaaaaagagtttgatttaactcatggttctgtaggctgtaaaagaagcacagtgccagcatctgcttctggtgaagcctcaggaggctcacaatcatggtggaaggtaaacggggagcagacatgtcacacagcaagaaagggagcaatagagaatgggcaggaggagccaggctcttttaaacaaccatatttcaaggtaactcattcccacagggagggaggacaccaagccattcatgagagatctgcccccatgacccaaacatttcccaccaggcccacctccaacattgatggtcacatttcaacatgagatttggagaggacaaatatccaaactgtatcacaattcacccattgttggacactcaaaagggtttcttatctaggttattgtgaatattgctgcagtgaacatgggaatgcagatacttttgcaatatactgatttcatttattttggatatatgcccagcagccatattgctggatcatgtggcatgaccatgaggaatctctatactgttttccatagtggctatactaatttacattcccaccaacaatgtacaggtgttcccctttctcacatttgttatttcttgtctttttgataatagccattctaactggaatgagacggtacctcattgtggttttgattaacatttctctgatgattaataatgttgggcacatttcatatacccgttggccatttgtatgtcttcttttgagaaagatctactcaggtattttacccatttttaaatcagattatttgctttttttttttttttttttttttttttgctatcgggttgagttccttatatattctagttattaatccttgatcagaaggatagtttgcaaatatcttctcccattctgtaggttgtctcttcactccattgattgtttcctttgctgtacagaagttgtttagcttgatgtaatcccatttgtatattgttgcttttgttgctgttctttttgaggtcttatccccaaaatcttttaacaagctttttcaaataaacaggcactactatcttttgatagggtttttatgagtgccattttaccagtctaactcttcccccctcggttttttcctaagcctcatttgtttccccatcaatgttttggaaactatgtttttcatacctgcagtttcctataacatagcccagccctttcatttcttcttgacacagataatcccccctcctgtgatatgttattttacttaacttttcttttcacagcctaaattcactatatttaggatttaactgctatttagccaatagcagttaagtgttaactggaaattttaatttgccttatttaatgtctcctttacatagtatattttccctgtgtcattttgccatttttttctcccccttacaatatgcttaatttttttcactcatacataactttgattataataagttctttatgcataagaatcatatactatatgcctttaaaaagatggttaaccaaaacaaaaacagagcaatacaaacataaaacttttatttctgttactaggtggattaagtattcaaatactagacaaaaactaaatatattagttaaaatattaaaaacacctttcgaaatgtgttactgagttgacaaaaagaaaaagtgcaactaaaaagcaggaactccgagagacaaggaacaccaaagatggtttccttcttcagggtgcctgctaaaacctgatgaccttggggttctcttttgatgatgtacaaagcttgaacaagcctagagcctgttcaggatatgcagtctgctaagagattcctgtataaagctagaggacacaccttccgtttaagggtaaatttgttaaaattaataaacacacacaaacaattgctaaactgagaaaactttccttttctagcttggcactgagaagaggcagaaaaaatgtcctatactagttgcatcctaggaggagtattttgggtttttagggtgttttaattttattatttaatactgatacctataaaatacataatatatgaagttataaagcataataaattagacatgtatctgccattcagattattgccaatatcctttaagctacctttgtgctcccctccttgacaattctgcctccacttccaaaggtagccaatgttcacatattggaatgatgtatcagttccataaagtctaacagacaggacatagtaaatattatttacttaatatttttaataacatacataaaatatatttttaattcagtaaataaatatgtatttagtcaagtttctagaatgtgacaggcatatgaagatcaaagatctgtcccattaaaagataaataaaagatctaaatagacatttctccaaagaactacaaatagtcaataagcacatgaaaatatgctcaacatcattagtcatcgggaacatgcaaatcaaagacataggaaggtgaagattctgaatgttgcttatcacttcattgttttatttaaaataatgttttaacacgtgtgtgtattctgaaacaacatattcttttggagctttataaaaataccattatggtgtatatagtttaaaaggacttgattttttccctcaatcatatgtttctaagatttaatctacattgctccttctggctctagttcttgcaaattcgttactataatattgtttttgaaacagagtcttgctctgtcatccaggctggagtgcagtggcgggatcttggctcattgcaacctccacctcccaggttcaagtgattctcctgcctcagcctcccgagtagctggaattacaggcgcctgccaccaggcctggctaatttttttatttttagtagaaacaggtttcgccatgttgaccaggctggtctcgaactcctgaccttaaatgatctgcccaccttggcttcctaaagtgctgagattacaggcatgagccaccacaccgggtctattactgtgatattcaatgatatgactgactattcctcaatttatttagcgttcttattgaaggccattttggttatttttagatgttttgctattatgagtgatgctgctatgaatattactgaatattcatgtatacatctacaggtacacacattcatgcatacaactacaggtacacatagcaagattcttcagtgtttatgttctatagtgagatagttgggttgtagaacttatgcacaatcaactttaaaagataatgccaaattgttttccaaagtgtttagaaatgtacatgctcactagtagtatataagaattgtggagtctttcagagaactgagagagacttttatgcttctgctgttttttataatccaaaagatttcccacatttaatactattagccacctcttcctatgacgaactattcctgcctcctttttttttttcccacttttatttttgaatgaacaaattgagggcactctaagctttcaaaatagttgtgttacaaatgcttaaaaagtgctttgatgtttgggaggccaaggcaggtggatcatgaggtcaggagatcgagaccaacctggcgaacacggtgaaaccccttctctactaaaaatacaaaaaattagctgggtgtagtagcgggtgcctgtagtcccagctactcgggaggctgaggcaggagaacggcatgaacctgggaggtggagctcgcagtgagccaagatggtgccactgcactccagcctgggcgaaggagtgagactctgtctccaaaaaaaaaaaaaaaaagtgttttgatggaataatagacattagagactctgaaaggtggaccgtgggaggggagtgagggataagaagtaacctaatgggcacaatgtatattttttgggtgatggttacattgaaagcacagacttcaccaccacacaatatatccaggtgacaaagctgcgcttgtaccccataaatctataaaagtcattttcttaaaaagcattttgaataaattttgatatttttgttactgcattatttttgcctgataagaagtatctttaaaacaaaataaagactttcttatttcctcatctaactctttaaaagaaaggagagaaactaaaaagtattcatacatatgcaaagtaggagatatggtaaaataaaaattagattggtatgaataggaattatgtttcttttttcaatgcagtaaaagttgggagaaaatataaaagaaaattaaggggaaaatgttgctatgtattcatttaataatagagctactgatttgcagtgttataacaagaacagaaaatttttgaaaattaatctacatgtttgtaaattttataatggatcttcctgtttacctccaacaatgaacattttacttgatttctctatcctctttttttttttcctatgtgactatctctgtgtaacctgtgggtttacaaacattttccttggtattgtaaagacaagagatagcattgaaaagagaaagccaggaaaacaacctacagggactgttgagctgccacattcacccggaatgtctttatcatgtcctcaaactcaggtgggataacaccatcctcctttgagaaactcacatccctcagaaagtttttggctatcaatagtgtttttgtttattctagttctatttgtttgggggagttgttgttgttgttgttgtttaaccagtattagtttattcctaataatgaatgtctgagaaatgtttgtgatagataaagcatagtccaaaagttgaagttcattaataattggaatgttgtggagtgtgaagtaatgaatactaattactcctttcatgtctgacagctccctgtggaccaatacatcagcccagactttaatttggttcgagtaatggtttcatcaatagcacattaaatctgtgtttgagaagatatacaggtgaacctggcccacacagtagataccactgtcataaaatggccacaggccgacaacagctgggtaattacaaataattaaatccaccaagctccagacaatcctaattttaaataaaacatattttatatcaatcgacagcaaatgtatctggaaagatttatcaacatgtaatttttccaaagcaaatttactggcttacatattagagaagttgctgatctgggaagcatcttcataaaattctctttaatctttcaaatacccctaaatatttttgaattttttaaaatattatttaaatattattataatttttgaaagactggagtaactttactgcaatatgtatttccggttgttttggagtatatacatatattattaaaagatattttatacttcattctgtatttttcatacaattattattttaataatagtcttaaagtagcatgctctagaaaggaacttaaaattggctaatagaaatattaactatatgatttaaaaaatttatttttacagaaatagagggagatggcattttatatttatttattttataatgactagatttcctgaaagttatgctaagattaagaagaattgctttcagttagcagctttccagtttattaactattattatgtttctgttcttggagttgacgccatgcaattatagttgactgtagatctattcaaatgaggacttaggtgagatttaagatagaaacatgttaaattgaacgctacactgtagtagaatgtactttcttgagctggaagcttacggattttttttttaatttttttttttctttttgagacagagtcttgctctgtcgcccaggctggagtgccgtggtgtaatcgtggctcactgcaacctccacctcccaagttcaaacaattcccctgcctcagcctcccaagtagctgaaactacaggcatgcgccaccatgcgcggctaatttttgtatttttagtagagatggggtttcactatgttggtcaggctggtcttgaactcctgacctcaggtgatccaccctcctcggtctcccaaagtgctgggattgcaggcatgagccaccgcgcctggcctagcttatggattttaaataaactctagagttatgtagttctctcattatttcctttgctggtaagaatagatttattttcaagttcattcatgctctcctataatagacttcagcattccagtctgttctaatttccaaattcaaaataaaatttaattgccacaaatctgcaacagcttttctattcctaaatttagtaaagttttttttcccttaatagtgtaatctttagcatttgcagataaagcattctcacattcagtcatcttggtaatagttgtttgactttatctgaaaataaataccaaacagggcttcagataaagaatcctcagattcttttattttctttttaaaaagcagtcttccaataaaataacaaacaaatgaaattgtctttgtttttgatgctacattatgatgtttaaatatggatatgttgaagcgtgtgtaggtgtgtatcaaaagagaaataatctacttatgacttttttttttcatttttctgggtttttttttttttttgctgtacaatgttacctggactcctgaaacaccaatgttgttgttgttgttgttgttgtttaattctggttgaagtttgcttttatcttagaagggcgtgttggttatattaactgtatgaagcagcaagacaattaactcatttctattcagggttttctttccttcttttccttgagcgtcttgccagctgtgcagctttcaaccaaaacctttcttcgggaaatgggtttgaccaacttgcacagcccttcccgctgaggttgctaagtaacaactcccctcttgtggtttgctacgtttgctacacctgatcttttccgctgcactcttgactgtagctgttggaattcccaagtctaatctagaagcttttaattttaaacagcaggatgtgcagtaaggcttttagatgtccattgaaaagtttatttcttctcctaaatgtgtttccccccaccccccgccaattagtaggctatattatttgcttatcttaaaaagcagctactatctctttaccttgacaaaatgcctctgatgaagcctccagaatggaatttctcctattcagagaacatgttggctatctgaattgtccaacttagagtgagaaccttcaatataataatacaatatcttaggaaatctctctccaaacagcaggttttgcaaatcttttgaaaagattcctactgcagccatttctaataaagccacttctaataaagactctggtctaccacaatagtaagtcttgattccaaattaaatatgttgctttccatgtttggttttagatggcaatggaaaatagtgatggtgtttgttcaggtactcagagtatctgatagctaaataaatgcattttggtttttataatcaatactgatgacatttccaacagtaactatactaaatcttgagaacgtttccaataaaagtaaaaggggcatcattcgttttcagatgaagattttagaaataagaatttcagataataatctctaaattgaaattctcgtcttggttatattaagataatggttcctctctcagctcacagagattcttgttttcaggaaactgatcattgggaacagtgtttgaattgttctgtcacagaagtactttgaaaactagccaagaaatcattcccaagtgtttttaacgtgatttgcatagctatcttccaacagtaacgactttccgtgatttgaagaagttagacgtctttttgccccaggacactaattttttggctgggttttgaataaacattgaaagcattttgatattcccagtgtacctggcttttatgcatatctgacgtttgaaaggttaatttatagatgatacgtatttgaagacggttgtcattattataaaataattcatttggttaactagcaaacattttggcacacttaatacattttctttccctgagagctaaacagtagaaaacttttatacaagttgaatgatttattgtaaaaaaattatgaattaataattcaatttatgaatctattgaccagaaattatagatctcagatgaggatttgatacttcggtagttgttgctattccccttcataaacaaggacagagtttctgaccaaagactagcagggcgtgtgctctgaactgtgtctgttgtttttctctagtggcagtcaattgttactgagtcgatcatattctctcagtaccctcttgtgatagaaagtcaggcaggttgacagaggctgacattataggctgccactgtcagagcaaattaacctgcaatgttatgcagtgaaatgaactttatactaggagtctagagacccaggttctagtcccagctctgcctctaagctaagccaccttggccaagccataaactctttaggtccataaaaaaaaaatcagttgagtgatctctagtggctcttcttgatctaatattatgctctgctagatgaaacagcatgttttttactcaccccatgtcctagccaattaaaccatttgtactcagagaaataggagtacatattatatttatgtactcataataggtactcagtacaaatatatggtatttgtactcagaaaaataattttatttctgttctgagattacttaagcagcttctcatctccaaaccagcaaatctcagccagtgggaagagacagaggaggagctcactcctgcagagggatgtataaaaatcctatgggagcagccccgtgccagatttggagattcacacccacttgactctccgtgtgatgcagtgacaagggccagtgtaatttgttcctgtggggagtggagctggaagatggattaaggttaacctctgttttaagaaagtagccacacttccaaattttatgttgctcttcacacctgctgttgctcctatttggaatttaagttcaagagctcatagctaccttcagtgttctagaagtcataacctctggattcatgtctttcacagaaacaacaaagtgattctgtttgcttttcccacccctctggttaactttgtagctttttgatccttcaagtcatgagagaacattagcagtctgtttaattttcccagataggaaattaaccaaaaattaatttagcagcaatgataaaacccactgagtcattatataatttttgcctctcatagatcataaacaccccaattgagtataatttactatccctgggaaatctaaacatatcaaataatgtttcagagcaagatgtaaaacccagttttataggcagacatccttctcctttccaacagcatggcagcatcctccccccctctattaacctctcttttcacagagaaaataacacctattccccaagcagatacatttctgcttttcaaactggaatcctgtatgcttcaggatatacatagatatgcaagagagacacagagtgaggaagtcatccatgaagcatcttacggaggttaactcagatacttgattaaacatttaaccagttaaaagcttctgttggccaggcgcagtggctcacgcctgtaatcccagcactttgggaggctgagacgggtggatcacctgaggtcaggatttgagaccagcttgaccagcaaggtgaaaccccatctctactaaaaatataaaaattagccaggtgtggtggcaggcacctgtagtcccagctactcgggaggctgagacaggagaattgtttgaacccgggaggcagagcttgcagtgtgctgaggttgcaccactgcactgcagcctgggtgacagagtgagactccatctcaaaaaaaaaaagcttctgtcacttgcacccagaagcaaaattgtgagaacctcatgcttcttttaattggggcatttagtccatttacatttaaggttaatattgttatgtatgaatttgatcctgtcattatgatgctagctggttgttttgcctgttagttgatgcagtttcttcatatgtcgacggtctttacaatttggcatgtttttgcagtggctggcaccggttgttcctttccatgtttagtgcttccttcaggaaaggcctggtggtgacaaaatctctcagcatttgcttgtctgtaaaggattttatttctccttcgcttatgaagcttagtttggctggctttccatttgcttggtaaatattcctccatccctttattttgagcctatgtgtgtctttgcacgtgaaatgggtctcctgaatacagcacactgatggatcttgactctttatccaatttgccaatctgtgtctgagaacctcatgcttcctgatgactagtctcacacatttattcttgaaagcctagaggaaggagcatcgttatatatagtggctaattggaaaaattagctgctattgctttgagaagagattacactagcaccgttagccaatgtgatcctctagagtggcagtggacaaatggcctgttttggtgcagcctgggaaccaagaatggcttttaaaggattggaaacaagaagaatatatggcagagatgtatgtgacgcacaaagcctaaaatatttactctctgatccttttacaggaaaatttgtcaacccctgctctagaaggatttcttattgaagcctgaacacctgctactttaaaaaataagttaatcatcttgctggtggtttgtgccgcttctcatgcatatgtgaatacacacacataaacacaaacacatacacatacaccacacaaatctctaaattaacctgacttcttaccatagttcccaatcccatgacagtgaactgtcccattgaacaataacaaaaattctagacttctctgattcagtgttcttgacttaaatttacattttgtatttgtttaatttttaattataggaatgtataaattctcttttcatcagggaatatatgttagtggttgaaacatgaagttcatgaagtatgaacataaacctggtgaaaattcttaagcaagtgaggaaatattcaaacaacctgaaatgatagaaggtggtgacacactggaatttctctaagactctccacaaggggatgaatgaattcaacccaaggtagagtggcaatgaaaagatgacaggatgggctgggcacagtggctcatgcctgtaatgccagcactttgggaagccaaagtggatggatcacctgaggtcaggagttcaagaccagcctggccaacatgatgaaacctcgtctctactaaaaatagataaaaattagcccagcatgatggcacacacctgtaatcacagctactggggaggctgaggcaggagaatcgcttgaacccaggaagtagaggttgcagtgagccaagatcgtgccactgctctccagcctgggcaacagagcaagactccacctcaaaaaataaaaaataaaaataaataaataaaataaaaaatcacaggatgcacatagaggtgtatttaaaatataagttttattgtagagatgcaaatgagtataaatgttggtatctcttatgtgtgagaaccctaggccctaatgacatgaaaccctcactcttgaaatttcatttaaacgtcagtcaatacagcaaaacgataataataggggacctcagcaccttactttcagcaatggacagaacatccagatagaaaatcagaaagaaacatcagagttaaaccacactctagaccaaatggacctcacagacgtttacagaacattccacccaatagcgcagaatatatattcttctcatcagcaaatgcaattttctccaggataggacatatgttatgccacaaaacaagtcccaacgaaatttttttacacaattgaaattatgtcaagtcttttttgtgaccacaacagaataaaactagaaatcaataacaggagaaactttggaaactatacaaatacttggagattaaaaaatgtactcctaaacaacaaacgggtcaaaaagaaaaaggaaattaaaatagatttcttgaaacaaagaaaaatggaagcacataccaaaacctatggaacacagcaaaagcagttctaagagggaataaattcctacatcgaaaaattgaagggatctcaaactacccatggttatgcctcaaggatctaaaaaagacaagaacaaactaaacccaaaattagtagaataaaagaagtaatgaagatcagaatagaaaaaacaaaatagagaataaaagaaatacaaaagatcaacaagacagttggttttcttgaaaagttaaacaaaatcagctataattccaacactttgggaggccaaggcaggagcgtcgcttgaggacaggagtttgagatcaacctggtcaacagagagaaaccctatttctatgaaaaattttaaaaattataagataaattagccaggcatagtgatgcatgcctgtagctctaactacctggaggccgaggcagggggatagctcaagcctagaagttcaaggttgcagtgagctatgatcacaccactgcataccagtctagcactccagcctgggtgacagagtgagatgctgtcccaaaaaaacaaataacacaaacaagatcagcaaacctctacttagactaaaattttcaaaagtttcaaatcagagacgaaaaacaaaacataactgataccacagtaataacagactattatgaacaagtatatgccaacaaaatagaaaacctagaagaactggataaattcctagacatgtataacctatcaaaattgaatcatgaagaaagagaaaatctgaacaaactaataatgagaaatgaggttgaatcaatagtcaaaagtgtcccatcaaagaagagccctaggacctgatgcatttactgcagaattctatcaaacatttaaagaagaactaataccaatccttttcagactattccaaaaaaaaaaaaaaaaaacagagggagttcttccaaactcaacctgagtccagcatcaccctgatactaaaaccagataaggacatacacaaaagtttatgggccaatatgcctgataaacatagctataaaaatcttcaacaaaataaaaccaatcaaaattcaacagcacattaaaaagatcattcactatgaccaagtggaatttattccaggaatgcaagagtggttcaacatacacaaatcaataaatgtgatacatcacattaacagaatcaaggggaaaaaacatacaattatttcaatcaacacagaaaacagcttcgataaaattcaagatcctttcatgaggaaaattctcaacaaattgtgtatagaaggaacatacctcaaaacaataaaggccatatatgacaaacccacagctaacatattaaacagggaaaaactgaaagcctttcctgtaaaatctgaaacaagacaaggattctcacttccaccacttctattcagcacaatactggaagttctaggcagcaagtaagtaagagaactaaagggcatccaaattggaaagaagaaagtcaaattgtccctgtttgcagatgacatgattgtatatatagaaagccccaaagactcctcaaaaaaaaaaaaaaccgttagaactaataaacaaattcagtaaagttgtaggatacaaaatcaacatacataagtcagtagtgtttctatacaccaatattatctgaaaattcaagaaagcaattccatttacaaaagctaccaaataaataaaaaacctaagaaatttaaccaaggaggtgaaaaatccttacaaagaaaactacaaaacattgatgaaataaattgaagaggacacagacaaatggaaagatatttcctgttcatggattgaaagaattaacattgtaaaactgtccatactacccaaagtgatctacacgttcaatgtaatccttatgaaaataccaacgacattcttcacagaaatagataaaaccatcctgaaatttatatggaatcagagaagactccaaatagccaaaccaaccttgagcaaaaaaaacaaagctagaggcatcacactacctgacttcaaagtatactacaaagctgtatcaccaaaagagcatggcacttgcgtaaaaacaaacacatagacagatgaaacagaataaaaatcccagaaatcacacacttatagtcaactgattttcaacaaagttaccaagaatacacattgtggaaagaacaatctcttcaataaatggtgctggaaaaatgataaccacatgcagaaaaatgaaactagacccctgtttatcatcaatgacaaaaatcaactcaaagtagatgaaagacttaaatgtaatacctgaaactataaaactactagaagaaaacattaggggaatgctttataacattggtctggacaaagatttttggggtaagacctcagaggctcaggcagcaaaagcaaagatagacaaatgggattacatcagactaaaaagcttctgcacaacaaaggaaataaccaacagagtaaagagacaacctgcagaatgggagaaaatatgttcaaaatatgcctctgacagtcaagagcttaatatctagaatatataaggaactcaatttagtagcaaaaaaatgaaaaggatgtgattctaaaacaggcaaaggacttgaatagacatttctcagaagacatacaaatgaccaacaggtacatgaaaaatattccacatcactaattatcagggaaatgcaaatcaaaaccataatgaaatatcatttcaccccaattagaatggatattatcaaaaagacaaaaaataacaattgctagaatggatgtggagaaaaggggatgcttatacaccattggtggaaatgtaaatcggtatagccattatggaaaagagtgtagagattcctcgaaaaactaagaactaccgtatgatccagcagttctactatgatgtatcaaaaggaaatgaaatcagcatgtcaaaaagatatctgcacttgcatgtttattgtagcattgttcacattagccaagatctggagtcaacctatcaacagttgaatgcgtaatgaaagtatggtatatatacacaatggaatactactcagtcataaaaaagaataaaatcctgtaatttgtggcaacatggatgaacctggtgggcattatgttaagtgaaataagtcaggcataaaaagacaaatactgcctgctctcattcgtgttatctaaaaaagctgatcttggaagtagagtagaaaaatggttaccagaggcaggggaggtaaaaggagggaggatggtggggagagattggtcaatggttacaaaattgcccgttgatcattttaatagatcatcgttacttttttttggtaacaccattatcaagatataatttacatactatattaccatttgaccacttgaagtatgcaattcagtggtttttagttaggaggaatacgttctggtgttctgtagcacagtagggtgactatagtaaacaatattatagtgtatatttcaacataactagaagagaggattctgaatattcccaccacaaagaaatgatcaatgagatgatggatatgctaaataccatgatttgatcattatacaatgtatacatgtattgaaacatctcatggggccccataaatatgtataattatgtgtcaattaaaaacagtttttaaaaaagtcagtcatacacatcctgaagttaggctgagtcaaaagaactagccgtgaactatacagtgaatagcactaacaaagattttctcaaagctgcttgtgagatcattttggaaatccttggaaagaggaaactcaaataatagaaggaattttgatgatgctctccactgtagacatatttgaatagattgtccatcaaaagaggcaggttaatttagaaagatgtccttatcaaacaagattatcctgtgatacacattgctatgctcaaaagacaagcgtgaacctctgagaaactgtattagcatggtaacttacagactgataaaagcccaaatgttaatgatttgacctctgataattgttccctttttttggtagcatccttatcaagatataagtcacatattatataattcacccactcaaagtgtgtaattcagtggtttttagtatatgcacagagttgggccaacatcaacacaatctgttttaaaatggaaattgctgtatctttctgtatttatttgcctgttctggacatttcactaagtggagtcatataatatgtgatcttttgtgacttctttcactttgtacattttcaggtttcatttgtgtcgtagcatgtatcaatacttcattccattctatggccaaatattaggtcggtgcaaaagtaattgtgggtttttccatgatatttcattgtttggatttttaaactatttatttatttatttatttatttatttatttttgagacagggtctctgttgcccaggctggagtgcagtggcctgatcacagctcacggcagcctcgacctcccaaggctcaggtgatcctcccacctcagcctcctaagtagctgggactacaggtgtgtgccaccacaccatgctaattttaaggaatggccaaaccgcttgccaatgtggttgcacaattttatgttcccattagcagtgtatgagggctccagtttctccatgtcctcaccaacacttgttactgtctttgcttttttattatagtcattctcattggtgtgaactggtacctcactaaggctttgatttgcatttccctggtgactaatgatattaagcatcttttcatatgcttattggtcatttgtgtttcttctttggagaaatgtttatttagttcttttacccatctttcacttgtacagatgtttgatcattgtttgcctatcaaattatagaaacatgactgaatacatatttattggctgaatagatggaagaataaatcactatattaaaagttgatgccgaccgggtatggtgactcacgcctgtaatcccagcactttggtaggctgaggggggcaaatcacgaggtcaggagtttgagaccagcctggacaacatggtgaaaccctgtctctactaaaaaatacaaaaaattagctgggtgtggtggtgggcgcctgtagtcccagctactcaggaggctgaggcaggaaaatggcgtgaacccaggaggcagagctttcagggatccgagatcacaccactgcactccaacctgggcgacagagtgagactccgtttcaaaaaaaaaaaaaggggacgtatgtaatgcacaggtatatactggcttgggcagaagagggttgctagctgaattgcttattctcctcttggaaaacaattaaatagtaggaggtactgacaaggtaaaaacaaatccaaactgaataaagtgaataaattcaccattcaactaatagggttttcaaaagtggcttatctggcagaattttttcaagtttagacacttaatcaacaactctgaaggtttctgttgtcagtgtaagatcactctgcagggaaaacaacatttgagaattagatgaagacaataggtcataagtctgatcagtcctttgggattttaaattcatattcaggcaacaaaagctttagtaatgtaagaaaattttaatttttaaatagtctttacacattaaaaccagttgtctcattaaaaatgtttccagtcaaataacacagccagtggttcagaggcactttccttaccatagacacaagagacctaatctctgagcaagacacaattataaaacatcatccaagaaccacagaaaacattgccactttatggcattctggatatcactcctcaaattaaaaattgttgctaatattgtgacatttcgataaaaaggagccctgtctgaatgcgatagaacatcttttctttagaattttcccagttgttcaaaattgacaaattcagtgaaataacatctcacctggaagtcaatgagataggcaataaatatttttttctcatggctatttaaaataatttcaattaaaataattgggctctggctaattttctatcatgacatctatacaatttaaatattttatacacttaataatgaagaatccaaaattttcatatgtaaggtaaaatagaagactgagccgagactgtttgctgcagccatgcctctaggcctcataagaagtttcactctaagcagcttaggccgctttgagaagttccagtattcgtggttttggcttctctgtctcttgcatgaattagaaagctccccctttactagatcctcatagcaggttcctagcaggaaagagaccatgaagcttgtatgaaaacatctcatgtaccccataaatacatatgattactacgtacccttaaattaaaaaaataacatgaattaagctgggagttttgaatagaattagcctagtgactatttacagaaataattttcagaggaaagggttaagtagagatgttgaggcagacaaggatttgcagttacaggaagccaatgcagaaagtattggaaagtaattttttaaatatatgtgttgggctgggtgaggtgcctcacacctgtaatcctagcactttggaaggccaaggcgggtggatcacctgaggtcagtagttggagaccagcctgaccagcatggcaaaaccccatctctactaaaaatatacaaaaattagctgggcgtggtggcatgcacctgtaatctcagctactcaggaggctgaggcacaagaatgacttgaacccaggaggtggaggttgcagtgagccaaaattgtaccattgcatttcagcctgggtgaaggagtgagacactgtcacacacacacaaaaaagaatatatgtgtttttaatatttcatctttataaaaataaaatattttaatacgttatttaagatacataagtatattaaatacatacttaagatgcattatacatatatatacagatatacataaacacatacatacacatcttatccttaaagaactgcaacatttaatgtatgtttaatcacagaaagtacagctggccctgaaataacatactttcatgctaatgttgatgagggaaaaaaacatcacttcctgcttgctgggaccactgtctgtgtggagtttgcacacgttccccatgtctgcctgggttttctcttttcctcctgtttcctcccatatcccacagctgtgcatgttaggtgagctggaatgtctatatggtcccagtgtgagtgagtgagtgtgggggtgtgtgagtgtccctgccatgggatgacatcctgtccagggctggttcccacctggtgccctgagtttccagggtagtgtgcagccacccgggagcctgaactggaatcagtgggttagaaaaggaatgaatgagtgaatacaaactattgtcaaataaaaatttgtaaattagacgataatcatacaaatgcacgacactgaacattgcactacaaaagcccttctcaagcctgccagatctgtcattgcttttgaactgtgtggtggtaggaggtgctgcttaagattttctgctttgtacacatttatttctcaatttaacctgccccctctatgcccaccatttctcactaatgcaccaaaaattgagtaaataattatcttgtttttattaaccttttaaaatgtatatgtagctcacatttatttcagtgtttaatattagaggtgtttgaggcctttatttagaagtttgatgatgtttttgtgaccaggaacatgccataggaacttcactcttgtttatatcaattagtcagtggtaaaactggtttcttcatatgttgttttgcttaaagtcacagtttgcaagtttatcgattacatcgaggacttactgtataataataaaagctaatatttgttgttataggtcttttatatgattgtatttaattgttacagtgacactatggggtgagtactattattgtcaatatttcacatatgaggaaactaaatcatatagagatttgctgggtgattgctgatcctgctgtactttaggaaatttgggagtagctgaaaaattctcaatcacctgagcttctggccaaggtccattataagaatacaggaatggaatgacaccgtagtatcagttatgggtcataggagtctcctgaaagtctgtgttttgctccgtttaggtatatcaggattggagataaagaatgtgaatttaacaagaactttcgccttatccttcacacaaaattggcaaatcctcactataagccggaattacaagctcagacaactctcctcaatttcacagtcacagaagatggtctagaagcccagctgctggcagaggttgtcagtattgaaaggccagatttggagaaacttaaggtaaaaatgtttacgtcaccaccaacacttagtcggcatttgctttgcacaaatcacagtgctagacatagaagtataaaataggattcctgccctctagaatcctgcaacctaattgggaaaaataagtatacatgttaaaagttaaacaattcaaagttgctcttcataaatgctagattgttacggttatgccacacgtaggagatagggtggctctggatcttgtttgagggcaaacaaagaggcatacgagtcatgtaaaatagaggtatgtgcccaggtatgttggaatgtaatcgactaatttagcctgggctaaagaatgaaaaagaggtataatgaagcaagcttggaagaattaaggacctggtagctagttgtgactagtattcaaagggacattcatggccttaagtatattaagaaacaatgctgaaaatactgaaatttagtgttatatacagaaaacaaagcaacatagccttaaaatgtagaagaaaggcaataataaagataaaatcagaaaatactgacatagaaaatagacaaaagattaacaaaataaaaaagctagttctttggcaagaaggggtgaggaagtgatatagtagatatacttccataaggactagtgaagaataaaagataaaaggcaagtaagggaagacaaaggcatataactacacacagattaaaaactataaaggaatgctatgctcaggttttttttgttttttttttttttttgagacagagtcttgctctgtcaccaaggctggagtgcagtggcatggtctcggctcactgcaacctccgcctcctgggttcaagcgattcttctgcctcagcttcccgagtagctgggactacaggcatgcaccaccacgcccagctaatttttgtatttttagtagtgatagggtttcaccatatttgccaggctggtctcaaactcctcaccttgtgatcctccagcctcagcctcccaaagtgctgggattacaggcatgagccaccacgcccggccatgctgtgcccagctttctaataataaatttgagtattgaaatggtgatgtgaaaaataaaaagaatttatgtgctaacctgggcaaatttggcaatagtgtgtctcaaaaatttaaatgagatacattaagaattaaaacaaggatttatatttcagatgttagagatttatggcctacattttggaacttgaaaggatttcttcacacagatgaacaacattattcatattttgaagaagtaagctagaatactttttcttagtataaatcaggggtccgcaaactgtggcttccatgcctaatttggcctgccacctcttttggttaataaaatttattaaaacacagccatggccaaacacagtggctcatacctgtaataccaacactttggaaagctgaggctggatcacttgagggaagatcacttgaggccagtttgagaccagcctggccaacatggcaaaaccccatctctactaaaaatacaaaaaattagccaagtgtggtggtgtgcaaccgtagccgcagctactgaggaggctgaggcacaagaaccacttgaacccaggggcagaggttgcagtgtgccaggatagtgccactgcactccagcctggaggacagagcaagactctgtctcaaacaaaaacaaaaacaaacaaaaaacggacttgttcatatatttacatattgtctatgactgcttttgcactataatggcagagttgagtagttgcaacagataccttatggcctacaaagccaaaagtatttattatctggccctttccagaaaacgattgccaccctggtataaatcagtggttctcaaactgggggtcctggaacagcagcatcaccatcagctggtgctgatacaaatacactttaaatgcaaattatctggccacaccccagatcccactaaatgagaaactctggttgggggtccagcaatcatgttttactaagccatgcaggaaattctggtccatgctcatagtctgtgtgaggctgctttacttggatttgccactgcagcagttgccatgtaggcaaagacagccatgggatcaaggctgggtatcagtggatatggttccctgaggcctccttacaaatgtgctcacattcagtggaactgcaacatgccaggagtgagtcatccaccaagtcagagttcaaaggaccactggcttgctgccttgtgcactaattgccaagctggatcagggaccgtgtctgtaatcaaggcaccaccagaccatataagaaaatagtattttttttttatgttagcataaaaaagttgcaggagttcttgtattctgaatgtcagactcttattggatatgtgacttataaaaattttctcccattctgtgggctgtcttttcactttcttgttggtgtcctttgaagcacaaaagtttttaattttggtaatgttcagtttatctattttttcttgcttgttttttggtatcatatctaagaaatcattaactgacagttcgtgaagatttatgttttctcttaggagttgtgtagttttggttcttacatttagctctgttgtatattttgagttaatttttgtacgtggtgtgaagtaggggtgcaccttcattcttttgcctgtggctatctagttgtctcagcaccgtttgttgaaaagactatattttctcccttaaattgcctttgatccttgttaaagatcagttggccatatttcatatgaatagatcagttggatctattcatatttctgcgttctctgtttcattccattgatctgtttgtctatccttttatcaatatcacaccgccttgattactgtagcttgatagtctggaagccaagtagtgtcaattctctgactttgtttttctgtatatttttgatgattctggatcttatgatttttaatataaactttagaatcagattttcaacatctataaaataatgtacaggtattttgaataatattgtgttgaatttcagaaaggaatgacttaacaataatggcttaacaatactcagaatggcttaacaatattgagacttcctattcatcaacatgcaatatctctccattgtttagatctttgatttctttcatcagagatttttagtcctccagacagatcttcaacatactttgtgaaatctatacctaagtgtttcagttgtttggtactaatgtaaatggcattgtgttttaaatttcaaattccaattgtttaaagctggtgtatagaagagcaatggcttttgtatattaatctgtatcctgcaaatgtgctatacctgcttattagttgcaagaggccttacgttcatactttgggattttccacatagattatcatgtcatgcgtgaacaaagacaattttttgttcttccttcccattccatatacctttaatttccttttcttgtcttaaggcattagttaggacttctagtacaatgttgagtaggagtggaaccttgcctcgttcctgatcttagggcaaaagcatctagcttctcaccattaagtacaatgtaagctatgattctcttcttttagatcttctttatcacgttaagaaagttcccctctatttctaatttgccgagagtttttttatcattaaattactgttaaattttatcaaatgttttttctgcatttattgatatgactacatttttcttctttagcttgttatatatcattacttcacttttgaaccagacttgcatacctggaataaatcccacttggtcgtggtgtttaattatttttgtacattgttggatttgatttgctaattttttgaggatgttcacaactatgctcatcagagatatcggtccgtagttgttttgttttttcctgtaatgggtttatctggttttggtcttagggtaatgcttgccctatagaatgagataggaaatgttccctctgcttctattttctagaaaaaatgtagagaattgatactatttctcccttaactcttttcttccagtgaaatcatctggacctggtgctttctgttttgaaaggttattaattattgagttaatttatttaatgcatataggccttttcagattatgtatgtatttttggtagattctgccctccaaagtttcagttcacttcatctaagttatcaaatttgtaagcatataatgatttataagattcttttattatcctttaatattcatggaattggtatttatgcccctctttcatttctcatactagtaattggtgccttctcttgtctcttggctagcctggctagagtattataaattctgttgatcctttcaaataatcagctttggattttagtttctctactgattttctggttaaaatgttactgacttctgctctgatttttattatgtattcacaagcttgctttaggttcacattgctcctttatctaattttctaaggtaaaagcttagataaatacctttaggttttcttctctacttttctaatatatgcattcaatgctataaatttccctttaaccactgcttttgctgaatctcacaaattttgatatgttgtatttttgtttgcatttatgtcaaaatatttttaagtttttcttgagacttcttctttgacccatgtgttattttaaactgtgttgtttaatctccaaatatttttgaattttaagcgttctgttactgatttcttacgtaattttgttgtggtctggaacatactttgtatgatttctattcttttaaacctttttggtgtgttacttggtccatcttggcaaatgttccatgtgagcttgagaaaaatgtatattcttctgtaagtggatgaagtagtctgtcagtgacattcgatccggttgattgatgatgatgcacagttcgactatatccttgctgattttttgcctgctggatctgtcaattatgatataagggttttgaattgtccagctataattgtggacttgtttatttctccttgcagttcttagtttttgccttctgtattttgacactccattattaggtgcatacacattaaagattattatgctttcgaccgggtgcagtggctcacgcctgtaatcccagcactttgggaggctgagacgggcggatcacgaggtcaggggatcgataccatcctggctaacatggtgaaaccccgtctctactaaaaatacaaaaaaaattagctgggcgtggtggcgggtgcctgtagtcccagctactcgggaggctgaggcaggagaatggcgtgaacccaggaggtagagcttgcagtgagctgggattgcaccactgcactccagcctgggtgatagagcgagactctgtttcaaaaaaaaaaaaaaaaagattattatgctttcagggagagtagacccttttattatgtaatgcacttctttgttctcaataatttttcttattctgataactactttgtcttaatatagccaccccagctttctttcgattagtgttagcatggtatatctttctccatctctctctctctctctctctacttttaatttttatatttaaagtgggttttatagacagataggtcttgttttttatctactatgtcaatataattcacatttaaagagattgttgctataattagatcaatatctaccgtatttttattgggttttattcattatacttgtttctcactagttttgtctttttctcttcttctgccatctttggttttaattgagcactttgtatgattccagtgtcttctttcttagctatatatattgggtgctcactctcactcgctctctctctctgtatatatagctgtaatatttatatattacaacatgatgtatgtattttgtatttgtaataatttttcttttccttctcttctgccttctttggttttaagcattttatatgattctagtatctcttctctcttagcaaaatagattgctatatgtaagtacaatataaattgtatttcttttaaaaatttttttagtggttaccttagcatttgcaatatacatttacaactaatctaactccattttcttttttctttttttctgagatgaggtttcactcttgttgcccaggctggagtgcaatggcacaatctcggctcactgcaacctctgcctccttggttcaaacaattctcctgcctcagcctcccgagtagctgggattacaggcatgtaccgccatgcccagctaattttgtatttttagtagagatgggatttcgccatgttggtcaggctagtctcaaactcctgacctcaggtgttccacctgcctcggcctcccaaagtgctgggattacgggcatgagccaccatgcccagcctctaattccattttcaaataacactactgcctcattggtaatgcagttatcttttaatagactattctcatttcctccctctcatcctttataacattgctgtcattcatttcgtttatccataagttataatcactgactgtattgcttttattactgttttgaacagacagctcaattaataaactaacatattttatcttcatttactccttctctagtactctttcattctttacatagatgtgagtttctgacctatatcatttttcttgtctatgaagaaatttctttttaacatttctggtaaggcaggtctactgacaacaaaatccctcagtcttcttggtctaagaaagcttttattacgctttacttttgaaggataattttataagatacaaaattatttgttgattgtttttttccttaaacattttaaatattttactcaactctcctttttgcatagtttctcaagagaagttccatgtaattgttatccttgttccttcataggtaaggtaatttatttcctgtggactctttcaagattttgtctttgtctttgatattatgcggtttgaatatgcaatgactaagagttgattttttggcatttatcctgcttaatgttctatgggtgtcctggatctttggtttggtatctttcattaattttgaagaatttttagctaccattatttccaatctttcttctgctcatttttttcttttttctccttgtaagcatctcacagttcttggatattctttcctttttaatttttattctttttttttttcaagtatctaatgacatatgtctaagcatactgattcttgtcactgtgtctagtttactcatgagcccgtcaaaaacattcttcagccgggcacggtggctcacgcctgtaatcccagcactttgggaggccaaggcaggcggatcacaaggtcaggagattgagaccatcctggctaacacggtgaaaccccatctctactaaaaatacaaaaaattagccaggtgtggtggtgggagcctgtagtcccagctactcgggaggctgaggcaggagaatggcgtgaacccgggaggcggagcttgcagtgacccgagatggcgccacagcgctccagcctgggcgacagaggagactctgtctcaaaaaaaaaaaaaaagaaaaagaaaaagaaaaaaaattcttcatttttgttacgttgttttttatgtctagcatttccttttcattctttgagtttctatctctacttacattgcccatgtggtcttgcatggtgttcacttttccattaaacccgttagcacattaagtagttatttttaactcccagtttgataattccaaaatttctgccacatctgagtcttgtcctgaggtttgcgttctgtcttcttctttttttttttttttttttttttgcctctaagtataccttgtacttatttgttgaaaaccttgaaaaccagacatgatgtattagataactgtcacaaaagtaaacagaggtttagtgtgaggttttatgtttccagggctaggagttacggctgtgtctcatgttcatttagctgcagttttacctggtgtccttgtttttgtctcccttgttgtccttaggtttccctaaaaactgatttttaaatagaatctgtgctttgcaaatctctcagttataatccactgatattatactggagtctgtcaatgtgttggtaaggtattatggaggggaagcattcttttctcttataattacatctcagggttttttaggagctgtgaatcactgggatgtggccttcagaagagttactcagccttttttaaaggacaggaattctgccttccccagtgatatggtttggctatgacatcacccaaatctcatcttgaattgtagttcccataatccccgtatgttgtggcagggacccagtgggaggtaactgaatcacgggattggtttcctccatgctgttcttgtgatagtgagtgagttctcataagatctgatggttttataaggggcttttccccctttgctgggcacttctctctgctgccgccaaggaaagaaggacatgtttgcttcccttccaccatgattgtaagtttcctgatgcctccccagctatacggaactatgagtcaattaaatctcttttctttttaaattacccagtctcaggaagtcctttatcgcaccttgagagcagattaatacatccaggtcatattaggcactggccaagtagtttcccttgtgggcaggctttggttaaggagaacagaaagttctggacatatttaaaatggttactttccctctgagcttatgtcataatggttacttttcccatccttagcccagagctggtgtagattttatctgaccttcactgtaagaaccggatggcatttcctggaggtaaaactcaaagaagtgtagagactacgaagactgggcccctctgaagttttaattcaagctctacttgcatgtcagtgttcccgagaagctgtgattctctgtgtttgcctgtttttaggatggcaatttgtcctgtgacctccgttctctgatgtatgtaggaagaattgttgatgagtttttttcctattttgagaacggaaatgagacttctaagcctttatatgtctgagcagaaaccagaagtttctgatgttttcttaaacagattcttcctgtggttcatgatgttaaattattgttaagcgtttatactctgcaccctggagtgcaactagatcttaacataccttctgaagttttttaaagaatttctaaaaattgtgattggtatgattttaatgttaagggtgttttattatatactgattccatgaaatttgtgattaaggaaactctggtttaaaaacatttacttgtccaggcgcagtggctcacgcctgtaatggcagcactttgggaggcctaggtgggtggatcatttgaggtcaggagttcgagaccagcttgaccaacgtggtgaaaccccgtctctactaaaatacaaaaaaaaatagctggatgtggtggcaggcacctgtaatctcagctactcgggaggctgaggcaggagaatcgctttaacccaggaggcacacgtcgcagtgagccaagatcataccactgtactccagcctgggcgacagagcaagacttcctctaaaaaaaaaaaaaaaaaagtacttaaccaccatttcccacacttttcttggtttttattagttggtattgacaaagcaccaaaatgattttaaaattgagctcaagtatctggaagacgatctccttttgcgcctttctgcggcagagggaagctttctggatgacaccaaactggtagagagattggaggcaacaaagaccaccgtggcagagatagagcacaaggtaggaagggcagagggtgcctggcagattctaatgctctgttcgaatgagacatgtggggtgggcagtgtgatcagacttggtaattcctctaagaggaccagcgtgtggaattcaggtgatttaataagctgcagttggactgtgtgggattgtaaatggagatggagatggttgaatgtgtgcttctcctaattccatagagatgtcattcaaattagacactgtccggctattatttttcctgggtgaccaaatgtgaagaaaagctgaggcctgctggcttctatggctgaaaatctgaaaagccttagcatccggctcttccaaactcatatcctacagtttctctgcaggttctccaagctgttggacattttaaagaaattcttagagtgaaagttttgtttacaggcctgccgtggcaggataccgagcaaaggataatctcctgctgtactcaaatgcactattcaccccaggaaaaatgacatttcctaaaagccagtagaaatttttattaaataggcttcctgctaatgtccaacatgggtcccaatatgccttatgtgtgatgtgcactttggactttcacagatgaccgttaacccttaaaatgccattgtttcagtgtgaattagacccttatttgctttctggaatatccttattactaagtaatctattaattacccagcagaagctgtgtcactacgcatcctttatatttgtcttaaattaagcgaggaaatggaatcccaaattactctgtcttttcaagtaagtgaatattaggtggctcctaagatggtaaagttagaacaattaagtaaattaacttagctttgaagttaacttctaattgtctcttaaaatgtgtcttcctatcttcttaatatatcaccatgtagtgacttccttctctgccctacattttatttccttttatacacaaatattatgagtcaactctatagagaaggttggggaaaatactgtatcctatgggaccagcagtagtcctagataaaagaaatagatatttgagccttgggtaaaactgatatgttggttgatggtggtgctggtttttctttttaaattatctctctgaatgtacccagaggctaatacataaagataaactaaatggaaatatatggacatatggatgatccagtgcaaagttagaattaggcatgagagtctctatattaaggctttttagtaagcataagttactgggtatattattgaccttgactgcttttgtatgctttgttgcctaatgaagttattggcattgaattgacccagcagacttttaagagccatccctgggaggtgatatagctgggttattaagccttgaaagagagaggggaggcaggaaggtgacattactcaaattctgtagaacagaaaacaactaggtttgtttaatctgtaacctagaaaaccgctagagttatgtccattctcactgaaactcagtttattaaaaaaattattttaaaatatgaatgtaatcattttagaaaagctcgagcacatggatgccatgcatgttatctattttaatactcataatttttcatttcaggtacgtccttccattccttggatatgcgtagagaatatgaagagtaaataagttacttattttgtttgatcccaccataggtgattgaagccaaagaaaatgaaagaaaaatcaacgaggcccgagaatgttacagaccagtggcagcaagagcatctcttctttattttgttattaatgacctccaaaaaatcaaccccctctaccaattctctttgaaggtaatgctgaatgagctaagaaatatgggaaactttaggagttcaatttgtttctggaacattggaatttattttattattgataataataataactattattactattattgagacagagtctcactctgtagcccaggctggagtgcagtggcgtgatcattgcaacctctgcctcccatattcaagcaattctcatgcctcagtcacctgagtagctgggactacaggagtgcgccaccacacctggctaatttttgtatttttagtagagacagggttttgccacattgcccaggctggtctcgaactcctgacctcaaatgatctcccctccttggcctcccagagtgctgagagtacaggcgtgaaccaccgcgcacagccagaatgtatttttaagccatcggtgtacccagtaaggagtcatgaggatctggttaacaaaataacaaaagcaaaattcttattctcaggaattttcatttataattttcagtaaggctttgaggtaattaaactgtgcatacggtatcatattatattggtgtattgctcctgagcagtctcttaattttttttttttttttttttgggatggagtctccctctgtcgcccacgctggagtgcagtggcgcgatcttggctcactgcaagctccaccttccgggttcactccattctcctgcctcagcctcctgagtagctgggactacaggtgtccgccaccacacctggctaattttttgtatttttagaagggatggggtttcaccgtgttagccagaatgatctctatctcctgacctcgtgatctgcccgcctcagcctcccaaagtgttgggattacaggcgtgagccaccgcacctggccagcagactctttaagggaattttccttgaggctcctattttgtctttgtgaaaatatgtcttggaaagagaatgctcatatttctttgctaaagaaagaaaaataataagaacaactatttattgagtcactattacatgcaaggcatttttatactttggctcattctttatccctattacatctcaataaagaatataatatccccatttaaaaaataaggatgacattttcaaactttaaataaattgcccaagaatttacatttgttattgtaagagccagcatttcaacctgtaactgtttccaaagcccacgctccataccttgtaccatgctgctgcctgctgggcagtgctcattcattctgttcatctgttcatccgtttttagacaaatgtttattatgatcaatcacgtcagatgcttgtcacttgagtgtatagttttggacaaaacataagggtggaggtatatctatatgtagatacatatagatatatatgtacacatagatatagttccacctttatgatcatacatttgtttataaaagtagaaagtattgtaagacagaatgatagaggtggagaggctgcttttactgggggctcagggaaggcctcccagaggaagtaacgtttatttctgaaggataagtaggacttagctatgtaaagagtgtttggagaaaacaggaatgtgtgagatgaaagaattcagggattccaggtagtgagtgaatttctgtggctgcagggtaatgagcaaggggaaaggtagcaagaaatgaatctagagaggtgggaaagactgaatcacgcagagttttgtagaccactgtgtgtggaatttggggattataatctgtgtgcaacaagaagccattggaagatttcaagcagataactgatgtgatgacaaaagactcagagttacgtgaacagacctgagatatgatttgaagctggaatcattggctcctggagatggactggttatgggcaataataaagaggaaaggatcaagcataactagcaggtttcctaacagtacagaactagtatgcaaaacttctaacaagcacagtgtggttggagtttgaaagtaaccatgtgtgaggagaagagtaaaactaaatcatcagtgtcagcccagtattgcccaaattccaaaactacactaaggcattacaataaaagaaaaatactgggcagtccccccttgtaaacattgttggtaaactcctccagaaaatgttggcaaattgaatccaaccatatataaaaagcacaatgtatcatgaccaagtggaatgtatgccaagaatcaaattggtttaacattcaaaaatcacgaagtgtaattaatcagttaacagaataaaagaaaaaaaagctcatatggtcatttcagttgatgcaaagaacttgaaaaatttcaacaaatgagttaaaaaaaaaaccaaccaactctcaactaatgaatagatggtaacttctcaacatgataaaatgcatctagaaaaaatctacaccaacattatacttaatgttgaaaatggaatgcttttcgctaaaatcaggaacaagacaaggatatctttctctcagcacatctattcagcgctgcactggaagttatagtcggtacagtaagacaatagaaggcaagagatttaaaagaagaagaaaaactgtgttttttcacagatgacctgattatgtatatagaaaatcccaagaaactcaccaaaaccctgccaggactaagaagtgaatttttagcaaggttgcaggatataaggttgatatacaatgtaccttgtatttctatacatgagaaacaagtggaaaataaaatcagtgtcttagcactatttacagtggcttccaaagccgtgaagctttttaggaataattttaataaaatatatgcaaggtttgtattctaaaaactccaaaatattgttgagaaaaattaaagaagtcctaactaaatagatacaccatgttcatcagttggaatgctcaatattgttaagatgtcagttcgctccaaactgatttatagattcaattcagtcccaatcaaaacaccagaagacatttcctttttccttttggtagaaattggcaagcttatcctgaaaatttgtgtgaaaattcaaaggacttaaaatagctaaacaattttgaaaaagaaaaaaaaaaacagggttggaagacttacaatttctgattttaagacttaaatctacacgaatcaagatgttgtggtactggcctgaagaaaaatgcatagatctgtggaacagattggagaatcccgaggtacacccacaaatgcatggtcaattgattttcagtaggggtgccaagacaattcaatgaggaaaggacagtttttacaacaaatggtgctggagcaattggatatccacatgacataaaataaacctcaaactattatactatataaaaaaattcaaaatgaatttattaagctatacattttctaggagaaaaataagagagggctttgggttaggcaaagatttcttaggacacaatagaaaataaaaacttaataaattgaaccttatcaagcttaaaagtttatggttttcaaaagatatgaagatgaaaaggtaggccacagacaagcaaagacaatattctcaatacatatatataaaacaaagaatttgtatcaggatataaaaagaacttgtacaactcagtaataagagttgaacagacatgtaataacacatgtgaattatccacaagcacattaaaaatgctcatcaggcatcagaaaaatgcaaaataaaagcagaatgaggtcttattctatgtcccacagaatggctaaagtttcagaagactcttaatagcaagtgtagcacagatatggtactacagctctctcacattgctggaaggaatgcaataaaccattttggaaaacagtttggcagtttcttgtaaagataaatatacagttagaaaatatgatctcacacttttactccaggcatttacctaagataaataaaaatgtatgcctgcaaaaagcttaacaaatgttcatagatgctttattcataaaagccaaagtctaaaaacaatccaaaggactgacacattaatagtcatgcagattttgcatgttcccacagtgggctattactcaaaacataaaggtatgaattgttggtacacacaacaacgtggatatgtcaccaaacgattatgttgaaaagaagcagccagataccgaggagtatataccatatgatgctatttatgtgaaattatagaaaaggcaaaattattctacagtgacagaggcaggtcagtaattgactggggctggcgatggtggtgggaataggctgtaaataggcacatgagaactttttctggtaatgtaagtagaaaggttctttatcttgattgctacggttattgttagaatatatctatttgtcaagactcatcaaactgtgcatataataggcacattttatagtatgtaaacgaaaaactgattttaagaaagtgtaaatatcaggttagtacagattgagcctcctaatccaaaaaccagaatgctccaaaatctgaaactttttgaatgctgacaagatgccccaagtggaaaattctacacctgacctcatgcactttatgcacaaaattgtttaaaatattgtataaaattaacttcaggctatgtgtataaggtgtctatgaaacatacatgaattttttttttcattttgttttgtttttgagatggagtctcactctgtcacccagactggaatgtagtggtgcaatctcggctcactgcaatctccacctcccaggttgaagcgattctcctgtcccagcccctcaagtaactgggactacaggcacccaccaccatgcctggctaaattttgtatttttggtagagatggggtttcaccatgttggccaggctggtctcaaactcctgaactcaggtgatccacctgcctcagcctcccaaagtgctgggattacaggcatgagccacaagcccaacctataaatgcttttgtgtttaaacttgggttccatccccaagacatctcattgtgtatttgcaaatattcaaacatctgaaaaaatccaaaatctgaaacacttctggccccaagcatttcagataagacatattcaagctatactttgttaatgccttcttaccaatgtttactgtatatatctgtcattgtaggattttactttcactcaaatatacatacttcaaggtgaattaatctgtggtctctggtccctatcatccaaaaataaatagatatttttatattgatggctatttatatatatagatatatttttcaaatttatatttatatagagagatatagcaattcatacaacgccattatcaccaaggcatgaatgagagtaataaatatcaagagtgatctttaaaggaagaagaggtgaccaaggggcatcccgaaagtacatgggaacaacaacaacaacaacaacgacaacaaaacacagcaaataaccagattttaaaataaggacataagtggacatttctccaaagatgttataaaaatgatcaacaagcctgggcaacacagagaaaccctgtctctacaaaaaaattcaaaaattagccaagtgtgatgacacatgcctgtggtctcagctacccaagaggctgaggtgggagggttgcttaggaccgggaggttgaggctgcagtgagccacggtcactccaccgcactccaggctggatgacagaatgaaagtttgtctcaaacaaaaaaggcaacaaacatatgaaaaaatactcaacattaacaatttttagggagatgcaactcaaaaccacaatgagatatcacctcacacccattagaatggctactatcaaaaaaaaaagataacaagtgttggtaatgacgtggagaaattggaatcttttggtgggggtgcacaatggcacagccactatggaaaacagtgtagcaattcctcagaaaaattacaaatagaattaccatatgatcaagcaattccacttctagctgtttattcaaaagaatcaaaagagtgtctttaggagatatccaaatacccaaattcatagtagcattatttacaatagccaaaaggtggaagcaacccagatgtccgtcagtggatgaatagatgaatcaaatgttgtatatccgtgcagttgaatattcttttgccttaaaaatgaacaaatttctcatacatgctgcaacgtggatgaaccttgatattatcctaattcaaatgagccagtcacagtaagactgtgactctgcttatatgagtgtattagtctgttttcacagtgctgataaagacatacccaagagactgggtgatttataaagaaaaagaggtttagtggagtcacagttccacgtggctggggaggcctcacaatcatggtggaaggcgaaaggcacttcttacatggcagcaggcaagacagaatgagagccaagtgaaagagatttcccctcataaaaccatcagatctcatgagagttattcactaccaccagaacagtatgggagaaactgcccccatgattcagttatcttccaccaggtgcctcccacaacacatgggaattatgggagctataattcaagatgagatttgggtggggaaacagccaaaccacatcagtgaggtacctataatagccaaactcatagaaacagaaagtagaataaaagtggttgccagggatgcggggaagggagaatatacagttgtttaatgggtacagagcttcagttttgcaacatgaaaaagctctggcatcctagtgacactggatttagcttttcttgttcctctttgggagctatttgtgttagtatggactgccgcatgtaatttttaaactgagctcatcacattgtgttgtacttttgtaatcttacgtgaagagaatctgtactgcaagtaaaacctactcccccaaaaatgtatggccttgaatctgcattaaacggtataatttatgttcatgagaaaaaaattccacatttcttgtggttacacaagaatgtgactatacttaacactactgaactgaatgtatgtacacttaaaattgttaagatggtaacttttatgttatgtgtatcctaccacaatcaaatactaaaatattattttaagtacatgggcagaaggagagaaaatgatgcaattcaattgcttggaaggagattgaatggatttcatggaatcatattcataataacagtaatgacagcaaacatttaatgagcatgtaccatgtgccagaaactataatcctcctaaaaattttgcctcattctcactccctatagataaaccttaaactgttgccctgtgtatcgggggtagctagacatccaggcaccagttgtcacattttaatggtcacattaaatttcccaggcttttaacgtgctgttccacagagcgatcgagcaggctgacaaggtggaagacatgcagggacgcatctctatcctgatggagagcatcacccatgctgtcttcctctacaccagccaggcgctgtttgagaaggacaagctcaccttcctgtcccagatggcttttcaggtaaggagatcagttacttgaaaaaggatccccagaaccaaaggcagatgcctctgtttattatatattttatttctgctgaagcaaaatataatagacttttttttttttttggaagcccttggtggcatgaggggaatttgcttcccacagggaacttgggcatgtgacagccttctcctaggtcccagtgctttggtttggggagtggggccggtggggtgggtatacacattatgctcctaccacagcggtcaccctgaaaaatattcataagacattcttctcaccttctcgggtcctgtaaagaaacttccaggcactaccaggaaggttctttgagatcagggttatgagtccagatccgagtggagctgggctccttacaaaacagcgactgggttcgtccatgttgtcaaaaatgactgaattttccttttttcattgtgtgtaattaataacgcatatttttaaattgctaaaggagtagattttaaatctcatcacaaaaaagataagtatgtgaggagatggatatatgaattagcttaatttaaccattctacaatataaacatgtatcgaagcatcacagtgtgccacttaaatatatataattattatttgtcaattaaaattaagaaaatgacagcagtgactaggtaaagagagctccaggtttcttacccacaccttcagtgaaacctgcttcctttttattcctttttcacatgaatttctatgaaagactttgtttaaataaaagcgttcatggccgggcacggtggctcacgcctgtaatcccagcactttgggaggatcaccaggtcaggagattgagaccatcctggctaacacagtgaaaccccggctctactaaaaatacaaaaaattagccaggcgtggtggcaggcacctgtagtcccagctacttgggaagctgaggcaggagaatggcacgaacccaggaggcagagcttgcagtgagctgagatcacgccactgcactccagcctgggcaacagagcgagactccgtctcaaaaaaaaaaaaaaaagaaaaagaaaagaaaaagcgttcgtgataagaaaaaagaaacccttgcagaccacattcctagataaaataagcagattgtccttttatcagccattttgctttatgtctttttctatccaaatgttaaggaaaggtctatgtcttacctattctgtgtgtgccaaagaaggcactttatacatatctgcagctaatgatgaactgtgtatgtaataaacaggagcaaggcattacacaatgaaatacttgtttttttgtttgttttgagacggagtctcgctgtgtcgccaggctggggtgcggtggtgctatctcagcttactacaccatttgcctcccaggttcaagcgattcttctgcctcagcctcccgagtagctgggactacaggcgtgcaccaccacacccagctaatttttgtatttgtagtagagatggggtttcaccatgttggccaggatggtcttgatctcttgacctcatgatctgcccgcctctgcctccgaaagtgctgggattacaggcatgaaatacttgttttgtatgtactgctcattaatagaaaaagaccagggatgataatacatgacatgaacatctatttaaaacttccccttggaagccatagctatatcataatcttaagtcctgacaatctatataaatcaaagtttcataactatatggataattacgtttgttgaaataaactcaagaaaaaataatatctaataaaatattttagtgcatgttatcactcataacaccttttgaagatatctggaattttaagataatataaagctcaaaaattttacctgtttagctttgtggtgtgttatggtttttatgtggaaattaggaatacttcatttgtactctccaaaatatactttgggttttttatcagttctgtgaccagaatgtctaaagtttattccacttcacaatgtgtttagttatacctataaaaggttttctcattcttctcaatataatcttacatattaaaaaatccttcatgtaccttgtagtttattgaataactactataccagaattaactaataatactggttctaccttctgtttagtaatttaatccattgtcactggaggctttctcattttgtgtaagtgttaagacaagtttgatctaataataaaacacttaatacgaatgcatattttaaatatgttgctaatagtgataggtgttagaattggaataaatcagccttcataattatttcctgttagatttctgatcatggttttgagatcattgacataatctaagattccctatttcaacagtagaacagatgtcaagtggagttcccagcaggtatggttctgcctactcagtcatgtctgttaaatgtgtgactacttcctgtgtgacgattttcatgtaaacctaataatccttttcaattttgtctactctcaagattttgttgagaaagaaagagatagaccctcttgaattggatttcctgcttcgattcacagttgaacacactcatctgagtcccgttgacttcctaacttctcagtcatggagtgctatcaaggtatgttaggaatacagtttctcaaattctggatcttatttaaaatattagctctctccagtgttgaaatgtaaacattaaagaatacaggtgatgtattaagcaccatttcagttgtagaaatgcactgtataatgtgatgttattaatctttgtattattcaattggttaatttctcatttagatgtaaaggagcttttggcttatgtatgcgtggaaaagttaataaatatgtacaatctgtcaggacctttgataaaagccaagtgatacaaatgaatatttttaaaaagttccttaaatctaaaatttgttttctttttaaatttccttaaaaatttgttttctttttaaatcgtttcaccatttttctaaatagttctttaaattacaccacagtggagtcgtttattctcattgtaaaatgtttaagaaaaacagaatattttagagaaataagtgacagttgccttaaacctcaattatcaatcctcattgcatttttctgtcaaaggccctattgttagaagttaattcttccaggatctggagtatcttaatgatgttcaacatatgctaagctttgccctactcttttttctaagaaggaaacatttctgtgcattggaaataactgttacctcttatttttatatatgttcagctttttaaagtagtatttgtaattagattgtaactttagaattcaaaattcaaattcaaatgtgtatcagtcagggtcttaacaggaaacagatggcacattcaaaaggttgatgaagaaagtttaaccaagagtctgttttcatagtatgggcaagaaggattaggaaatcaaccaggggatggggaaggaaaaaggaggaaaaggacagttactggaacttcataagaaatgaagttatgggagagagccaaccttagaggatctgtggcctgtggcagagaaacatagtccctcccaaaccacattcccacgagaaagagctggggtagaaatgtttccagaaaggggtcctgatccagaccccaagagaggttcttggatctcgtgcaagaaagaattcagcgtgagtctgtaaagcgaaagcaagtttattaataaaggaataaagaatggctactccatagggagagtagccctgagggctgctggttgcccatttttatggttatttcttgttgatatgctaaacaaggggtggattattcatatctcccctttttagactttatagggtaacttcctgacgttaccatggcatttgtaaactgtatggcactggtgcagtgtagcagtgaggacaaccagaggtcaccctcatcaccatcgtggttttgttgggttttagccaacttccttactgcaagctgttttatctttatgacctgtatcttgtgccaacttcctatctcatcctgtgacttagaatgccttaacctcctaggaatgcagcccagcaagtctcagcctcaatttacccagctcctattcaagatggagttgctgtggttcaaacgcctctgacagaagtacccccacctctctcttctccagtcttccaggctcctgccattgctttctgttggccaaacccaactaggtcagggaaccagggaactcagctcaagtgtcctttgagcttaccctctcagcagagcaaaaaaaaaaaaaaaggaaatctgaagaggagagtgaatactatccagcacagtttttttacataagattagatacattcacaagtcttcttctcaaactgtaaagtatcgttcacaccattcctacttgtttccctatcatattacaggcaattgccgtcatggaagaatttcgaggcatagaccgagatgtggaaggatctgccaagcagtggaggaagtgggtagaatccgagtgtccagaaaaagaaaaattacctcaagaatggaagaagaaaagtttaatacagaagctgattcttctgagagcaatgcgccctgacagaatgacgtatgctctcaggtggggtggtcagcatttttggaaacatgtattagttaacatagaggaaatgtagtctgaagagttaggaggatctggtggaagtgtttaccatccattttgatggggagtgattctgctgagattttgatattataatcactgctactgttaaaatttgctaaacactaaaccatgtgctaggcagactcagcacattcttcccaaaaaagcttaattctgaaatcagtactggagacaggggactgatggaaatattcctggaagagaaatgggtgtcagcagagttcagaggccaggaacatgcattcatgcattatccaagtgtaatttccatcgttttctttcagtgatggcattttggttctgaagattttgcatgtcaaacaaaaatgcattcctttcatggagtcactcatagtccctataactttacaaccaatgcagtttcaaagcagaaacccttgtctacatcttggtttaagtgtcctttttctttgccctcttggcttctaaatggtaatgtgctgcttaattcacacaagtctcattctaatttgaattcaccaaccaaagagttctcaacttccttccctattgtgtttcttcagtaatattcatgtgcctcaggttttttcctttgctttgtctagttcagccaattttccctttgcagaaacctctgctgaactctactttacaagttaattctgcttagtagtacttactttctgctaaatctgatgctgctggaaaataatccttgcttaattgagcctccctgtgttagaaacaccccaaaaagcatttgtatattcatgagaagcccagcaggctggaaaattgcactgtggcaaatctaatgaactgttaataagtaatgggggaatctggcaggggatttgggggatacaaagccatagcagacagctgatggcactcaggggggtctcagtagccccccaaaatggaatgtaggcttctgattttcagagcttctaaggaagagaaggatttcattgacacacctaccgcatacatctagctggattcatattgttattctaacaagacatcccatgtaataaacctggttacttctatcgtgtgcctgtgtggtttaagcttatccaaatggtgactcttttcaaggtcaaaaccactgatcatgtttttatattcttgttttttatagaaattttgtagaggaaaaactgggtgcgaagtatgtggagaggaccagattggacttagttaaagcattcgaagaaagcagcccagccacccccatattcttcatcctgtctccgggggtagatgcccttaaagacctggagattcttggtgagtggctgggaggctcgctggcccgccccttctccctccctccctttcacccccacccctgcccttcttttcagttcacagtgatcttagtttcttttttttttttttttaatttgttgaagattgggtgtatggaaaatgtaaagctaataaccccatagtctgaagaaatgttgaaatggaacattcatgtggctggcataatgcaagtttcttttgtactgttttccaccttttgactgtatgagggccagagggcaattttccacatgctcatgtaatcttgtgccccctgtgactaaataatggtcattagagcaagtgtatttgattgcgcaaggcactgtcgcctttgtgttctggattaccattccccacggcctgcaccaagaataccaggttaatatagctgtgacctgactgtgctcaatttaaatgcagtctcacaaggtgagaggcttgtgcatttacccaatgaacagatccattcaaaaaaaatgatgtgatatctaccacatgttgctcctttttatgagagaaatgctttgctactcctgcaagagtttataaagctccataacaatgcctgccatctatcaaaatgtcaatagcttcattatcataaaaccaaaggaactggcttccacggcttttctaatgcttgcaatgaggcagctgtggagagctcaaaatgctgcttgtggatacaacagaagtttctttgggattcttcaggaaagtcactcagaagatggctgcggtgaccacagatgtgcattagaccacagaattccaggctcctctcaccctccttcatagacatttcctctcaccgtggtgtattctcccacaggcaaaagacttggctttacaattgactctggaaaattccacaatgtgtctttaggacaaggtcaggagacggtggcagaagtggccctggagaaagcttccaaaggaggacactgggtcatcctccaagtgagtattaagtttcagggaagacactgggcataaacacagaggagggccagggcagagctggcccgcccaacagaatgctcccttaacaccgctgtgcatggcgatttgcagagtgcaagcagtactgtcagtgttcatgatgcctgcaaagatggtgaggggctctgcggacagcgatggctgtcatcttctgagagactgtctagccattgtactctaaaattaaaactattaggaagaacttcgtcgttcccctcacttagagatatctggaacactcagtagtgcctgagaacacgcaggcttgtttagattgctaacagtgttatcatagtatctgggttgacgttagagtcgacagaactcttttttaatgtatattgttgttgcagaattttgctccttagcatagctaaaaccaggtccttgtcacacaaccagaaaggactaggaacacagacacattgaagggtggggggaatggaatttattgagcgaaaagaaaaaaaaaagtctcagcaaagtgagaggggatcctgctaacacaccccaacctcacagattgaataccaggccactgcccaggagctgtggaggccaggctcctccccgctgcaaatggtgtgaatttcctatggctctaccacattctcccaatgcacaggcaggtcagagattctctggggaccttccccaatacttggctcctgcatcaatcattatctcatacaagtccaactctgcccctacctagtgtgtaacattccctttgattgtaaattataggggtttgagtagacaactcctttatcccttctcaggcaaacatcatacagacctttggttctcccacccagtgtcctctgggatgccccccttggctgagtattacaagaaccagtggagcacaggccagcattagggggcacctgaggaatgtgctgactccatccacagcaagctctgctagctgtctcactaggtctaggaatggctatttagttttcagctgagtcatgcaaaggttctcgtcagtaggcaattcacaggctgccttatctggaatcattacaacaaagctcctaggttaggagtcgtgattctctatataaagatgagaaaagtgagcatccgagtggctggagagcctcaaggccacagggctgattggatggcagagctggtacttcagtctaggactgtttagcagcaggtgacattcctgaaaatagccaccctcatgcaagatacagcgttggcctcccttagtgtctccagtatccaggctcggtgcctttggcatttctgcttgaaatgcaactggattcataaagaagcttccagagtccaagcaggcttatgattgcaggaatgtaaccttctgggatgatgataatacccactgcttagatgaggccttaatagagacctttgtaaggggacttgagggcagtgtagtgcatccccttctgaggctcagaaacacaggagggttcgctttttcagagaaaacagttgacactcagacagttaggtaaattttaaggttgtctcagaaaggaaagagctctttgagcattctcatgctcccagtggctcagactggagagaacactaggagggctatagtcatcctcaaaagaacgtattcaaaataaactatttccattacttttgtatctgtgctgagctatttgttgcccctaaaattgcaagttgtaaattttaacataaaaaaaacttaaaagatcttattttgtcaaggatctacttttggatatttgtttcagacctttgatttttgttgttagagctatgccagtaaccaagaatttaactgtttaaacctcttcactccccacccctgtacccacatacagtaattggtaaggagagattataccaggctttgggccatcccagtgtctagaagttgctagtatccatttgatcagcaggaaaaagagaagcaggactttgaagaaagagaaggcaaacataatgaaaacttgttatactgttcataatttacattaaattacattaacgtgggtatatgatatgtatgtacatgttaattagttcttacctaagccccaatgtgatcaattattatgattagatagagccctctaaaggtgtttagatagtagttaatcgaaagcccaaattccagagaaaactattataaaagtagcaggccggcaactatctttatctcacatgcacaccagaaggcttgtgaattaacataacagatattaaaaaccatttttcaagggcaaaatgaccatttttcatgcatttccaagacatatagattgtctaaaagtgttgcacaagcattgctgttcttggaaaaataggcataagaatctagccagtcccaaagccagtaccctcaagaatagctgccaagctagattccaaagtgtgcctgtgctccacgatggcttgcttagaggtttttctgtccccttcagtgactccaaagtcactacctagaatatttttacatttgattcaagtaaacttttcaagtaaggtactgttgtagcccataagacagagaatgaagatataattgagtttacaaagcaggttttattattgtttctgttgttttcttttatgattggcacaattaggaatgagaaatacgctttccttataacctgttagtaagcatgtaaaggagggaacttagagtccttacctactgtattactttgctagagtggacggccaactttccgtgtcttcatgtgatttgtcttctgtgtttctgggtcctaatcccttcttctcataaagacatcagtcatattggtttaagacccttcattggcaggatggggtggctcaagcctgtaatcccagcactttgggaggccgaggagggcagatcatgaggtcaggagatcgagaccatcctggctaacacagtgaaaccccgtctctactaaaaatacaaaaaaaattagctgggcgtggtggtgggtgcctgtagtcccagctactcgggaggctgaggcaggagaatagtgtgaacccaggagacggagtttgcagtgagccaagatcgcaccactgcactccagcctgggtgacagagcgagactctgtctcaaaaaaaaaaaaaaaaaaaaaaaaaaccttcataatgaccacatttagcttcaattatctccttaaagaccctatttccaaatacagtcacattatgagatgctgggggttaagacttcaccatatgaatttgggggtgcataattctgcccaccacatctaccagtgttcattatttgccaagggaataaaagccaataatgtgaatgactgagtgggcttagatctttttgcaatagaaattttaaagaaggatacttgcattattattttgttccatgtttgccctcattctctgtatttttgtagctgttataatcttaaatgtttttctttgttggaaataattatatatatctgggtgtgacatttcaattactgtatcaaggacttctccaaagccagagaacatgtaaggtgcagcctttatatctccctcccagcaccaactaccaagctataacctgtaggtgtttggtattggaagagcaaatttgtgaatcataaaatggaaaagaaaagaatgacaacggtggtggcatttaattttttgtgtgtgattttcaacagacctaggatttaaggaaaatcatctgttaggaataaacaaaacatcttaacaatgaatgattgcttgctttcagctagccttgcttcccttatttccttttgagttcatatgcttatgagtaggagtttgagtagaagaggtttccatcagaaaccaatgaagagggtgtcaggcacatttctggcttttagttttcatattttctcaaactaaccccaatatgtctcagtaattgtatttgaaccataacaaagaaaagtactaggcaactccatctcagaagtgactggtgggcttttgaagtaggtatgtgtattgcgtggagattttggattacaaagacagtctgtgttgattgggaacatttaatatgttcaaggttcaattcccttttggctttttttttttttgatgtattgatgtattgataaaggaaaatttttatgatgtattgataaaggaaaatttgaatcatggttctctgagttttcagtgcaattatatataggaaaatgtaatcttataattcaagtaatatgcctcaccttcacaggaattatgcaccatgctatctttcagaatgttcatttggtagccaagtggctaggaaccttggagaagctccttgaaagattcagccaaggaagccacagagattacagggttttcatgagtgctgagtctgcacctacaccagatgagcatatcatccctcaaggactcctggaaaattccattaagatcactaatgaacccccaacagggatgctggccaatttgcatgccgccctgtacaactttgatcaggtaagaaagcgaagcaggctaggcagacaatgaagtcagagtcatctcacaagactgtggggcccagaatcaacccaggcatgtcattgagagggatgaagcaagttcttaatgttcgcatgtggaagggtaggggtgggcgtgttttaatctcttgaaagaattgcccctgtcatttccgattctaatgaccagtaaatatatttcagtctcaccctaacattaagaaaacttcagctactgtgtagggaaagctaactaggtaacttcttgaggaggttgcttttttttttttttttttttttttgagacggaatctcactttgccgcccaggctggagtgcagtggcatgatcttgcctcactgcaacttccacctcccgggttcaagcaattctcctgcctcagcctcctgagtagctgtgattacagctgcataccaccacgcccggctaatttttgtatttttagtagagatggggtttcaccatgttgaccagactggtcttgaactcctgacctcaggtgatccacctgcctcggcctcccaaagtgctgggattacagacatgagccaccgcgcctggccggaacttgcttcttgaaaacaaatgtggcacactagtatctctgaccacagaaagagaagaagccattgttattcttgttgatgatggcgacagtaatgacatggtaaaagtttcagtgtagtgttttagcccggtttgatatgagtaaatttaaaggcctctttttgggttatatctatgacaccttatttatatgttcatgtttttccaagataagacaaatgaatacttacatggtttttttttgtttttggtttttttgagacagagttttgctcttgtcgcccaggctggagtgcaatgacatgatcttggctcactgcaacctcagcctcccaggttgaagcgattctcctgcctcagcctcccaggtagctgggattacaggcgcccaccaccaagcccagctaacttttgtatttttagtagagacagggtttcatcatgttagccaggctggtctcgaactcctgacctcaggtgatctgttcaccttggcctcccaattccaccttggctggaattacaggtgtgagccactgcacctggccaaatacatatataaattaatacataaatacatacgtatatatacatatatatacacatatatatgatatatatatgatacctttattaccattactctttttacccaaactatcctatctatcaacatcattgtcaagtctttcagtttcctttcttgctattgctctgagatcttccttccttcctctaattttttggaaatccttggtaaatcgcattcttgttaggacagtagaatgaaccctaaagaggaaatacatatgatttggtgataaatattcagccccctcttagaaatatcattctctacgaagcatgttaacatccttagcttcttttctcgtaacttttgggtcaatacgtaaaccaacattatgaaggaattatgataattgactacctaagaatacagtgttgaagaatgcagttaattacttcattaaataattgagtaatttttatcctatatatacacacaagattgtgtaaatagtaggactcaaaaaatctttttgaaactattaagtatctgcaatatgccttatttaatccactatgacagacatatatgttttttaatcatctcttaatttataatttctggctatttatgacattttcaagctatttcccaaagtacatacaaagaggaatttgatttatttaaataggacttatctgccccctaaaataagtatctttattcatgaaagtgaacatttcatgaacaaatatgcttcagcccaattatccttcagcttttttgttcgtttgtttgttttgtttttttggtaaagatcacttcgagaatctcataaaactgtggacactctccccagggaaatacacgttcgaaaatatactgcacattgggccagacacagtgcctcatgcctacaatcccagcactttaggaggctgagaggaggatcacttgagcccaggagttcgaggctgcagtgagctatgatcacaccactgtgcttcagcctgggcaacagagcgagacactgtctcaaaaaataataataagtgttaaaaatatgttgcatataatgataaagattcacagattcccccaaagcctatgcatgaattccctagttaagaacacctgttctggtcttttcatgaacctgtcaattcttttgactgctatctggaaagccacttttattaattgaaggttacttttattagaagggcttttaggaacttcaaggaagaatatttcttttttttttttttttttttttttgagacagagtctcactctatcgcccaggctggagtgcagtggtacgatctcggctcactgcaagctccgcctcccaggttcacgccattctcctgcctcagcctcccgagtagctgggactacaggtgcctgccaccatgcacggctaattttttgagttttttagtagagacggggtttcaccgtgttagccaggatggtcttgatctcctgaccttgtgatctgcccgcctcggcatccgaagtgctgggattacaggcgtgagccaccgcacctggcccaaggaagaatattgcttatttagtggagaggatcctctgaaatattaagactgaacttgatgttaagtagcaaaagcaaagataaccaaagtgattcactaaataatcttctcatcaaacctatcttagccagagccaaccaacaaaataaaaaatgtgcagaaaatctaaaatgttagagtcttttatgaatgctgacctgtcattatgttagaaaacaaaatgcagtttttaatcagattatataattcaagggatttagcctgtgctccctggctctctgtgaatatgttcccattgcccttttatcagttagaatgttgggttggctacttttgaaaaaagttcttataaaataacagtggcttatacaaggtcaaaaagtagtcctgccacatgagagttttacagatagtccattcagaagtcatgtgttaccacaaattgtcatcaatctggctctttatagttcaccatttctagaatgggcttttcacggtcccaggtggctgcaggagttgcagcccccatatccacattcctgacaggaggatggaagaagaaacaaacaagatgacaaaaggaaaaggacggtgtttgctttgttgtgcaagtgcttcctacaagttaacaaacagaaattctcctttcatctcattggtcaaacttagtcacattgcattacctagctgcaagagaggctgggaaaagtgaatttatcttaagcaaccatatgcccagctaaaaattagcaagaagacattttaaggaaggcaatcagcagtctccatcacagatgtcctttcccacatctccttgtattatttggggtgttctgtgttgctgctgtggtccaatcttgttaaagcctgtgtatggatagattgatgaatgctatctctcttgttacccatatgggttaggtaaatgaggaccagttgttcctgttgcctgggtgtccctcacagtggagtaaaatacccaagaggtttagacaagtcaactgtactgctagggtatttttcaaatctaattaaaccttttttttcttttttttgctctgtcacccaggctgaagtgcagcagcacacttatagctcactgcagccttgaactcctgggctcaagtaatcctcctgcctcagcctcctgagtagctgggactacaggtgtatgccactatgcctggctaatttttaaatccatatttttaatctttcccctcaatttagaatttacctccaaactttggcatgtgtattcaaaatgaacagtttgtttaatactagtgctttattatcctgagcattccagaatatttatgtaaatttaatcaagtggctgggacataaagaaccatttcttgtaggataccatctacctacgcctttcagctaaagagcctcttgaggctaggcacggtggctcacgcctgtaatcccagcactttgggaggccgaggcgggcggatcacgaggtcaggagattgagatcatcctggctaaaaaggtgaaaccccatctctactaaaaatacaaaaaattagccaggcgtggtggtgggcgcctgtagtcccagctactcgggaggctgaggcaggagaatggcatgaacccgggaggcagaggttgcaatgagcagagatcgcgctactgcactccagcctgggcaacacagggagactccatctcaaaaaaaaaaaaaaaaaaaaaaaagagcctcttgaggaagatgtagtaaaggagtactcttttggctcccttcacacccagataactatatttttttagagtaagaagatagatttctgtttctgtaaaatttgcaggcagaaacaagtaattgatcattgtgcatataaaattggtaattgtgtacaaatagcactactatgggtatgcagatgcctgttctttgttcacaatggagtctgtattttttaaatatttccttatcacttggtttgcaaaaatacaactggcctgaactgtggaatggtaggtagactcataccttttcttcagaaagcctgattcatatttttttcctgcatcatttatgttatcagaacacaaagaaatggattgacttgtttcttttagcactgaggataaagccaagtcatttatataaagtacagattgaagtaatgtacttagttattatagtaccttgggttttatgtggactatctgtaattcagaaaggtattaagtgatttgttagatcataattccaaagtgaaattttgatacatatattggatctcctagaaatttctcacatttaaaagtaaattttttttatacccttcaaggttaattccagttatacggtttctcttttctgccttcacaagcttgccctttatttgtggaaaagttattttttaatgattgtatatttccaagccccataaatgacctaaaaatggcctagtgatttagagtgacctagtgatttaattggatctgcgctacatgcttcctggccaattctagaaccgtatttggtgggagccctggattctgctaaaagcactgtctaaagaaactgaaaagctctctgatcctgacccacagagaacaaatctggtcttggtttagtatcacaagtcctctggaagactaggtctgaactactcacactggttctacatatacttcatatatggcccaagttgtcagatccatttcaaatgtgaactggctatagtttgcccattttaaaggacaaggcagggaagggcagattttggcctcttcctcccctgttgctcaatgccagctgaaggaatagtcctcaacttcctttccttgcctcacagaactgccaaatctgaacatgggtgaaatatgacttttaagccatagattggacagctatttttcttttaattttatggctgttgggccataaccgtatccatgtagcatgccaggattccattttccatctgcgttcttaaaaaaaaatctcacaggtctaggctgggcacagtgacttgtgactgtaatcccagcactttgagaggccgaggtgggtggatcatgagatcaggagttcgagaccaccctggccaatctggtgaatccccatctctatttaaaaatatatacaaaaattagccgggcatggtggtgcatgcctgtagtcccagctactcgggaggctgaggcagaagaatcgcctgaaccctggaggcggaggttgcagtgagcagagatagcccctctggtgacagagcaagactccatctcaaaaaaacaaaaaacaaataaacaaaaaaaaaacctcacaggtctagacacatgtttcccaattttccatatatcacccagtcatcccaacaatgaattttacttttagttcattggaaggaaataatgtgtcgtggtgattttattagttaaggtacaggctaagctgctgtaagaaagagaatcaaaactatagggattcaaacaagataggagtttttttctcacacatattaggcagctttgttccatgagatcattcatacgcccaagctgatgggtgcccctgccatacctaactcaagttttccagacttgaccaatcatcatcatttctagccatagaaaaggaaagagttcgctgggccccgcggctcgtgcctataatcccagcaccttgggaggccgagcagggtggatcacctgaggacaggagttcaagaccagcctggccaatgtggcaaaaacccatctctattaaaaatacaaaaattagctgggtgtggtggcatgcacctgtaatcgcagctactcaggaggctgaggcaggagaattacttgaacccaggaggcagaggttgcaatgagctgagttggtgccactgcactgcagcctgggtgacagagcaagactccgtctcaaaaaaaaaaaaaaaaagaaagaaagaaaaaaagggaagagtgacaactaagacaagcaatttcattttcagcaaatgacctggaagttatacacaacactttagctgaaattctgttggcaaaaacttggttggatgacacaaatggcttcatgggaggctgggaaacagtcaagggtgtccatgtgcccagagaaccagggaagaatggatagttgtggttaactagcattctcccaaccgtaatagcattctactacagtgatgaaatgaagatgatggctttatgtcatccagattctgcgaagaaaattttgcagaggaaaatgatgtcaagcagtatgacatggttaaaatgaactgtctcattttctagtgaacttagaagcattcagaagcatgactgaagcaaaataaaagtattcctcttaagccaacagactggcaaatgccaaataatctcctgttaagcttctcattggataagtagccatgctgaagactgcctctgtagtatctcactctcaaagttctttacaagattattgaaaacgcagacccttgctcttggaaaccatacagatggataatcaagcatttcttctcttttttcccaggatacacttgaaatatgctccaaggagcaggagtttaaaagcatccttttttctctctgctacttccacgcctgtgttgctgggagactgaggtttggcccccagggctggagccgaagctatccttttaatcctggagacctcaccatttgtgccagtgtcctctacaactacttagaggcaaactctaaagtaagtgctagtggtcaaataacctcttccaaggagtttacaaagctgtcagtctttgggcactatcaaaattgaccataatttctcttttgaagctattattgaaatagctgacactatgtatgtatcttctgccaagtgtgaaaataaaccagatcaaaggttttccagcagtggatgtttgcacttcatgagataggtcaaaccagttctacatcagcagcttagtgtaaaaaaaaacaaaaaatgtccttcattatgttaacaaaaacagtggtttacatgtgcgtatatgccagattcattaggcaggtaatgaagcatttgcacaaatgtaattacatacagcaattctgacagttcataacactgcattaataatcactacaattagttctgatgatggaagcaatttacagcgcgtcacatgtataaataatggtgcatttcctgcatatgtcattattatgtattaaggatgccaccttgttgtgactttctcagtaatgttccccttgatttgaagttaaaggtagatgaatgattttatttcgtagctaaaatgtgttttacagatgggaatgggaatgcctcatcaagaacatttgtgtaagttctcataaacccaatgattggatttcaaaaagcaagaaccattcattcctaaggattttctagcttaatcctcacaagggaaacttttttcattaagttaaatccgttaagactaggatacatgtgtcaaaaccagtcaagtgttgtactctaggccacattttctataaagcgtttttaaaatcacccgtctctgtttctaaatggaaactattgttttatgttccttcagtaatgattgttataacttttttggtcagctttctcaggcttcggtggtgatttgattgctattagaatagatacccttggtacctaacaggcatattttcccaaggaacaaattttaaataagttgtatccaaaataaatggttttaatatggtatttgatgttcagtgttccatatctctcatttttcaatttatagaattaagtaattctgaatactttgagcatattttgaccattctattaaatagtaatatttttgtgttgattcccagcacattttgtctaaactattgcacataaaattataacagttctaggtagaaaaaggaatggaccatttaagacttttattcatgtccttcataactgtcctgtgaggctgcaaccgggaatagaatcgtatttcagctgaatcctatacaccattgaggtggaaatgaaggggaggaagagggaagtggacacacgtgtttctctccagctcttacatcctgagtcttggaaacaccagttgaccaaccgagtcacactgtgtcctgcttttttttcatcctggggctccaggatcagcacagccttaagtttttaacacattctcatgtttctcagtcattttctgcacatcacaaggcgacttatcaggatttgggaattaaattcctatgagcacatgtttggttgtacaaaatggccttttcaagaaagtatatgtaaaaaacaaagaccaggattgagggaaagagaatcaattattgaaaagaacagatctgaggccaggcgtgatggctcatgcctataatcccagcactttgggaggccaagtcgggcggatcgcttgagtccagaagttcgacaccagcctgggtaacatggggaaacccagtctccataaaaaatacaaaagattagctgggcatggtgatgcacgcctgtagttccagctatttaggagactgaggtgagaggatcgcttgaaccctggaagtggaggttgcagtaagctgagatcataccactgcactccagcctgagcaacagagtaaaactctgtctcaaaaacaaaagaggaaagaacaaatccttagctaaataattattgaaaagaacagataattatttaaataattattgaaaagaacagatccctagttaaataaaaattaaaaagagatacatattgaatactgaaatgtgttgcaagcatcgattaaatgtaagcagaaaaagaactaaaagtcagaagcctttgttttccatccatttcagctatttggaaggtagtccatgcagtggttgagagagcatgttgcggtctaggcacccctctcttatttttcattcacctcaacccagcttaaaagacatatttgaggttcatttattcaaattcaaataaacttgtagaaaagtacattggcatagttgaagcaattttacttgttctgttctgtcacatcacgcaacaagcgaaggctataattataattatgtttttacttaaactgttgggaggcagtatactgcccccgaaggtgtaaaggttcctgtctagaaaggcttcatcacacactggcatgttttgcaaacccagaagaagctaaagtatagcaaagagaggcttcaaaccctgctcagccaaataaagagtaggtacagtgatttcttgaataaaacatggtatagtcattagttacaacccttagaacagtcattaggccagtcatgccgtaagacaagccctcagctccatctgtggcaaggggatttgtttgcctggacttttggaaaatactaggattctaaatacaccccaaattcaaattgtgtggatgttgctttcttttcctgaatcagataatacaagctgatataaagcagataataaaaacatgtcatacttcaaaggccctgtgaaccaacatcctttcacaatttttagatgagaatttgaatgtataaactttccctgcaaacatgttctagggatgactcagtttcttttaaaatctgcctaaggctgggcatggcagctcaagcctgtaaatcccagtactttgagaggccaaggaggaaggatggcttgaggccaggaattcgagaccaacctggacaccatagtgagacccccatctctacaaaatttttaaaaaattagcgagatgtagtgtcctgtgcctgtagtcctagttacttgggaggctgaggcgagaggattgctggagccccagaattcaaggttgcaatgagctgtgattgtgccactgcactccagcttaggcaacaaagccagacctcatctcttaaagaaaaaaaatcttcataaacagctcaatgttagtgaattttcactgactatattagaagacactgaaaataattctcccaagaaattctctgcagaaacttagacaatttctgaagcacctttaaatcctcctattgacggaggcttggagggcattgtgttagaggggcacgtgctactggttggctactctgaggcagactctgcacccagcagtgaatatttgtgtggttttctccacaggtcccatgggaagatctccgttatctctttggtgagatcatgtatggaggccacatcacagatgactgggatcgcaaactgtgtcgggtgtatttagaagaattcatgaatccatctctggtaagacatttgtaaattaatttgtaaataaatttcactgagcaaaaaattctggtaagaattttataaactaattatactatgggcaattcttaatgttattgaggatgcttggccttttgggaaatttcttagaaaagcggaatctcgggttccatcccagacctacagaatcagaatctgcattttcacaagtcttccaggtgatctctgtgtgtgctagagagtgcaccagcgtgaggcagcctcacatgcactgactcatcggctctttataaaaaccctatgaggtatgcagagctgacgctgttattcccttttctagaccgagatgctgaaacatggggatttgccccaggccactaggttggcacaggcaagagttttgtgcgtcttttgatagaagtcttttgatttctattccagagtttatttcactaaagtttcttttctgcctgtcatggaagtcctagaaaatagtctacagttggaccagtatcagttactcaattataatatgtgctcaagaaaaatgtggtcaatatgtatgtgaggtgatagatttgttaattagcctgatttaaccattccacgatgtacacgtgtatcaaaacatcacactgtgccccataaatatatataattattatttgtcaatttaaaataaaattaaatctaacaagatagtaaaaaaaaagattatatatatcaaccaagggcaaggtaagaaccttatttggatcttgttccaaatgaactataaaaaaaaaaaaaaaaacacacacatttatgacacaatgggaaattaacattaacatatcatggtaatatagaattcccgttaatattttatgtgtgataataaagtaatatagttatgttttttaaaaagagaaaagatgctccagggtgaacctggaggacattacgttaaatgaaataagtcagacgcagaaggacaaatacatgttctcacacacataaagactcttaaaaagctgatctcctataaatggtgaatagaacagtggttaccagagactggggaaggggagaatggggaatgaatggtcaacagatacaaagttaccatccttagaaaggaagaataagtaagttctcgtgtcctattgcacagtagggtaactgtagtcaacaatacaatattgtatatctaaaaatagctagaagagaggattttgtatgttcccaccccaaagaaatgagaaatatttaagatgatgggcctgctgattgcctgatttgatcattacacaacatatacatgtatcaaaacatcgcattgtaccccatcaatatgtacaattattatgtgtcagttaaaaagacaagtatggtgatttgagaacctcattcttccttctctcgtgaggaagaggtagatcacccctgtaggtggagttttaaaagaccaagcatccttttcccatttctcatcttagtaaccctgtgtctgtgtagaaatggttccagcccggggctgtgttttctggaaaaagtactccatttttgtttctcgtactacagagggtgagcgtggtggctgtagttttctcatgctctctctccctcatggcatccaggttcatggccattcctggttatttcttggaaacgtaaagcacctgtacaccatatcatgtctatttccagttgggcgagacaccaactctgtttaaagcaatgctttgaatagtttgagtgatgtcctatttatagtttctctgaaaatttcacctcagagaagcattatatagatttgatcaccttcctagagttcattttgagaagtaatataatcatatcagtctaatatttagtgtatattagattaaatcactaaaatcatattagtctaatatttagtctattttagactaaaatacaccaggaaaacatagtgtattttagtctaatatagaaaactggggacattcttttgttactacttttaataatgtggaacagtttggagacagtgcaaaaaatgcacaatgttatgtaattgtttcttttgattgtgagtctcatggtctttccttagttctaatgagcaagatttcacatgtcagagagagacttccaatttagcacaattggaagtcactcctcaggaaaggtctgggagcaagttaccatggagatgggaaagctaaacagtgccaggcatgcgacctttacagaggctgatttctccgaatgatggtggagggcaaggggcccgcgaggagctcccctagctctggcctgtggctgaggggagaattactgttgccaaatgcagcagtccattaaccttcacaagcctgaactcccattcaaataattgtaaaataaatataggtgatgaaacctgaaggggcatcagtgatgtgtgtaagccctttagaaatttaggtacctgaccttacatacagatctggcgaggtttccaggattgaaatgcttcattttgcaagctggcatcctcactggagaggtacctcctcaactcaccaaaggaaattaaagcacttaactgacttgctgtcagaggctgcaaatcccagttattttgttctcatgcacgtttctcctgtttatgctgtttatatgattagcaacatgatctaacacttcatctgcaggacatctttttgccacttcccacaagtggttaacatatttggaaattagtgtctttggttgcattggaacatgatcaaaaagcaacccattcatggtgtggggtttaaagttctgctgctcttatccaaagaatcagaatgctttcagtgatatcttgctgttaggaggatcagtgagtttcttgttgaataaatgagtttgctctcagagagagttctccagtgggctttagagggtctctggccaaagtcaagaaagaaaacatcttctcacataaagcatgtatttggcagcgttaattaagaaatacagtaaatcactttcagagaataaggtaccaggtcaccttaaagttatcatataatacaaactattttagtaatatagaataacaagaatctggggtttgaagtaaaaaacaaagacaaaaaacacctgggttcacactgaagtacctctatgtatttgccgtatgatgtaattgaccctctcttagccttggtttcataatctacaaaaccagaatgatcaacttacaggtttgctgtcaggtttaaactttggtacaatgctagaacaatatgcttaataaatgggaaatctttttattataaagtatacattttcattatatatatttaatatttggctatacattaatctgtgataacaatgggaatcctttagtaaatacctgctctgtgccaagggtcattaccacacactttatatgtatgatttcttctcactataatctggaagagtaagtattattccatttaatcaaaaaagaacctcaggcttagagaggtcaagcagctgaaccagaatttaaactcgtaatcagactccaaaggctggtctttctctgcaccatactgccctggctggagtgctgagctgtttgcagcacaggtcaccaaaacaatgactcgtatttgtatgtagatggtgtacaggccaacactgagaacaacacgggcaatacgggagaccagagttctggttctgctactgacttgctgtctggctttgtgcatggcttccctgtgcctcacttcattcatttataaaattaaggtattgcctagaaaatcaccaatgtaccttttcattctcaagacaccatgataattcaatcttgagtaatgtctaaaaatccctaacagcactttggggccatggcatttttgacccagaaggccaagggcaaatgcatttgtttaaattcacaatgaactggagcttcttgtcattaccaacactacttggagaggcagtggagtgggggtcggtttttgttaaataccagaaaggaaaatataaaaaagacaataatctcatggagtccaacatagtgggctggatgctggttctccagtttctaataactgtgcctgcccctgatttcaacaaagatgatttcaattttttttttctttctttttgagacagagccttgttctgtcgcccaggctggagtgcagtggtgtgatctcggctcactgcaacctccaccttccagattcaagtcattctcctgtctcagcctcctgagtagctgggattacaggcatgtgccaccacgctgggctaattttcgtatttttagtagagatggggtttcaccatgttagtcaggctggtcttgaactcctgacctcatgatctgcccacctcggcctcccaaagtgctgggattacaggcatgagccaccatgcctggccgaaaatatcatccaaatttttgattatattttcatgatgtggaggttctttctgcctgagcatgattctatcgattctttttgtttttaaaaaaggttttactaagatataatttgcacactgtaacatttaccaatttaaattatacaactcaaaggtctttagtatattctgcaaccattacaagttttagaacagtttattacccacgccccacccacccaaaaaaaaaaaccctgcagccattagcagtcaggcaccatttgtttcccaccccatattcccctataccccagcccatggcagctactaatctattttctgtctctatagatttgcatgttctgggcatttttaaaaatggactcatacaatatgtagccttctttcacttggcataatgttttcaagcttcagccatgctgtagcatatatcagtactcaattccttttaagtctgaataatgttccattgtatggacatagcacattttgtttatctcatctgtcagtggacatttgggttgtttctccttcttggctattatgaataatgctgctatgaacttttatgtacaaattttgtgtggacatatgttttcaattctttcggatatgtaccttggagtggaattgctgggccaagtgataactctatgtttatcatttgcaagtaccaccaaactgttttttaaatagtggctgcaccattttatcttcccttcagcaatgtatgacagttctgttttctccacatcctcaccaagactgctactgtccacatttttttattttagccattctggtggaggtacagtggtgtcacattacagttttgacttgcatgtccctgaagactaacaatgttgaacatcctttcatgttctcattggccatttgtgtatcttctttggagaaatgtctatttagaattttttattctttgaggcattataacagctttctcagacaaacctcctccaaaggcaagaaagttggccactgtgtagagagctctacaatgatggccccattagcaaaaagcatcttttcataaaaagtcttgagtgggaaaggagaaagtctagattcagcatcaggattcacagggctccttgagtatattaaagtcttgatggttttcttaaagtaaaagggaacacaagtctatgtatggaggacatttctcaggttttgtttgttttttccttctagaaaaagcaagatatactaaaatcaagtctgctgctagggtacgaggaagaccaaaacttacataagagcctgctgtgtgctgagctgtttgcataccttattaaattcttatggccacaaccattaggttgctgttatgagcaatattttactgatgaaaagattgaaatgcagataaattgtcatttcttaaggccaccaacccattaagtgatggaagctgaatcaggctgtctagctgtatacctcaggcccttttgagttggctgttttcttttgccttcgctcattgcctaccatatggaaggcacttgtcacatgtctataaagactgattttctttccaaagagcatgggccatttgcaatcccatcagcagtacatgagcacgcattcaaacaaatgtccccatggcagcttaacctttccaagtggttttggttttggtcagtttctttgcttgaagttctgtttttaactttttgatttattaaggacagattaactgtggcttctgaaatttctttcaatttcctagtaagcacaaacagagaagaccaactacttgttttagggaataatgttcagttgggatatgtggattctaggttttggttttcttattcatattttgcccatatttttattctggctactttatccatcatagactaataataatgagtttaactctcctgtaccattttattttggtcgccctgagccaggtgacatttaaattttcattattcttatatataaacatgaaatgatacaaatgtgaataaataaagccaagccaatggatactggtggtgaaatagtccaacttcttccttcccatattcatcgggtcaagatttccatttctggcaatatgaaggattagataacttgaaaatcctcccggtacaaaataaaaataaaaataaaaatgctgtgtcgaatgttttaaatgcacttggaattcgcagaaagcagtcgagcatccttattaaggacataggctttctaagtaacctggattgcaggtttaagaaggaaagagaaaaccactgttacacacatgattgtgtggaaattcacacttactttgtcctctttagactctgagttccttaataacgaggtcatatggagcttatacttctaaggtttgttgtagtgtactgggtggtgggtacatattactgaatgaattaaagaatattcactttgtctccaagtgatagtgaggggaccacagtgtagcatacacagttacagacaaatcccatttcagaaactgactcagaaaatctaggtagaaaatagctacattcgatgatagtttaaaaataacattcctctgtacatttaagtgcacatacagacaggatttacggtgcaagagactgggagaattaaaacagaggggttaatggtccctggaaactaaagagcaatcagggaaaaataaatctgagattatactgttacttagaaaattgtaagcacttgattgactctgtgtttatggctggtcagagactcaggctcataaattcttttgttacattttgaagttctacattctaatgtttagagggtttgttattgctattcacattgcctttgttcaaaacttccccctaaattgaatgtctaccctcttgccccagccttattgaagtagatgggcacgataaaagcccgctttctccagcctttcactcagtaggtaactgtgtattgagctctcagggtctgtggatcctaaacaacagactttgctgtgagtagctcaaagtcctgggaaggtaggatcggtctgactcttagtatatatggcctatacatggtacttatatacacacacatttttcattaaatgcacatatcattatttataattataaaattcaggtatataaattcacatcatatataaaatgatgtgatgcagtactgtggaaagtatggtgccctggggaagtacaggctacagagtcctactaaaatgagttcagaattatgattaaaatcaaatgtctacctcagcaaattcacatcagagtcttgatttcctctctgggaaatggggatggttgggagaatcaatgaatgggagtgtgttatagggtagcccaggctctgtgatggctcattccttttgtgtgcatgtatcacactgccccatgcacactgcaaactgagtcttcttagggataggattaatgtgtgttccttgggatcttccgcagagatcagtctggtgttgcatatagagcaaaattgttgattataaaacagtttagggagcctgctacccagacagcattgtgctggagccttcttgtcagggtcttctcgaagtgttgaggaagtgaaaatggatgcctacctacatttggaataactgacttttcctttgtggttcaagactgaagatgaactgatgctggcaccaggttttgctgccccaccctacctagattatgcaggctaccaccagtacatagaggagatgcttcctccagaaagcccggcactgtatggcctccacccaaatgctgaaatagaattcctgacagtgacatccaacactctcttcagaactttgctggagatgcagcccaggaatgcactcagtggtgatgaactggggcagtctacagaagaaaaggtagagggtctttccttccttttctttttcattgaagtataacttacttgtactgaagtctactaatcttaattgtgcaaatcaataagtttttacctaggttttactcatacaaccaccacctagatcaaaataacatttccaacactccagaaggatactcatgccccttatcagtcaacatacccctcacctcccccagagataatcagtatctttacctctatcatcacagattagctttacctgattccaaatatatggaatcatacagtgcgcattcatccatgtctaactcctttcattctgcattagatttgtgagattcatccatgttgttcatgtaccaatggttcatttttgttttgaattctatatgaatataaaattcttcattgtactgtgaatggatgtttgggttgtttcttgtttttcacttttatagaaatatcacaaccatgaacattcttctgcagtcaatatgcaaaggtaactcccaaaggcatccattcatactacccatttctctatacccagaagtgggattgccagataacagggtataatgtgtagctttaatagtattcccaatcagttttctccagtggctgtaccagttactttcccaccagcagtgcgtgtgagttccacttgctctatcttttttgtgattttgtaagggtaatgatatctcacagtggttttaattttgcaatcctcaattgaggagtaatattgagcatcttttcacatgcttatggccgtttggatatactgtctacctccactgtaaatgagtttaagatttcaggacctgataaattgccggtcagagtgatgccagctggcaggcatgatgtcagaaccagaggcagtagtctgagaaagcaaggaaagaaggaaagctgcctgaggctaaggacaggcaaagttcctccatcttttctcctttctagatattgactggtttttccagctcggtggagctgtctacatagaattagtatgcatgtctgagtaccatgtgcatactcatacctgtaatatatgtctttcattctttcagagcaacaattacagaagatagaagtttctttgttaaaaatgttgatgtaaattggtctaggaattttaggatgccgtggttgggagggcagcatcatagttcagcagaatttgcttacgcttaaaaggcttatttgggttatgtgacttttattctattttattttttattttttgagacagtttcattctgttgcccaggctggaatgcagtggcaccatcttggctcactgcaacctctaactctcggattcaagcgattttcgtgcctcagccacccaaatagctgggattacagacatgctccaacatgcctggctaatttttatatttttagtagagacagagtttcaccatgttggccaggctggtctcgaactcctgacttcaagcgatctgcccatcctggcctcccaaagtgctgggattacaggcgtgagccactgtgcccagcccctggtttgtgtggcttttaaaaggatctttttaatttagcagattataaaatatggtaccctaataataggcttctacttcctctgatcatatctttacatataaataacatgtagctgatgacagttctatactccctaaatgttaagtgagtaaactgcaaacaactgtagctccttcttgaccagatttggggctccatggaaggggaagtgctggcactggtacagaggcaccaatgaggcagctgagggagttggcactgccatgctgcccacctcctgggagccgtaggcatccttcacatgcatttgcaggcaccttcggaagtcgtatgatatattctgtaacttcaaaaagtagaggatatacacagtcaccatgacgaaaactgaaatagaaaggagctaaatctttgtgttactgatttaaggttaagaatgtcttggatgacattttggagaaacttccagaagagttcaacatggcagagataatgcaaaaaaattcaaatagaagcccatatgttcttgtttgcttccaagaatgtgagaggatgaatattctcattcgggaaatacgtatatcacttgaacaactggaccttagtttgaaggtaagcttaaagtgaggctatagtagacttcagcacattggaagatattcactgtgtggctttttttctccatgcaagggggaattggcattatctcctgctgtggaagcccagcagtttgcattgagttatgacacggtaccagacacttggagcaaactggcttatccttctacttatggcctagcccagtggtaagctaccccatcctcactgccactggccctgagcagcctcggtgctgggttagtgttctgaataatgcttcctaagaactatgcagacggagctttgtgactgttctcaacctgtaaccgtaaaaaattcttccaccaatttcatttgagtttacttggtatattgcatcaaaggcaaaaatagttaaaagacagggtcagagcaagactgaaattctgtcgctcactcattgatacatgatcttagacaaaataacctgtctcttttttaaatctgaaaaatgtagatggcaatagaatcccctgagttgttgttaagagttgaatggccatggaaagcaacttgaatttgcctttgtgtcatcttataactttactttgcaagcctgagattcctctgccttctcatagacaacctttgaaagtttgtaatatggtatgcagtatgcagtaaactagactgggggtataactgcagagatgtgtcacaaagctagggcagaaattcacagattactgaatgtaatctgtgctgatgttacacctaattgctccttggtcttggcaagcaattcaggaagtttcacaaagctgttgattcctggctttttggtgctgagtttctttccccctgctttcctgaatcattattccatgaacctcaactatccctgtaccattcctattattttagtggagactctttacattgtagcatgcacacttttgacttttctttctttttgagacagagtctcactctctcgcccaggctggagtgcagtggcgcgatctcggctcactgcaagctctgcctgccgggttcacgccattctcctgcctcagcctcccgagtagctgggactacaggcgcccgccaccacatccggttaattttttgtatatttagtagagacggggtttcaccgtgttagccaggatggtctcaatctcctgacctcatgatctgcccgcctcagcctcccaaagtgctgggattacaggcatgagccaccgcgcctggcccacacttttgatttttctaacacaatgttagagccttcagcttccctctgaacatcaacctccttctggtctggaattgtagttccaccttattttaagccacattatgtttgttgtgttttgtttgtggtcaatcattatttttgttttaatatactgtactgatttctttgctcatcattgctttttttgtatcttgttctgggcttttctttttttatcagagtataaaatatagagcagggcttggagggtgggggtgtaaatcatcttgtgtttctgaaactgtcctcactgcactctccttcttgattgatagtttacttatacgtagaattataggacacgattatttttccttcagcactttgatgttctaactccatggttttctagctttgattgtagagggtggatctggtcttaaatatttgccattccttcccaagtaaagttttaaaatgtttctctttacccttgatgttcaacaattttactattgtactgaggtatggatttttaaagtactgtcataaatgtgagattccatccatagcttttattctgaaaaagtcttagcacttttttctctgaatatcgtattctcctcatgtctacatttatctgcctgacctcttaacgttttcagtgtgtctttcggctgtatacttgtagacttcatcagttctgggtgatcttcattatatcttcaactgtctccaatctgtttcttaattatttagatgtcattgtccaggttgggcgcagtggctcatgcccagcactttgggagggcaaggcaggaggatcacttgagcccaggagttcgaagccagcctgggcaacataatgagaccctgtctctaaaaaacaataataaaataaataaaataaaaattagccaggtgtggtggcatgcgactgtagtcctagctactcaaggtgtagaggtggtaggattgcttgagcccaagaggtcaagggtgcaatgagccatgatcatgccactgcattctagcctgggtgacagagcaagaccctgtctcaaaaaataaagtatatttcatcgtccataattatcagttccaggttttttatatttttggaagggtgcctagcttagttttataatttcctgttttcgtttttatgactgttattctcttttcctgagaagtttaaacatacttacaagtaagtattttcttcaagacttctctatttcctgggttataaaccttcctgtttgttggatttgctggtggtttttcatgccctatactcttatgtctatacctgaatgacagtttggccagttattaaaatataataacaccctcagttggaggcctttgtagccatcactctcctcttgtcaaatgctgccgtggagatgtcaaaagctagcatacttcttttccctttataaatggcttcatgttttcccctggccatccagggattcttcattgttcatattattctttatattttagtattgattactctctaccaaattttcttggaacatgatgtgcccttgattgtatagattcaaaggtataatttaggaaaactcaaattttctagaattacactttttttttgagagattctcattctgttgcctaggctggagtgcagtgacgtgatcgcagctcactgcaacctctgcctcttgggttcaaccgattctcctgccttcagcctccctagtagctgggattacaggcatgtgccaccatgcccggccaactttgttatttttagtagggatggggtttcaccatgttggccaggctggtctcgaacacctgacctcaagtgatccacctgcctcggcctcccaaagtgctgggattacagatgtgagccaccacgtctggcctcatttcagctttcattttattgctttcactctaaccctttacctctttatttccatttgtttttattattctcccttacgctgtttcacttttgctttcatttctataattttattttctacttcttatttggggtcttcaaacttaatttccttactatttcctacctgatcccttctaagtcatgatcttgtttatatcaacaatcacttgttttagttgttacaaattgtctgcagtgtttatcctcatgatggcaacattttgagagaaatgtcttcctgcctttgcttttctcattcgcctttttcctttgtgtggtgcctatgctgtttcttcttcttatcgtcgagtatgctttttcggatccagctatctggaagaacttaatataggtccgggcacagagattttccttgtggtgacgtaagtttgaccgtgagcattctgagccttttcttcttcacggcccagagtcaggcaagtatctcaggcagacatgttctgccatgtggtttgtcagggtgtttcctcattcacccccacttcctttgcatatctgaagcagacaaggtcctagaaaacttcagtgccagcctttccttctagagaactctggcttttacactgaggctatgctctctactccattctcctggtcccctttaagcagcctctgaaacttacaattcaaggtttcacttctctcttaattttatcgaagaggttcatctgtccctagcctctgtgagccagcttccttataggtcaactgcaaatacttcctaccttgcccaattgtgaggagccgagaagagaacatgtacgtaacagcagcgtttctcaacccaccggcgtgccattcctggctgacttgttttcctaattaacctttttcctccccactttcaggcagctactgcacgtgcttagactgccgtcacgtgctccactgcctccgcacatgctgttccctctgcttatcaatcagatttcccggcaactctggtcttgtaaccaccatcacagccttgccatccctggtcctcagacaccctgtccatacctccaagttggcgcttgtcagtccaagtcatagggtgatgacctttgtatagtcaccacatagcatgaagaggctctaataaaagctgttgcataaatggaaatgagttttccacattcctcagtgtatcttgctctaatgtaaacgctacagtcatcaagtctccaatgggaaacaaactagccctttaaagggacagtgccctgcaaattgtcagggaaggattttaccagctagcagtggtatacttctcctccaccaccaccctgccctaaccgcccacaacagaacatactggaaaatggctattttactgaacagcaagtttttcttcctccctcccataaaccaggttcaatgacctcctcctgcgatgccgagaactcgatacttggacacaagaccttacccttccggctgtcgtgtggctctccggcttcttcaaccctcagtccttcttaactggtaagggctgacgcagtgcagcccctgatgcacacaggaccacagcctaaccagaagccctgctttgtttacctatgatggcgtctccttgccctgctcaccaatcctcaagcagcagccattatagaaaggaccagcagctatagaggaaacagagtcctgggcaggcgagtagcagcaggagggaaaggacctcctatagcagcaagagtagccaagtgaggtggggcacggtgtgctcttattaaacattttctggaaagggccacatagcttctctgctactgtagtgcgaaaaccacagacaatccacaaatggctgtgactattccaataaaactatctacagaaacagcgagcttgtcctgcaggccttagttggccaaccccctgctccagcgcagccatgtgccaatgcccaagaacctaaaacaccctatgggactaaaggatgcctcaatttactggtagctcccgggaaccttacatgcaacacttttatcctattcaatttttgttatatttccaaagcaatcatgcagacgatggctcgaaaaaatgagtggcccctggataaaacgcgcttgactgctgatgttaccaaaaaaacaaaggaagattatggacacccgccaagggaaggtgcatacctccacggactcttcatggagggtaagacaccccaaggggtaagtggggaaccttttcttactcaggttcagatcagtgtttgtcctctgcttactgtttctcagcatctcctcactcacacagtaaccttatgctagtcattatctcatttcttcctcttaaataatttaagtgctgggatgtgtgtccactgtgaaccaaactgtaatatttggggtgatggctatcacttaaattttgcacatatatctggatgttaatgccactgaataacatcattagacttagactgaatttacattctttttgcttttcaatataatcatttcaaaatctttcttctattgtttaaaaactgtcagtaaatttgctctaatgttttactacaagacttctccaagcctggaagatgctactgcgtagggtgaatctctaagagggggttagactatgcaatattttccaaatttatctggccatgcatttattccacaggacacttagtccctaccaagatgttcctttttcagtttaaagcaagtgccacaagttctggtgtaaaagaataaggtgcgacggggaggaaatgtggtgaactggagatttttaaagggagggcaaactagttcagtgtatgtgaattctcttagaatcccatttcataaaatcagcttacttccacaggaaagtttaaccactacgcatggaagcaaagcggtgcctccgctgcaggcagggtaacctacctttcaaagctcagtccggccagctcagtaaaaataccactgacaagcaaaaatatgacaaaaccagaatgttgaatgtttattgcatcaaacaacttacttgatcattatcattagtagcaagctgccacacaattgcaaccgctgtgtttttgccataggcgcccgctgggacacccaagcaggaaccattgttgaagcccgtctcaaggagctggcatgccctatgccggtcatctttgcaaaagccacccccgtggacagacaagaaaccaaacagacctacgagtgccctgtgtatagaaccaaactgagaggccccagctacatctggaccttcaggctgaagagcgaagagaagactgcaaaatgggttctggctggagtggctctgcttctagaagcgtaaggtaacactggcattcctctagcctctgctggagtgcagtgaggattttctagcatgttgctgcactgttcccatgcacattattctaactttttagtaactcacacgtgcattcttttttcaacgctatccttagagtgaaagtcagaaaaaaatactagaaactaactcagggctgagcgtggtggcacacgactgtaatcccagttactcaggaggtaggagaatcacttgaacctaggaggcaaaggttgcagtgagccgaggttgcaccactgcactccctcctgggcaacagaacaagactccatctc

SEQ ID NO: 346 - DNA, 45026 bp, Homo sapiens
tatgacaaaaccagaatgttgaatgtttattgcatcaaacaacttacttgatcattatcattagtagcaagctgccacacaattgcaaccgctgtgtttttgccataggcgcccgctgggacacccaagcaggaaccattgttgaagcccgtctcaaggagctggcatgccctatgccggtcatctttgcaaaagccacccccgtggacagacaagaaaccaaacagacctacgagtgccctgtgtatagaaccaaactgagaggccccagctacatctggaccttcaggctgaagagcgaagagaagactgcaaaatgggttctggctggagtggctctgcttctagaagcgtaaggtaacactggcattcctctagcctctgctggagtgcagtgaggattttctagcatgttgctgcactgttcccatgcacattattctaactttttagtaactcacacgtgcattcttttttcaacgctatccttagagtgaaagtcagaaaaaaatactagaaactaactcagggctgagcgtggtggcacacgactgtaatcccagttactcaggaggtaggagaatcacttgaacctaggaggcaaaggttgcagtgagccgaggttgcaccactgcactccctcctgggcaacagaacaagactccatctcaaaaaaaaaaaagtacatcataaaagtacatcatatgtgaacatgcaaaagcaatgcagccggaaagaacggagattttaatttttaacaaacaacaaattaaattattagcccttaaactctttcaaaatataaaagcagcaggccccaggtgagtcctgaaggaagaggctagcactctgtaaggcctccagtgtccagtgtctacaatgttgatggtccccttttgttcagtcaagttttaataaaaataaaactgttctacagttaattgcactttgttcagtgtaaatttccaatgaccaagagcaggttaaacgatgtgtgtggtctattaaactgtggtcactcgtgctaaggcacacttggcctggagtgagttactgtttgggaagccaaagatagatagatcaagtgcaggagctgatcatacaatgttttctctctaacttacttacctgaactttaaccccaccccatttaaactgtgctttttaataactggcagatatttttaacaaagttcagcatacagacaggtctgtgcatacatctatatagattcctctgctctgctgtcttcctgagaaatctttgtaagcatataaacaatctttaacaaaaaatagtaatttctacaaagaatttctgtataaaaacacaactgtaaaaaaatctttcttaggcaccaatggtatgcatgtcttgttggagtactctatggtgaggtggctggttctgtttgttttcctcttaattgtcttctaccagctccttttgtaagctgggaaaaagatgagaagtatttggtaaagtagtacaaatacacaaatggcattctaggcttgagagattccacaatcatctaagagtacaaagccagaacccagatctcctgacactcgaaatcctgacaatttatgcatcaatatccgtataccctctggtgtagtacgccccaagcatgacttgcctcactcccgcattccagaaccacgattcagagtttattaattacataaatgaaacttgtaactcacattctgtcctcttgccctgaactctctctctgcactaggattatggctgcctcttcataatctgtgtctttcccctcagcctgccttgtttgtttgttccttccatttctgtcatacacctcaaggagaaattttggttaaaggcaacgtggagttgagttgaaaaatctagcaaaggagaagattccctaatagggaaaatatcaggcctgagcttttccaatgcaaacagatacagaatggatggtactcgtggtttatataagtaagtaagtcacacgggaaggcaacaactacttgcccagagggtctcctgtgctcagcctcaagatttcaagctgttttgtaagctgctagagacttacttacctctccagatattccttaacattgtcataaccataaaacttggccagatgaatgaggattcctgtggcacagcggccgtcacgcttccgacagtagctgcaattgcagatcccacgacaggggggacacacccaatcctaacagagagatgacagcagacacttcgctcattatctacagggtctggcaagaactgggattcggatccagaatggctcagctggcctctcctccaacctttaatcacatggcatctttcagtctacgtcccagggggctcctcacaaggcaggaaggctgaatcaccccacgtcacatgcaaacactgaaaaatgacaccttttagggctccttgcttaaaaattatggagattttcacaagcatttggccaagcacagggccctgtgcgagcatgcaggtcacaggcccaggatgtcagccctggtttaggagcacaaggtttccaaaatatcaaggtatgaatttcagccctttcaatgtgtgcttattgttgaatgactaacctgagcagcagtttgtttgtctgtcagttgaggaccatatatttaccccatgactgctgcctaagaggtcacactcgggagcaggactgccccaggctcaaggtcgtgcctactcaccatgatactatgtctcattttaccgagggagctgagagaggttatacacctatttcatgggattaaacaaatttatggtaacagagtgagcgacagcttgcacagtgccaggcacacagagagcactctatactgcaatctccacctccctctcagcctggcccaggaaaaacaaaacaaatcagagggaaatcactttgctgaaggacaggtacagggattacttgcataaaactagaggactgtaagcaagttttgctctgacaatggaaaatctaacaacattaattcttctattcactggtcagcttgctctccttccagaaggaatccctatttttcattttccctggagccttaagatacaaatggaagggaaaaaccagagttctggagctccctagttcccagtgagaacccaggaggcccatctttatagcttgcttccttcaccaatacaatttacaacaaatgcaaacactgttcctaccgggtccagcaatgccgatctgacatcctccccatagcggttccgcaggcatggtccacagaactgtcctcgcacaccacagcaaccctggttccgacacactgtcttggtgtcgatggtcttttgtcgacactgatggcacgtgttaccctacagggggaaggcagtgagcaggtgaacacagggatatgctgatgcccaatgaggccagatgccaccatgtgcatttccaagtatatgaagaaatacccccgtctcctcgaatcaagcaggactgttttcctaagaaccacagcattgtctctagaccggggtccccagcccccaggctagaaccagtctgtggcctgtttggaaccgggctgcacagcaggaagtgagcagcggacgggcgagcattaccgcctgagctctgcctcctgtcagatcagcagcagcattagattctcataggagcacaaaccctctattgtgaattgcacatgtgagggatctaggttgtgcaccctttataagaatctaatgcccgatgatctgaggtggaacagtttcatcctgaaaccatccccttcctgccccccaaatccatggaaaaactgtctttcacaaaaccagtccctggtgccaaaaaggttggggaccactgctctagaatgtaaccatcacaggtctgtggccagagaaacatattaggtcagatgaggctgagcagagacccagaaggaatgaaatgatcaggctgtcaggaagagagaccagagaaaagcttgaggcaggggtggcagagcccctgaaaggtgacaggtgactgaggggcaatgagccttgggtggcatcacctcggccccagcctagctctgcagacctggataccttcaatgtgagatctatttttttttaaatattggcaactaaatttaaaacttgacagtgtcccgttacatatccagaaaaacacaaaaaaaatgcagaacgcaaagcctccctctaaatcaccatttagaagaaatttaacccatttcctaccaaagatattctgccaaactttaatttctatggttatattaccccccaaatatacttttttcaatatttagaacataaaactatatgcttaaaccattaacagttacatataaaaatcccttttaaactataccgttcccttcccccagattctacgcatccctaagagagaccgccgtccagatgggaattactgcactaggctgcctcccctttcccaggtacagctgacttttgaccctccaattcagagcctggctctgagcccttggtgagatggcataagccctgatagagtttaaaaacaagtgagatttcaataccaatgccttcgactcccaataagaatgacaattaatgtatactttaccagaactttatcatagattttatctcgaacagttatggcaacattttctaagtcctcttcggtgatatcctccactggccgaaaagaagatatacggtgacgtcgtctgtactcccggcatttcccctgcacaatgaacacaagcagaacatggagatgtgttgagcagttataaaaaaattataaatattttaaactctcaaagatctagcaccattaatgttaaccccgtccctcttctatttccctgcagccatttcatttagttatttactgagctcctgccacctgccaagcttccttctcagcaaggcgatacaatcataaaggaggaactcaaggtttttggttctttgctgtaaactctgtggagaggtgaaccacactgaacagccaaacccacaaatgggtccacagttgctccctccaaactgaaagcgcttgaaacgcctcatgcctaaaacagaaaggcaaggaggaatcactgcacttttctttattgcctgcagcagagattaaagcagggtcctaacaaatgagctgcttctcagctcggcttggataaaagactctctctgtgacctccagcttagaccagggctgcttctcaaagtgtgatctcaggagcaatggcatcacctgggaagcagagagaaatgcaagttctcagctgccgcagacccacggggtcagaaccagccctggggtgacagtgacgtgcgttcacgtttggagggatggtagctcagacaaaaactaattcatgtattagtcagaaaataccccaattgtcttccttcttcggaagctgtaaaactcttccgcaaatttagcggctgagacagtgaagttctctagagcaaacttctcaggaggccgcgcactccgggttgggttcatacgccgcgtgatctgtccctccgagaaggcccgcctcactgtcttcttcctctgaaatcaagagcacagacagagacaactggggactctctcgaataaaagccgtctggtggctgatcaccatatatcagtattggtataattataaggagttctacttacagaagctgaggttggggttcgtactgggaagaaatctggcatcgagttcaattccgccaataactgggcaagctgaagttcagaacaaaagaaagaatcttacaaaaatagggctccaggtttaggtcatccaacacctatctcaagtcttccattttgccaccataagaaacctaacttgaatagtttatataacccacaacagttatacttttaacctcacatgtaaagattgtacctccagacctgagatgctgatgtcatcattcatatgaatgaacactagcctattccttatatataaggacaacacaacactatgaaaacagtcctggaatgatcaagacctggagcatgaggttccgatcccgactcggaggctaatccaaggcggtgtgaccctgggacaattcattttgcacacgtgagtctcaagtttcaggatgttcaaaaaagaaaaagctcaactagattatttcgatggttatttagaactccaaaagtctgattctttaaatagattaatttctcatcaatcaaagtaatctatgaagatattcctacgtgaactaataataccaaataataggcattaatatgccagagaatttaattaggattcgttttagtttatacaattatatgagtgccaccaaaaaaatcataaagaaaatagcttattttaaagatgcagatggatacagtgctgaaaatttcccttagctaagtaaaaatgtttcttaggataaaaataatccgaaagtaggcattccatttttgtaagtaatttatattagacatataagcttgcatatacagtatcactgcatcattctttttttaaaaggaaaagattaaaaaattaccaaaatgctaaaagggataagtggtagaactatttaaaaaaaaactgtagataaacaattatgaagcaaacaatgattctctacaatgatcagattaacagtaattgattatatacagaaaaaccaaatatatgtaacaaagatttcacctggttccattcattgttctaatgaagacaatgtagagtgaattaacactgttgaggttgttttaattcctagacctcttccattccttcagaagtctcagaaccagtgctggtcaccatagaagagtggttctgtggtgaaaagctacctgcccaacctgctccttgcaacttctcagtggacttggtgacatcccacttcccctgctttactctgctgggaacgggctagttgttcagcccctctcatccccaacacaactatatacttagaacttagcttggtcaacagtaagcagcattatggcaccatgtaggggctaaaaatggtgctggggaatctctttctgttcccaaaccagagctgatcatgtaatagttgctctgggttctggaaaagtaaaaggatacacaatacccagagtatattttcttgacagaagccaaagcaacagcagcagctgtaggagcaaagtggttctgggagcccagcaactgctgccagagcctggtgccaactcccaggacgccctccgtgaagcctcaccatggctttgttctccttgatgttcatggtccttttcagcaaagcatctgaactctcctggctctcatcccgagagtcatcctcagactcagaggtagaatcttccctttgtatcacctgtctacagtctttctttctttcaagaattgtttttttctcattctgtaagcgtgcgctagaaaacaactgctcggaagaactgtttttatctggtttgttggccagcttcttggtggggaactgaaaggctactcgaagaccaatactacttcttctagacctgcttcttctaggggtagccttatcttcttcttcatcttcctcttcctcgctcaccaaagatgctttgccatcatcactcaaatctgactccacgacctaataaaataagagcaagaaaaagcacaaagacactgttacagacccacaaaaaagacatgcatttaaaacaactgacagcattatgagaaaaaacatgaaaaatgaaaagcttccccttcatattatgagttccctctgaatttcctttaaatgtgcaagaaattggttgatgaataaaatcagagagcaggcaacctactactgaactgtgcaccatcatacccgcgacagaaatgggttccattcagagcatgagggctgtaagcaaaacactgacagggtgggttcctccaccgtgggacaaccagggagcaccagcaagaggagagacagtcacagaaaaggagagacagcagcatgacagatgtgatcttcagacaggaaaggacgcaacgggggaaaaatgctgactggtctcctctaaatagcaggaaccagactcctgaataacagggcgggagagctgactgcacctcagggcagtgacccaggacaggcagatgacctgccactgcgtcctcagtcaaggggcacctttcccttctctggaaccctcagagccatgaggtgaaaccaggtcacaaagctctacaggttgtagcaaaacaccactcagtcaactcaagaaatcctcacccgacattttcaaattccacatggcagaggtctccagcattcaaacattgctctgttttacaagtgagaacacagtaaatatggaaggcagtaacagggatacatcacctaggtgacagcttggatgtgacgggactcttagcagtggtacagagacaggtttaagtatgtaagatctaggacgtcttctgggcatccttccatgaccagaagctagaaaactttgggaaccattatctgggaattctgaaaatctaccaagaacacggaatggcaccgatacggacccaggatcagttcagggactctgcttcctccccggtgacgaccatcaaccccaaactctcgttggactaaagttagaaataagacacagggagaaaaaaaacgcagataactgccaaccctggtatatccacaccaagccaagtgaggagtaagactatatggcactgatttatctattttttaataccctgaacttcccatattaatagcttcagaattcaaaatggtgtactgcaaaggaacccaatttcaggggacactgtcagggaagaacttcagttttgatccatttatctaccatcctcatcatcgacaggcctctctttaccagatgtggaacagctcactacagaggcctgaaggaaggaaagaacaaatggtacacagcagcccagaatcagacccaagagaagagcacaagtgtagtacatggatgtggttatttcgcatccggccagcagacccctggaaaccaagttacagcaatgtcccattatcaagaaagataggttcgccagttcccacaggggtgggcaggagggtgggctgggaggcaacaatgcttttcttctcactggattctaaaataaaatttgcaagggcctgtgctgaactgtaagctatatcatgatctatgtaactacatcacacagtccatagacttgggggcaggtgggagggaagacttctggggtaattcactttctctcactagaaatgcaaatgcttcgaataaccagacatcacttcactaaagaacagaaaataagtacattgctaactgatgatgcccattagggttttagaagcatcttaatatcgtgctggcaagaagctagggacttgctggccagaactgatggaactgccacacaaacagcttctgcaaagaaagccaaaggagacctggggcctccaggctggcacagctctatgttgctactcatagcaaaaaatcactatcaaacgaagcagcctaccatgcgggcttttatgctctacattctctcctaggacaagtgagggacatggcaggctaggagtcacggcttatttatacctctacacagtctctgccaaaagttagtctttagcagcttctggctgtgaagaggcgtaaactctacgttccatcttcatactgaagaagatagtagcatgtttattttttgcataaatgtatgctatttttagcagaaaacatttctgcacttaaatccgaaggctgtgccttaaagttaccttcaggttcaaacacgagtgggcagtaaactagcctaactgtgcaggataaaacaaacaaataactaacaagtctgttcataggaagtgctgagagtagacttccctccagaatccaggcaggcctgggtcatctttaacactaaaaagcatgacaaatccaaatccacaatgcatggggaacaccaagtttgtaccacagccaaatttttgccaaattaacttcaaaccaaaaactgtcacttcacacacagtaagaaagtatctcaagaaagttgtcatctaagataaacttttagataaaagaggtttaaggaactcttgagataatttttttttttttttttttttttttttttttttttttttttgagatggagtctcgctctgtcacccaggctggagtgcagtggctcaatctcagctcactgcaacctctgcctcccggcttcaagaaatcctcctgcctccgcctcccgagtagcttggattacaggtgcccgccaccacgcccggctaatttttgtattttgaggagagatggggtttcaccatatcggtgaggctggtcttgaactcctgacctcaggtccacccgcctcggcctcccaaagtgctgggattacaggtatgagccaccgtgcctggccaagagagataaattctttgagaaggacaataaaggacgcctgggacacatccccaaaaaccccctaaggcacgaggagaagatgaatggattttctctaagagaataatggactggtggaccagggattagccttccaggagcaatttttttaggttatgttaattgcttgtaagataaatatgtaagaaaaatcttttcacttgtgaagtgactgcttacaagtaaaactctttcagaaacaggattaaaaacgttaccacccacatcccttcctgttgtaattattaccattacttctgggttagtctttccattcagatcactctgcgtaaatcctgcaaaatcctcagtctctgagtcagtgtcctctataaaaattcttcttagctcttctgtgaagtatttggaatgaaagcgcacatcctgctaaattaaagacacacatacatcagagacggaaagtagaatagaggttaccagggaagggtagaatgaggagctactgaacgggtacagagcttctgatggagatgacgaaaatggatggacaacaatgtgaatgtacttaatgcactgaactgtacacatcaaaaacagctgaaatgatatacttcatgttatgtgtattttaccacaaaaaaaaaaaaacactggccgggtacagtggctcaccctgtaatcccagcactttgggagaccgaggcaggcagatcacttgaactcaggagttcaagaccagcctgagcaacatagtgagacctcatctctgcaaaaaatacaaaaattagctgggtctggtggcatgtacctgtagtcccagctacttgggaggctaaggtgggaggattacccaaccctgggaggtcgaggctgcagtgagctgcacaccaatgcactccagcctgcgttgcagccaagatcacaccattgcactccagccgggtgacagagtgagaccctctctcaaaaaaacccgcatacgtacacgtatatattacatatatacacattttctaaagcttacaaaattcagacctacaagacagacaatttttaaaaattgggtgtagtctcaatcagcttctaatgtgactggtaagtgctcatggaattcagcttctcctgccaaagctggcaaccagacacgtctgctttcacatagaaccaaaacacatggaaagaagatatgaggagaaaacctggctccctcccacgtgttggcttccctttccaacagcctttcaaagccggagtctcctccaagtgggtgagcatgcctcccattcaccaacagcgagcttctctgtaggaaaaggctggggcctctctcagcccccaccgcccaccaccagagagcctagacttgctccatgagcagacaccatgggggcctgatggaaagctcattcaaggtcacccccaggaatttctctcgtgcaggaggtgagaggtgaacaaccatggctaggtggcaagtgagcagaaggaaagatgcaatgtgactctttaagaaaaggcattttctaatactttttcttttgaaatagtgcaaagatggaaacccaactctcttaatagtatacttgaaagaaagaggaaataacaaactgcaggccaaagggagacccacgagaccagccccctgcaagcccgccacacctcatcaagactagagtctgtccccagtttcctctgacgtctcttccccccatctctgatatagcaatgaccccttgtaacaccacacttggcggggaatctgtatctaccccactgcgtttccccgcctttaattatatacttctttgagctcatatatctctggggaaagatagatataatagacaagtggaaaaacttacaggggcacacagaaagaaatgcctacatctagcattctgtaagcttaaaaatgtctcctatgaattattatgggtaattggagtgagtttgctcagagctgaattactttgttcctttgttgatagctgtagtgcagctgcttgagaaaaaaaattgcacacacaaaagggaagtttctttaaagtgaaattcaaatcgtgtttaagggagaccagagttagcatacacatactgtgtgcaagttcatgcagcttctctctattggttaaaatggatcatgagcctgtggggtcggggtagagaagcagccagggcttgattattaaggaagaatggtacacagctgctgctaaggaaacccaccatgcacctgaggcctctcagtgcaagaaacatctggctcacagagccttgggccagcccctgcaggctaatttagagtggtatttctgtgtgcaaatttcatcaactacctaaagcccctgcctagggcctgaagggaacagggcaagccttgaagctatgagttcccatcttccagtttttctggctattttgatcctgtgtgctggcctcccagggcaatgggcatcttgggagagattaccatctttgatggtcagtcctgatagagaaaaacaacttaccattgtcctgaactgaggcctgtgctttagtttccttactccaaagtgtgtaagtactgttttccatgtgggtctgtatgatgccaatctccactccacactgctccactgcattctgagttagaaaccctggcactgctgattgctctctggcactggttcattcatcttcaaaatcaatactgggtgctatgctataggccttggtcatctaccatgatcaggaccataagcaaataacacatcagaggagaagctaacataggtggataaacttattttgaagtccatgtgacatggaagaaacagaccagagagcaatggcctgttgaaccagacagccagacaagcaccccatttcaactgcacccagcaaacaacaccccccgtgctcactgtatacagtcaggtggggtgttggatgcttgaaatcagaggaaaggaacaatacatgaggacgaaaagtcagagccagggaagctagaaagcaccattcaagtatgaggtctccccttcttaaggagtttataatctaacagggaggcagacaggtccacgaataaccctggtgagggtcagtgctctaagggatacaaagcaatatggcacacggagggaaagaaaatccagtaagacttcatggaagaagtagcataactggatgtgagccacggtagaggctagaaaaatggtgagagcacagataggcaggaacagcatggaccagtgggcagaaagggcagaacagtggataatgagagtgtcagttcagttcctgtgccctgcagcatagcaggtaggaaagagacccggcggggtaagaggctgagaagtggtggccctggatttggaacatcccagcttggtacttcccagatgtggggccttgggcaagtcattacaccttcctgaacgtcagtttcatcacttgcaaaactgcagcttcccagggaggtctgtggattaaatgcagtatctgtatgaaaagcagttggcacactgtcctccctggggagaacacacctgactacaaaaggagtcatcatagcagcagaagcagctgttctgtttcttaatgcccggtgcctgccaggctctgtgctcggccctttagacatgttctgccttgctcaaatgctcctcaaggtggatccaacaggctctgctctccccaccgcctgactgtgctcagatggagggctaagggaggagctgaccggaggtcaatcctataacagatcctagtaggaagggatgagcattcgggtaagagctacgagggctacggcagctgcagagggaagggaaggatggacaccaggaacacagcagaagtttcatcaactcctggacgggagtcaaggagatggaagaggggagggaaggccaagaacaaaagatggaaatcaagatggggaaagggggaagccagaaagacaaccaagggaaggagaagtgagtttcagatctcccttagcaaccaggaccagtccaactggtagtcagaaaccacctggggctggagagagaagacaagctccacaaaagaatacagtaacagctcaaagcaggacaacagacaagattcactaagtgagaagactgaagacaaacccttagagaacatctgcatttagggacacgaacagggaaaacaagtgacagtaacaaaaagcaggccaggtacagtggctcacgcctctaattccagcactttcggaggccaaggcgggcagatcacctgaggtcgggagtttgagaccagcctggccaatatggcaaaaccccatcactactaaaaaaaaaaaaaaaaaaaaaaaacacacacacacacacaaattagccaggcgtggtggtgggagcctgtaatcccagctactcgggaggctgaggctgggaaaattgcttgaacccgggaggcagaagttgcagtgagccaagatcatgccactgcactccagcctgggtgacacaatgatactccatcttggaaagaaagaaaataataataacaaagagcaaaaggtgtaacagagaggaagaaacccaggtggttagaaggaggtctactggtggggtcaactgctgtggagatgccaaatgagatgaggacgacagagaccagggagcctccagagatctcagaaagcacagctcccaccaggccagaacttacagtggcccacgtaattaagcaggcacttcacttacatataattaactgcttcccttcctggacttgcccagtggaagcaaagtgggtttaatttgctgcctttttggagaggccatggtcaaggcagaatgaggaattttgagtgccacaattaactcagaagaaaatgccactgaagggtagagattttggccattctactactaggacacaatgtgaacctccaggaatctacctgtcagagaactctaacttgtgagtgctagagatcaaagtaattaacgcaagaataaggctctccccagcaattccaagaggacatgccaacagaattgcaccacgggaccacagaggtgtaattgtctccccgtaaccacacaatccctcatgcctcgccgcagcctcgcctctgtgggaagaccctgaacacagcctcgccacaggttacagccccaaggcagccaagaaaatgcacttgatcatgtgaggtccctttatttaaaaaaaaaaaaaaaaaaaaaaaagaattatggtacagggaaggattaacacagcaaagtgaacgaggttctctcaccagttttttaaaacaggaagacacagacataatgtttctaaaataaaatgctagacaatgaactgatatcaccaatctcacaccatgttcaaataaaagaacatccaaaccaagattcaggcctccagatgaacacatctgcttggaaggaatcatccatacctgtttccctgactctagtgagtcaaaactatcgcagctctcctctgacgagagggtttccatgggaacatcatctcggaagccaacaaactcttcatcatcactgggggcgttaaagatgtcagccacttctttagggatctgttttggattcaaaagaggcaggattaaaccaggggttcttgctaatcacttagggacattttctggaggggaggagagatctcatcacttcatccaactgccacggttgcccagaagtccccagtaaccctcagcaaaacactcttcagctaagaactcatggcaaaataaggtgtggggtgggtgggggagataaaacttaaaattctagatatacaccctattttacagagaatgttaaaaccaggccagagagaagacatgtttgatctcttgacaaaaagaaaaattgtttctaagaaccaatgatctcttttttctcctacagtggatgcatctttaaatgtcatctacataaaaaagatgccataaaatatcattaagcacttttcttaatgttcacctacactatttatttttctcttctttgtcataggctgattcagaaagtagaaagttcatacaatgaaataagtagcttttcttcttttctatattgtaagtcaacttaagtagctggggattaattctaacagaattcaaatgctattaggggataattgatcccagagagaacaatgtcagcacacttaatccacaaatatgtatctgctggagttcatttttgtaagttgactattttctcccaattctttgttttaaaaaagttcaaacacacagaaatgtgaaaaaatagtacaaacacctgttgattctttatctagacccattattggtcactgcatttgctttctttctctgtttcaacaaatattaggttgaaccatgggcatttgctgatatttggctgtttttaacttaggaaaatagcaatttaatatgagccaacctaatccatatattcccacacattgattaaagtaatttgcaaacattgtattgattggcccgaatataattcagcacatatctcccacggataaggacattctcccatagaaccacaaaaccataattgtaccgaaaataattaacattaattcaatagtacgatttactgtaactctatattttaatatctgcaactgttctatttgatttttatgacactgttttttgttgtttttcacaacactgactttctttttagatagaccatgacaactgccttgtagaatgtcatgtattctgagcttatctgagtgtttcctcatgattagattcaggttatgtatttttgtcaccattctacataggtgacatgtactcctcaatgcattgcataagggggcacaaaatgtcaagttatcccactattaattagtaatttttaaaaaatttttcattataaaaactttcaaagatatttcaaaagtagatgggaagatattgtaatgagcacacattgatcctccccgtaattatctgcccaaggctaactgtgcttcccctggatcccgacccaactccccttcttctaaattattgtgaggcaactgtagacatagtatcatgtcactctgtatcatcatcaaatgtgcagtctgtattcacagttcttctgcctcattttttaaaaacttagtttatctgcatcatgatccaaataaggttcacactgatcaacatggctcttaaatcccttctcatcactcctttatctcttttctcttgcagtttatttttgaagaagctgggtcacttgactgtggagtctgtccaagtctgaagttttattttttttgcatccccaaggtggtgtttaacagactcatttgggtttacaatttgggagttgaatccggaggctttacttctagttggcttgcttttgccaagactactttttaggaagtgctatgttcttcctttggaaagcacataaggtctggctgtctctttttttagtgatgttgctgtttggtcaataagttaaggtggaatcagcctgatttgttcttcgcttttaaaacaaaacaaaacaaaaaacaataacaacaacaaaaaacaccctttctcctttgtcactaataaggaatatgcagagtgagacttgagattctgtgaatagcctccctgataacatcttgctcaacagtttcagcgtccattgacaattctttttttttatattttttattttaataaagacagggtctatgttacccaggctggtctcaaattccttgcctcaagtgatcctctcacctcagcctcccaaagtgctgggattacaggcatgagccagggcacccttgaatgaattattacattagggactgcaaaagagaaattttcagattttctctctccttcacaaagtagctggcattcttgtataatatagtctttctctcactctcccccttttcttctaccatgtatatccatggatttctaaaaattattattaaatgtgttataatccatactctcataatgctgactgtcccaaatttggccattgggagcttcttggaaagtcatcctctgtctttctgacatggcactaagggtctttcaacacctccttgctttctgacacaagcatggcaagctaaccttgtatgtttcctgtcccagacctcaaatcagccatttctccaaggagccctgaaacctttcactgggaaatggcatttaaaaaccaagctcggagaacacaatgcatctcggttaattaagtatcactgcttgtaggctctttggacagagcaaggatattttaaataggtaaatcacaagttcatggtgacaccctgaattcaaatccaacacggaggcttcttcctctgctccctcatctctccctcatctcacattagcatcgccgttccaccacaaggaaaaccctcgattcccaaaatttttaatatacttatccatgtggtgctctatctacaataaacacaaaatagcgccaaactgacgccaccaatatactaccaacaacaaacagtgcagttcaagatttctttgcagttctttctagccctggaacatagtctcactatacacaggatcttttccttcagctaaccagatgatcattgtacatggttatgcaaaaatgtttcacatgtacttcccatttcatcatgcagtatattaaaaagatgtccttaacagttgagacttaataatttttactgtttcatcagaacattcttatgtgaaactgacattttctttttaaattgagtgcatggaggtgaatgcaatgactactaatacagtttgttgctaccacctggattcatgctaaagatcagcagttttctccactttggcttttgcacaatcagtgcaaatatcaacacagcaaaaagggcaaataatcttagtattattatgacattacattcgccctcatggacccgtgaaagggtctcaggtcctccatctcacactttgaccactgcactagcatatacagagttgtgtattcaaaagctacttagcttcgtggaattctctgtgtgggtgtgttgacttaattttacatttagtcaggttccatttaggaaactggtaatccttaatctatttactttcatccttattttaatgcttcttgattaaaaataattagaaaataatggttcaatcaaaggaagtgtaacataaatacagaaatgggataccccaagttcagtgatgctgaagggttaatacaaacactttcccaccatctaataaaatcactgcaagggacaaacaagaacaacacttacagaagtagagttccactaacaatttttttaccagccacacgtagtgcagcactagcaaagcctaactctgacatcattcttggggaaaatattgaaacttttctcaaggaggtatgttaaacaatgtttgccaccttatcttttcaaagacaccttttgttgttgtttagcactcagaactaatacgcaaggaaaacacccagactagagaaacacagacaatacttatgaaagtgtgcctatgttgtagctacataatagccactgagttcagtccctgcagaggcactaagagggacagtgtgtcaatttcagtctttttcttttggccttctcaccattctacaaaattcaaacagccctgctggcccagaagcttcttttaacataaatggtttaaaggaggaggagcaccccatttatggatttaatggaaatacatacaaggaatggagagggttggtgataggaataaactgcttccagcagcaactgcattagtccctgtgctattgtgttcagccccaccactgctgcgagcctgtgtctgactagctaattcctccttctgcatctttgacttctgcatctgctccagaggtaccattagggggctataattactgattaggaacaaaaggaaagagcacactttcaaaaaaacggtgtgcattcctggggtacgcagggctctgatccttcaaaaggtattaaaagagtttcagatagtcacaagcttcaagatttgccaaaaaaaaaaaaaaaactgtaaaatattcaagtgtcctcaatgcaacgaactgatttgtctaacagatgcaacaaaggcagcaagatttatatgagaaggacctgatagaaaggatacacagggacctcttctaatgaatgaccagttccacaacacagtgatacattaggcccaaggatctgtcactttcctgttccattcagcagcgatccactgggtagctgcatagtctagacaaaaatgcaagacctttttttttttttttcaaagtttgtgttccattctattacaataaagccaatcataagactcaccaaaaagaaaactacaacaagtaactgaaaacaacaaaaatacaaaatttctcaatcaatggatatttacattagttgaacttctgaattaggataactactatctagtgaaccaaaaaaaaaagggaaaattctcatctgaaagtgaaaagaccgtttcattatttataatacttgttaaaaatcgacaacttcatgctattcctttcatgtacagtttctgtttgtctactctgtctttattggaattaacagtgtgaatatcatcaaaagtcatatgggggaccaggattcaattctatgagaacacaggtactagaatggaatccacaggcacctaacatagagcccagcctaaagcagatgatcaacaaacccttgctgaaagcatttacatgcatctgactttgtagccattttcttaagaaaggtgtattttactaggaaaatactaagtcaaaaaggtacactctgtgacattcctacatgaggggaattaaaaattttcacccagaatcctaagacatctttctacaaagcagtcatattcacagctcccctttcagaaaggactgcaggtttcccttataagccatacagattacctgagagcttttctctgaaatacattatgccaactcaacaggctttggggccaagcaggtgggtaacagggcagtaggtcagctgtaggacaatatgggatggtgctgactggtaggctgaacacatatatcagggaaggcaggccactcctccactccagctgatcactgccctgcaggaacaggggtctggtgtgtctgacctccaacattcccagagaacctgagaatctgagtgttggtaagaaacttcccatctacagactggatctcaaacttgttcagggaacatgcacggtggaactcatagggctctgtgggacaccaaggaaactgcaaatgccagaattccaaatattaccaacagtattaatatatctactagtgcctagtagtaatagtagagggcatcaaagtgttaagaagattaagaaaaactttatatcctttcccttattcatggcatcatgattcacaagagccaaaaggtggaagcaatccaagtatccatcgatggataaatggataaacaaaatgtgagacatacatataattgaatattattcaacactaaaaaggaaggaaattatgacacatgccacaacatggatgaactttgaagacgttatgctaaatgataataacccagtctcgataaaaccaagaacggtatgattctacttataacaggtacctagagtggttgaatcctcggagacagcagaatggcacttgccagatgctgaggggagggagaaacgtggagttactgtttaatggatacagattcagctttccaagatggaaagagttttggaatttaaatatgcttaacactactgaaccatacattttaaaatggctaagataggagattttatgttatatgtatcttagcacaatttaaaaagaattcaacgaaaaaagacaagaaagacaatttaagccaggcatggtggttcatacctgtaatcccagcactctgggaggccgaggcaggaagatcacttgaccccaggggtttgagaccagcctaggcaacatggtgagaccccgtctctaccaaaaaagatacaaaaatcagctgggttgtggtggcgtgtgcctgtagtcccagctactcatgaagctaaaatgggaggatcggttgagcccatgagttagaggctgcatgcagtgagctatgatcataccactacactacagtcagggtgtcagtgagaccctgtctctaaaagagaaaaagaaaaaaagaaaaaccggggtagaggggaatttttccttccttaagtgaatgaaatcttccaaactgacagaacaagtccagaccttagcctagttttaatggtaccatcactttaggggcatgtggcttaagaacccaactctctcacctaagggaggttcagatacatcattgtaggtgccaaggcttcagctttagtgtctgaccaaccaggtatctgagcctgtaagcccattagttaactgatagtctggaggacaaagctgtttgcagaaccacacttggctgaaatccagctttgttctatcccagctaagctatactaataaaaataaaccctgctgagttgctgctggcttctcgttgagtaggtgcctttcaggcatacaaagcagtgctctggaggtctccataccattttgacctttgtcagcctgagtctccattaaaattcaatttaaaaaactaataagctataaaaagatcatcaaactgtcagttggtattcaatcaagtatttacctttgaaaatattttaacgtgaagtattgttcatttaaaactttatattgtgaaattaagtataatattttttaaattaaagcttttccataactcaatgatatctaaattcatccttcctggattaaaaaatacaacctcctacccagaaggaacacatttatcagtattagtttttgaagagaaagaaaataagattcactttttaggccaactgatacaagggctgattctgatatactccaagaatattcagtgtacatttcacctagaagcaagctctattttaagatttaaaaagcagacaaaagatatttatgcacactactgcattttccttattaagtgttttgaaagcaattttgatagcaatgacagcagaatttgcaaggtgtactatcttgcatctatgaaaagagatctacacagaggagagcattccttcctctttaacacaccacgaagggcgagaactgttattttcttatgcaaaatcatttctttgaattttttacaaataaatttgttggcccataagaaaagtacataccatgcaccaaccacaagaactaactcaaaatggatcacaaacttgaatataaaactataaaacttttagaagaggagaaaatctttgtgaccttaagttaggcaaagaattcttaagatacaacaccagatacaacacaatacagatctttaaaatgtgtaaagtaaacaatcaaaattaagaacttctgctcttcagaaaacaccgttaagagaatgaaaaggaaagccacacactgggagaaaatatctgcaaatgctgtctctgatttgcacccagaaaatataaagaattctcataattcaataaaaagaaaacaaataaatcagatggtcgacgagttaaatggtaaacaagcacaaaagagaattaaattaacacacacatgcatctgacctctgaatggggaggactttcaccaatcacgtaaaggagaccaaaatggaaaagtagatcactgaccatgtaacagtttaaagcttgctacttaaaagaagaaaattcagaaacaaaaacaaacaaacaaacaaaaaaaggtagggcaaagatctgacaaaaatatgacaaattattaaaattgctaaaaacctcatacaaaatgaaatatataccatggccacacagacaaaatggcaaaacaaagaaaactcactagggaaaacaaaagaggctaaaaacactttaaaagtcctcagcctacctagtaatgaaaagaatggcaagtaaaacaagtattcttttcatctagcaatttagcaacattttgcttccatttttaagggcatgctcaatgatggggaaggtgtgaggagacaaacacttctatacagaactggtatgaggacactgaacccaaggcttcagaaactaagtaccatcatatacatctaaaatagggcagttaatttttaaaaaattaaatacagtgcaatttcaagactgccaggaaaatgtagctaaactcagggtgaaggcgtatatgaattactattagcagttaagagaatcataaaatcaaggattatcaggccaagtgtggtggctcatgcctgcaatcccagtgctgtgggagaccaaggcaggaggatcacttgagcctaggagttcaagactagcctgggcaatacagcaagactccagctctacaaaacataaaaaattagccaggcatagtggcatgtctgtagtcccagctacttgggaggctgaggagggaggattgattgagcccaggagttcaaggctgctattagctatgatcctgccactgtaacagaggaagaccctatctcaaacaattaaagaagaaaaaaaaagatcatcagattgtgatgggatctcatccatcagtttgtgcttcatataatgggagtgacagccagacacagaggcacacacctgtagtcccagctacttagatggcctaggcaggatagcttaagtccaagagttcaagttcagcctgggcaacaaagcaagaccctatctctataagaaataaaaataaagtaaaattagggcaaccacagttagacttactcaaaggcatgtagcttgttagtgtccttacattaaaaacatttccaagcatctaaataagaaaacgatctgtttttctataactatatattaattagtattcagcagttaataaaaaaaatacaaactcatgttaacaccaacagcacaagcaacaattcgaggaaaataataaactggaattcatcaaaattaaaaactgttgtgcatcaaaggacagcaagaaagtgaaaagaaaaatctgcagaatgggagaaatagctacaaatcatgtatctaataaggatctactatctagaatatataaagatttcttacaactcaagaaaaaggcaaacaaccaatcaaaaaataggtgaagaatttgaacagacctttctccaaggaagctatacaaatgacaaacaagtacataaaaatacacacatcagtggtcattaaggaactgcaaaccaaaaataggtaatactggctggatacagtggctcatgcctgtaatccaagcattttggaaggctgaggcaggaggatcacttaagctcagttctagaccagcctgggcaatgtagcaagaccccatctcaaaaaaaaaaatgttttttaattacctaggcatgatggcacatgcctgtagtccctgctacttgggagcctgaggcaaaaggagctcttaagcctgcgagtttgaggctgcagtgagctgtgatcaaggcactgcattttagcctgggtgacagagcaagaccctggctcacaactaataataataacaataataataaagacattgaatagaagccatggggagtggaaaaaagccacacacaggtccaggcaagacagtatgttcagaaaagatctaagatgatcttcagttttcagggtcagaacatacccagccaatcttttaaagatttccctagcacagagtcagtctgcaaagactggaagaggtggccacttctcgaatatttaattctcaacaaaagaacaaagacatataaaaaagaagaaaaacctggcccattcaaagaagcaaaattaattgacagaaactttcccagaggaaaacactggacttactagacagacactggacttactagacaaagaaaactatcctatgctgaaagaacaaaaagcacaaagaactaacgtgaatctggaaaacgagcaaaatgagcctattaacaaagagaaatgaagaaggactccaacagaaattatggagctgaaaaaaatagaatgaccaagttgaaaatttcactagagtggtttaaaaacagatttgaggaggcaggcaaatcagcaaatctgaagataatgcatttgaaaatactgagtcagaggagaaaaaaattagaggagaaaaagttaaaaagaatacagaagagtgaaaacagcctaaactacttctttaggcacaccaatataggaatgatgggagactcagaaagaaaacagagagaaaaagagacaaagattatttgatacgacagtggatgaaaactccccaaactggctgaaaggcatgaattggaatacatcccagaagctcaaggaattccaagtaggacaactcggaagaggtcctttcaaagacaccatataatcaaatattaaaagcctaaagacaatcttgaaagtagtcacatacaagtgacactcaacaagattatcagctgttcagccccagtcaggggtttacagataaaacccccatctccctgggacagagcacctgggaaaggcgtggctgtgggcccagcttaagcagacttaaacgtctctgcctgccagctctaaaggagcagcagatctcccagcacagcgttcaagctctgctaagggacagacttgccttctcaagtgggtccctgactccatgcctcctgactgggagacacttcccagcaggggtcaacagacacctcatacaggagcgatccggctggcatctggtggttgcccctctgggatgaagcttccagaggaagaaaacaggcagcaatcctttgctgttctgcaacctcgcaaacggtctggagcgggcctccagcaaactaactccagcagacctgcagcagaggggcctgactgttagaagaaaaactaacaaacagaaaggaatagcatcaacatcaacaaaaaggacttccactcagaatccccatccgaaggtcaccaacatcaaagaccaaaggtagataaatccacgaagatgaggaaaaaccagcacaaaaaggctgaaaattccaaaaaccagaatgcctcttctcctccaaaggatcacaactccttaccagcaagggaacaaaactggatggagaatgagtttgatgaattgacagaagtacgcttcagaaggtgggtaataaactcctccgagctaaagaagcatgttctaactcaatacaaggaaactaagaaccttgaaaaaaggttagaggaattgctaacgagaataaccaggttagaaaagaacataaatgacctgatggagctgaaaaacacagcacgaaaacttcatgaagcatacacaagtatcaatagccaaatcgatcaagcagaagaaaggatatcagagactgaagatcaacttaatgaaataaagcatgaagagaagattagagaaaaaaagagtgaaaaaggaacaaaaaaagcctccaagaaatatgggactatgtgaaaagaccaaatctacgtttgactggtgtacctcaaagtgacgaggagaatggaaccaaattggaaaacactctgcacgatattatccaggagaacttccccaacctagcaagacaggccaacattcaaactcagaaaatacaaagaataccacaaagatactcctcgagaagagcaaccccaagacacataatcatcagattcagcaagattgaaatgaaggaaaaaaggttaagggcagccagagagaaaggtcaggttaaccacaaagggaagcccatcagactaacagcggatctctaggcagaaaccctacaagccagaagagggtggggtcaatattcaacattcttaatgaaaagaattttcaacccagaatttcatatccagccaaactaagcttcataagtgaaagagaaataaaatcctttacagacaagcaaatgctgagagattttgtcaccaccaggcctgccttataagagttcctgaaggaagcactaaacatggaaacgaaaaactggtatcagctactgcaaaaacataccaaattataaacaccactgacactatgaagaaactgcatcaactaacaggcaaaataaccagctagcatcataataacaggatcaaattcacacataacaatattaatcttaagtgtaaatgggctaaatgccccaattaaaagacacagaccggcaaattggataaagagtcaagacccatcggtgtgctgtattcaggagacccatctcacacccaaagacacacataggctcaaaataaaaggatggaggaatattatccagcaaatggaaagcaaaaaaaaaaaaaaaaaaaaaaaaagcagggattgcaatcctagtctctaataaaacagactttaaaccaatgaagatcaaaacagacaaagaagggcattacataatgctaaagggatcaatccaacaagagcagctaactacactaaatatatatgcacccaatacaggagcacccagatgcataaagcaagttcttagagacctacaaagagacttagactcccacacaataatagtgggagactttaacacgccactgtcactattagatcaaagagacagcaaattaataaggatattcaggacttgaacacagctctggaccaagcagacctaatagacatctacagaactctccaccccaaatcaacagaatatacattcttctcagcaccacatcagacttattctaaaattgaccacataactggaagtaaaacactcctcagcaaatgcaaaagaacggaaatcataacaaacagtctctcagaccaagtgcaatcaaattggaactcaggatgaagaaactcactcaaaaccgcacaactacattgaaactgaacaacctgctcctgaatgactacagggtaactaacgaaatcaagacagaaataaataagttctttgaaaccaatgagaacaaagacaacataccagaatctctgggacacagctaaagcagtgttgagagggaaatttatagcactaaatgcccacaagagaaagcaggaaagatctaaaattgacaccctagcatcacaattaaaagaactagagagtggccgggtgcagtggctctcgcctgtaatcctagcactttgggaggccgaggtgggcagatcacgaggtcaggagttcgagaccagcctggccaagatagtgaaaccctgtctgtactaaaaacacaaaaaaattagctgggcgtggtggcgggtgcctgtaatcccagccacttgggaggctgaggcaaaaagaatcgcttgaacctgggaggcggaggttgcagtgagccaagattacgccattgcactccagccccggcaacagtgcaagactccgtctcaaaaaaaaaaaaaaaaaaaaaaaaaagaactagagacgcaagagccatcaaattcaaaagctagcagaagataagaaataactaagatcacagcagaactgaaggagacagggacatgaaaaacccttcaaaaaaatcaatgaatccaggagttggttttttgaaaagatcaacaaaatagaccgctagccagacaaagaagaaaagagagaagaatcaaatagacacaataaaaaatgataaagggggtatcaccactgatccaacagaaatacaaactaccatcagagaatactataaacagctctacacaaataaactagaaaatctagaagaaatggataaatttctggacacatacaccctcccaagtctaaactaggaagaagtcaaattcctgaagaccaataacaagttctgaaattggggcagtaattaatggcctgccaaccaaaagagtctaggaccagacagatttacagccaaattctaccagaggtacaaagaggagctggtaccattccttctaaaactattccaaacaacagaaaaagagggaatcctccctaactcattttatgagaccagcatcatcctgataccaaaacctggcagagacacaacaaaaaaagaaaatttcagaccagtatccctgatgaacgaagattttcacattggcaataaaatactggcaaaccaaatccagcagcacatcaaaaagcttatccaccaggatcaagttggcttcatccctgggatgcaaggctggttcaatatatgcaaatcaataaacataatccatcacataaacagaaccaatgacaaaaaccacatgattatctcaatatatgcagaaaaggccgtcaataaaattcaacaccgattcctgctaaaaactctcagtaaacgaggtattgatggaacagatctcaaaataataacagctatttatgacaaacccacagccaatatcatactgaatgggcaaaagctggaagcattccctttgaaaaccagcgcaagacaaggatgctctctctcaccactcctattcaacattctgattcttcctatccgtgagcatggaatatttttccattttccattgccagggcaatctggcaagagaaagaaataaaaagtattcaaataggaagagaggaagtccaactgtctctgtttgcagatgacatgactgtatatttagaaaatcccatcgtctcagccccaaaactcctcaagctgataagcaacttcagcaaagtctctggatacaaaattaatgtgcaaaaatcacaagcattcctatataccaataatagagagcaaaatcatgagtgaactctcatttacaattgctacaaagagaataaaatacctaggaatactacttacaagggaagtgaaggatctctttaaggaaactacaaaccactgctcaaggaagtaagagaggaaacaaacaaatggaaaaatattccatgctcatggataggaagaatcagtatcatgaaaatggccatactgcccaaagtaatttatagattcaatgctatccccatcaagataccaatgactttctttacagaattacaaaaatctactttaaatttcatgtggaaccaaaaatgagcctgtatagccaagacaatcctaagcaaaaagaacaaagctagaggcatcatgctacctgatttcaatctatactacaaggctacagtaaccaaaacagcatggtactggtaccaaaacagatatacagaccaatggaacagaacagaggcctcagaaataacaccacacatctacagccatctgatctttgacaaatctgacaaaaacaagcagtggggaaaggattccctatttaataaatggtgctgggaaaactggctagccatatgcagaaaactgaaactggaccccttccttgcaccttgtacaaaaattaactgaatatggattaaagacttaaatgtaaaacctaaaaccataaacaccctagaaaaaaacctaggcaataccattcaggacataggcaggggcaaggacttcatgactaaaacaccaaaagcaatggcaacaaaagccagaattgacaaatgggatctaattaaactaaagagcttctgcacagcaaaagaaactatcatcagagtgaacaggcaacttacagaatggaagaaaatttttgtaatctacccatatgacaaagggctaatatccagaatctacaaggaaattaaacaaatttataagaaaaaaaaaaagaacaacttcatcaaaaagtgggcgaaagatatgatacttctcaaaagaagacatttatactgccaacaaacatatgaaaaaaagctcatcatcactggtcattaaagaaatgcaaatcaaaaccacaatgaaataccatctcgtgccagttagaatggcgaacattaaaaagtcaggaaacaacagatgctggaggggatgtggagaaataggaatgcttttacactgttggtgggagtgtaaattagttcaaccattgcagaagacagtgtggcgattcctcaaggatctagaaccagaaataccatttgacccagcaatccattactgggtttatacccaaaggattataaatcattctactataaagacacatgcacatgtatgtttattgtggcactgttcacgatagcaaagacttggaaccaacccaaatgcccatcaatgatagactggataaagaaaatgtggcacatatacaccatggaatactatgcagccataaaaaaggatgtgttcatgtcctttgcagggacatggatgaagcaggaaaccagctaaattatcagcaaactaacacaagaacagaaaaccaaacaccacatattcttattcatagttggcaggtgaacaatgagaacacatggacatgggaagaggaacatcacacactggggcccgtcggggttgggggactagaggagggatatcattaggagaaataactaatgtagacgacgggttaatgggtgcagcaaaccaccatggcacatgtatacctatgtaacaaacctgcacgttctgcacatgcatcccagaacttaaagtataaaaaaaagaaaaaaaaagattatcagccgttttatcacagaaaccttaaaggtcagaaagcagtaggatgatttatttgtaacatatttaaaatgtagaagggaaaaaaactatcaaacaagaattctccatctggttaaaaaaaaaaaactgcccttcaaaaatgagataaaaattaagacattcccaaataaacaaaagccaagggaattcattactactggcatttgcaacagaaaatgctgaaaggagtacttcacatttacatgaaagtcactacaccgtaactttgtcaaagccatacaaaaatataaggttctcaggtaaaggtaaatacatggacaaatataaaaactagagtattattgtaaatttggcttataactctacttgttattttctaaaggattaaaaatacttacgaatctgttcatggatacacaacacataaagatgtaattcctgatctcaattacataaaatgatggaaaaagagctatataggagtagaatttttgtatgtcgctgaagtgaaattggtatcattcaaaccagattgctataactttagaatgttatatgtaatctccatggtaacacaaaaactatctaagaagaaaaggaaatgaaatgagaagagagtcaaaatgtgccaatactaagcaatcaactaaactcaaaggaaggcaataacagaggaaatgagggacaaaaaagccataggatatacagaaaacctatttcttaaatcacaagattaagtaattccccaccagtaattactttaaatttaaatgtgttaaactccaaatcaaaagaaattgactggcaggaaggattttttcaaaataggatacaactctacactatctacaacagactcactttagatctaaagacaccaataggttaaaagtaaaaggacagaaaaagatactcgatgcaaataataaccaaaagagagatggagtggctatactaatatgagacaaaatagtcaaaaactgttgtgaaagacaaagacattacagattgataaaagagccaattcactagaagatagaacaattataaatatatacacacaccaaacatcaaagatcccaaatatatgaagcaaacactgacagaactgaatgaagaaatagactgttctgcaacaacagatagaaacttcaacaccccactttcaacagtgaacagaacaagacagagcaataaggaaacagaagacttgagcaacattataaaccaactaaaactaatagcactcaacccaacaacagaataaacacttttctcaagtacttacagaaaattttccaggacacactatatgttaggccacaaaacaagtgtgaatatatttttaaatgactgaaataatactatcctttgttacagtagagtgaaactagaaatcagtaacagaaggaaaaatgaaaaattcacaaatatgtggaaattaaataacatattcctaaacaaccatgggtcaaagaagacatcacaagggaaattagaaaatactttgaaacaaatgtaaatgaaaacaaaatttaccaaaatatatgggatgcagcaaaaggcactgctaagaggtaaatttatagctgtaaacacaataaaaatgaagatctccaaccaaaaaacaaaccatacacattaggggaacaggaaatgtatagcacaccaaacccaaagttagcaagaggaaggaaacaaagattaaaacagatatgaatagaatagataatagaataagagaaaaatcaatgaagccaaaagtttattctttgaaaaaaaaaatcaacaaattggcaaatcttaagctacatgactagaaaatatacagagaaaactcaaattactaacgttagtaatgaaattggacattactaccaattttacataaataaaaaggactggccaggcgctgtggctcacgcctgtaatcccaacactttgagaggcagaggtgggtggatcacaaggtcaggagttcaagaccagcctggccaagatggtgaaaccccatctctactaaaaatgcaaaaaaattagccaggcttggtggtgggcgcctgtaatcccagctacttgggaggctgaaacagagaactgcttgaacccaggaggcggaggttgcagtgagccgctactgtgccactacactccagcctgggcgacagagcaagactccgtctcaaaatgaataaataaataaataaataggattttaagagtactataaacaaccgtatgccaacaaattggattatctagatataatggataaatcccgagaaacaaacaacctagctagattaaattatgaagaaacagaagatctgaatatatttgaaataaggattttaagtagtaatcaaaaccctcccaacaaagtaaaccccaggacaagatggcttcatgggtaattctaccaaacatttaaagaagaacaaacaccagtctttctcaaagtcttccaaaaacttgaagaaggaggaacacttgaaactcattctatgtgaccagcattatcctgataccaaagccagagaaagatactagaaaactatacagccatatctcttacgaatactgatacaagaatactcaacaaaatgcaggtaaaacaaattcggcagtgtagcaaaaggattatacaagatcaccaagtggcatttattctaggaatgcaaaatggttcaaacacataaaaatcaattaatgtagtacaccctatgaacagaataaaggggaaaaacaaagatcatctcaactgatgcagaaaaacatctgacaaaattcaacacccttccctcatcagaaaaaaaaaaaatagaaggaaacttaaactcaccaacataaggctatatacgaaaaacccgcaactaacaagatactcaatgatgaatggaagattgaaagcttttcccctaagatcaggagctagacaaatatgcctgcttttaccacttctattcaacgcagtattgggaggtctagccagaccaatcaggcaagaaaaataaataacgcatccaaattggaaaggaagaagcaaaatttatctctgctataagagacgtgattatatatgtagagaacactagagattacacaaaaagtagttagagctaacaattagacattgcaggacacaaaatcaacacaaaaatcaactatgcttctacacactaacaatgaacaattatgaaaattaagaaaacgattccatttacaatggcatcagaataataaagtacttagaaataagtttaaccaaaaaggcgaaaaaagccttgtacactgaaaactacatccccgaaaaaatcaaggaagacaaggaaatggagaaccatcccatgttcatggattggaaggcttaatataaggtgacaatactaactgaagctatgtacagactcaatgtattccttctcaaactctcagtgacttctttcgtaaaaacaaaagtccatcctaaaattaatgtggaatctcaaaggaccctaaatagccaaaacaatcttaaaaaagaagaacagaccaggcgcagtggctcacacctgaaatcctagcactttgggaggctgaggtgggcagactgcctgaactcaggagtttcagaccaccctgggcaacatggtgaaaccccatctctactaaaatacaaaaaaaaattagccaggcatggcagcatgtgcctgtagtcccggctactcgggaggctgaggcaggagaattgcttgaacccaggaggcagaggttacagtgagccgagattgcaccactgcaccctagcctaggtgacagaacaagactccatcccttaaaaaagaaaaaaaaaaaaaagaacagtgttagaggactcacatttcctgacttcaatacttactacaaagctatagtaatcaaaacagtgtggtcttggcataaaggcagacatatatatcaatggaaatgaataaagagcccagatacaaacccttgcatatacagttaactaattttcaacaaggatgccaagaataatggcaaagaacagtattttcaacaaacagtgctgggaaaattggattaggttggacccttaccttaagccatctataaaaactaactcaagatggatcaaagatctaaatataagagctaaaactataaaactcatggaagaaaatacaggggaaaagtttcatgacactgaatttggcaataatttcttggatatggcaacaaaagaaaaataaataaactagacctcaaaattaaaaacttttgtgcaaagggcgctatcaagacagtgaaaaggcaacctatatagaatgagagaaaatatttgcaaataatatctaataagggattaatatccaagatatataaataactcacttaacaactacaaaaacccagttaagaaatgggcaaaggacttgaattaacatttcttcaaagaagaggtacaggtgaccaacgggcacaagaaaaaaattcttaacatcactaatcattggggaaatgcaaaacaaaaccacgatgagataccactttatgcacattagaatggccattaaaaaaaaatccaggaaagaactagggctggcaaagacgtgaagaaattggaacactcgtgcactgcttatgatgatataaaatgacacagccactgtgccaaacagtatagtggtttctgaaaaaattgaatttagtattatcatataacccagcaattctacttttaggaacacacacccagaacaactgaaagcagggactgaagcagatatttgtatgccaatgtttattcattggtatttacaatagccaaaaggtggaaacaaccgacaacataaatagatgagtaaataaagatggtatgtacacataagagtattattcagactttaaaagaaatgacgtcaggcacagtgtcttatgcctctaatcccagcactttgggaggccaagacaggaggattgcttgagcccaggagttcaagaccaacctgggcaacacagagactccatctctaccagaaattttaaaaagaaaaattagccaagcagggtagtacatacctatagtcccagctactcaagaggttgcagtgggaggatcacttgagcccaggaggtcaaggcgcagtgagccacgatagcaccactgcactccagcctgggcaacagagtgagaccctgtctcaaaagagaaataattgaaaaaaaattctgatacatactataacatggataaactttaataacaatgttaagtgaaatgagccagtgacaaaaggacaaataccatatgattccactcatatgagatacctaggatagtcatatcctcagagacagaaactaaaacagaagtaaccaggggctggaggaagaggtcataggggtaattgtttagtaggtagagagtttcagtttaaaatgatgaaaaagctcatgagagatcagtgatggcggcacaacattgtgactatacttagtaacactgaaaggttaaaaatagtaccttttattatgtatatcttaccacaataaaaagccccacagggtagtcaatgttatgtttaaaagagaagaaataaatgggaagtcattttagatatgtatttacacaggtcttagaagagctattcagcagatgagtacctaatgaactggaattttggcagagatcctgggagtgaagtgaaccaaatcacttgggaagtgtgaagtaatttcctcctccagggaggtcagcagatagaacatgtgaagccaatgttaagatttctctggagtctaaaagattatcaaattggacaagtctgttctcagtgttttccaacaaggtgcaactgacgttttggacagaacaactgcttcatcctgtaggactctcctgcctgccacatggtacttaatacccctgaactccaaaccacttaccaggggcattcccctcaccctcatcactctaacaatcaaaaagaaacccacccacgtttgttaccacgactaccatgaccccagatcactcagatgacaaccacagagtgattgaatccaaaactgaaataggagcaccctggtctgttaggatatgacaagctataaagcagtagcaaacaaccctaaatctcaatcaatagcttcaaaccaaaaaaaaaaaaaaaaaaaaaggcttccgtcttgttcacattacatgtccatcacaggccagcccaaggctctattccacactgtcctcacaccagaacctgggctgatagagctaccactctgcagaatgctgacagatgcagtggcagagggaatgagatacagtaagtggtatgctggcatttaaataattcacttagaagtgacatatagtacttctcatattccactggccaaagcaagtcaaatagccttgactgtttcagggccaggaaagtgcaaccctacaccacttacctggaaggaaaagaaccagccctgatgacttccaaactatgcctgcgaagtgctctgaaaagtagaaaacgctatataaatgttaattaaaagagtatattactaacaatactactttgcccttccatccattcaatggatatttattaggcatctaatacatgctggacatcgtctcctaagcatcaaatatatgccagacaccatgctaagagagctgatgaaaactgagtcgtaagtggtagggtaagagaaacaatctttaaacaattccagtgtggtatgataaatgtgatcagggaagtcagcccaggtactccagaagttcccagggcgagcacctgagccagcggtgggggcaatggatgggaagacttccaggagcagtaacctacatagctgcaggatgcagtcaccctggagaacctgctgtagatgcacaggtggaagcatgaatgtgggcgctgtggatggggtgtccctgccttccgccaagtcaatgagaccaacttgccacaaattccccatagccctaatctgcagtcacttccactaaatgtccactgacacatttataggttttcttggttttctaggcagaccggatgtaaagaacagatttctgggactactctccactttccccccaactagaacattctatgagatgctctaagttcaaggagacaacattctttcagtccagttatcataagcttggttctaacctcagcaaaaactgctttctttcagctaatatagcgcaacaaaaggggaaatgccctaggaaaacaatgtgtcagaggctcctaaccattgaaaatcaggcacattccctttatgagatattaaatacattataaagagttattaaaaatagtgcagactccaacacaagccgtaagatatacagtataccaccctgagatatttatttcctctaataaagaaaaaaatattttttcaacagaaaatacataaaatacacatctagaaacactagacagtcactaaaaatgaaaactgtaaagatctctacgctactaggaaaagtaatgctgatagtgctaaggaaagcagattccaacagcaatcatactgtaaaggttagacaaagatgacgactgtgctacaggcaaacacttcatggaaactgcagaaaatggggcacggagagtaggggaagcagagaagtggttcagtgcagcttacggtaacatgttattgtttgtacaatgcaaatttcacataaaagtcattcctatgtaaaagcttggtggatcttattcacattcccaaactgacttttacaggcagtataaagcataatctggtgagttcctaaaaaagaaccagactagctgctgttaacactccagcccttctagttaaagggaggagggaacagggcaagtttcctgactcaccaaggcccggtgattccagcagcaagggccaattccttacaaattgccctgagcaaattagtcaatttagccttatctttaaaaggcagataacacaacctacttcacagaactacagtggggattaaatctgataacttttaagtacttagcacagcatgacttttaaaaggaagtgatagtttccattccttgggggcaaaaaaggatggctcttaaggtctccctctactctccaaacccaaggtcccccaggtccccatagcacagagcaggagccagctgagctctggcaaaagcagaagaggaagggagttcaagcatggccttctggtagagagtgtggggaaagaggcgtgttttctgtgtctttgttcttccaccctaccaatgcctagcacataaccggtgctcaactgactatctgatcagtgtactaacccagtcagcaagccctctatcctcagctgatgatcatgaaggaaaacaggcaggaaacatcaacgatttatttgaactaaagctcaggccccttgcactgtgagactccacactttatttctgtgctgcatgcagggtgctagcatttactactatggaagatacatttttctgagtgttaacttcagtggtatttaccaaatatgcctctgaatggtcctatttcaaaaaaactacagaaagcactgcttttcataaacaaaaagaacaaaatggccccagtagtattttcttatctctatccctacctactttaagtagcctgtaatctattccattttggtgaataaagccgagtcttttctaaaacaaaactgtatactggaggtaaatattctaaaacataactttgagtaaaggaaaactctcaagagcagtttaaatgtaatgcctggcttattctattccaatgatgttctaatctttttcattaatttactctaatgtttgtaattgttttaggccacaattatctcattgtttcctggcctgtgtacctgatcagaatcattatgatctctgaggttttcgcctgatttttgagaatcctgctctgctatggatggggtagccagcagaacacagaacaaccaaggagcgttttaaatacaagactattagagtggcaaatcattgtcctttctgtgaccagcttctggggctctggaattacatgttaaacaacaggatcagatgggagcactttgcagctaagagaccaataccagaaaaatacccctttaccccttcaacagcgtgctcctgcctatttacaagaacatttagcatcatttccttctcaaatgggccatcctgtactctggagctagaacagagtacgaggagaacactgacattcagtgcctaccagtttctctcctacggagctgcagcaagctggagctcccatgagctgcactgttgacagctcttagtcagggatcacacccttgcctttacgagctatttctgtcattttatataaaagcacaaagacacagtggtcagcacgacaagactacagcctgggggaagcgtaatcactgtcagaggacatcaaatccaacacactggtgggatggcaggaaagcagactcgaaagtagttcagagtaaatgagtctccttgtttgcttcttactcataacattaggcctaagctgctttgctgaaacacttagctctgcgctttccaagcgatagaaattatacttactccaatgtgtgagatgaaaacccactgcacactgagctgagcgacatttgatgtgcagtaatgccacttcaggtggttcatcacattgctttattcataaggctgggggacagggtggaaccacacgaatttaacatcttgctgtgcctgaaatgttcattaagtgttcttatccgcagtcacctgcccaccccacagaaccactctccactaatttagagactataatctgtgcacatttaaattacgatgaacaggaacatttccactggaaaaaccatcacacatctttgatttgcactgccaattaggtcttcagaaaaggaaaaaaaaaaaaaccctgatcatcttacatatagtaatttgccttaattggtgcataatggatcggatataatttgtgggtaacccctacatgataaatagtttatttaacattttagaactaccaaaaattagcctcattgtgtggcagtaaacgctcacttccaactacacattctgggacttctgagtttcctaagcatgaattatgaatatcagtagtggaagtgcaaagaactctccagcttaacaacaggagtgacacattccagaaacattttctgattacattcacaaggagctccggagtgataaattccagatacattttctgactaaactcacaaggagctcaaatctccatccagagggtttgttttttgtttttagtcctgtagcaacagaaactcctagaaggttaggacgccagccggaagtggtggctcacgcctgtaatcccagcactttgggaggccgaggcaggtggatcacctgaggtcagcagttcaagaccagactggacaacattgtgaaaccctgtctctactaaaaaaaaaaaaaaaatacaaaaaattagacaggcgtggtggcgggcgcctgtaatcccagctactcgggacgctgaggcaggaaaattgcttgaacccgggaggcgaaggttgcagtgagccgaggtcgcgccattacactccaccccggacaagagcgaaactccgtctccaaaaaaaaaaaaaaaaaaaaaaggatgctaatacacggtaaaagccagtggcaaaaaataaaaaatcgaaccctgtctcattccgtaggctttactgtttcccttgcttttaatagtttatctcacaggaggcattttaaaaatattctcagaaacatcaacaacagatttttctcaagcgaccattttcaggaaggcttcagaaattactaaaaggccaaagctaccgttagtggctcagtctttgccgccagactcgggcaggtgacagcggtttgggctcgggcgccgggcactctgcgccttccaacgctggcggccccgcctccccttctcccgggccaggcacgcaggtggaggaaagtaaacaccagtcggaagcaaggtggaagcagtgagtctcgcgactctcaataaaacaagtggaaaaaaaaaaaaaaacaatcctcgcacaaagcatctccgtgctcccacaagcagaggcgtggctgcttgtttccctttttaaaggttgtatttttagttcttatgaaaaatgtttttattgcttacttctaagtaaacatgtatctccattacgataacgtagagaaaagctcttttaagaagtaaaaagagaaaactgaagtcacgttcacattcccactactcactgaaacgtttgggggaacttactcaagtgtttgctaatgagttttaaagacgagttaggcccttaacgcgtaattggggtcgtgctgtgcatatgatttgggatcttgcagcttgtttaactcggcccaatgacgttaccatttcccccaaatggttactaattccttgaaaacgtttacaaaagttctagaataaacactaaagttattatttttaaactccattatccaagttggactggtctggcgatcgactgttaaaaaaaaaaaattacaactttcttaagcttcctgatctctgtgccaattcccggagaaagtgtggggagtgcacaaaaaaagcccctcccccgtctcacgagggctgcaaacgcaggcgctgcgccccgctagctccccgcctgcacccccggcggccacccgagactgagcagagcgccaggctgagcgcggttgtgtgctggggcgaccggcctctgtggtccgcgtagcacaaacgtgacccactgcgcacacctgcagggcgcgcccactccggcactcaaccggctgggcgcgccagatccccagtgccgcagccaagggccacgtttccagcccaaggccagcaggaccgggtggcaaagggaagtcaaactgtgggtgcgtccggacggcggcgggcggccggaccctcacctggtagcgagtcgccaactccattcttcctaaccgggctccagtctcctcccagcacgcggccacgggagcccggactcaccacggcccggcgcaccaagaacgccccgcgcccgagcagctagcgcgctccgcccggagcac

SEQ ID NO: 347 - DNA, 45026 bp, Homo sapiens; identical to SEQ ID NO: 346

SEQ ID NO: 348 - DNA, 45026 bp, Homo sapiens; identical to SEQ ID NO: 346

SEQ ID NO: 349 - DNA, 187268 bp, Homo sapiens
gcacataatgccaaacatgatattatttccttatagtgttgttttaagttacttataaaggaggggaacttggtcttttactagcaaaaactgcttaacatttactattttttaaaatgttattttaaaaaattacaattgtataagctgatgtacaataacattgtaaaggttttagttttaaatggtagtttttgcttttaatttgaaagtggttgaagggtagaaaatagcatcttgttaaagaactggcttttctattgtacatctgagttcattgttttcttaatctttaaagttttctctgtgaataatttggtggactgagtttgtgcatctgaccaataattaaaatacctaaaaagcattccaaagcttttccaaataaatttatggtaaaaatagttaaaaaaatagcaaaactgaaaaagagtcagagtctggttctgtttaccaagaactctatcatacatttgcacccaattacactgcaaaaaacaagttactaatgctctgtttttgttgaagtaatcccatggggtcattgaaaaattttatgtaaaaatttcatttaaaattattcacatcttgcgaatggcttagattttgaaatcattaattcagaaatagaaaaagagtcctcactttatagaaatgacttacttatatcatttaaaattaaaactttccctacttatatttggagataggagttgagacccataaaacattgatgggaaaatggtttttattaaaaaatcttccatgaatccattttgttttcattgtattcatttttatcaaaatgtaaatactttaatcccattgaattttaaagtcacattctaaactaaaatataaaagtcttactgaattttgtcctgttatatcaaattattaaacacaatcacatacagttaagtagctattaaaagtctaacaaaaacaagggtgctggcttgaattgttcaatgtttggcaataactaaaaatacatagctataatacttatttaaaaacaaagttgtttcccgtatttccaccttcgttcctagagatacaaagtttaagaaaagtagattgtgactgtaacacgatctcttgttatttgttttaaatttgcacagaggaaaacttaatattctaaacaattaaatttagtattccaaatcattaaagtcttttaatgctcttatttaaaaattttcaaaattacatatgttgtttaaatagtatttatatgtacaatcctccattaatatgagtgaatttcccactgtaactaattattttcccattttgtaactatactataagaaaatagttttaaatctcaaactattggtttactgtgcaaaatttgcttttgtatgatttaatagcattgaattacaaatcaaggaatttcaaagtagttttcatgtctactattatgagatattatataacatataaacacattggcagtaaagcttccacttacatggtttactgtgaaaaaacaaatcacctggaattaatatgaaatagaatcccctaataaatattttatattcattaaaagaatctcatctttctcatgactttgcatagctaaccaaaatacaaagcttttccatatgccattttaatacaatggtcatcatttgtataccacacgcacacatatacacatacacacctatggcagagacactttcttctgaattgaccatttgcatttgcatgcccccagagacttaatcttgctgctgatgaatatcctcatgcctaagaattttatagataacccagtagaaaatattaaaaatcaaaaaagctaatgggaagcaggctcgggagatggtatcaatcttcttggcccggtcgataaagaccttcctcatttcatcaggactttttggcattacctggacagggtggttggggccctttggagtcatgccatcctttgcttgtagacatggtcccattccataggctgtgaagctgaatcggctttcccttacctcatcatcctgtcaaagaaaaatgtgacaaggccctttaataatacaatagagcatgtataacaggcatctcagaatcataaccaattttatcatggttaatatttacattaatataaggaaaagataaccgaagcatataaagatgaattggtttttattccctattgaagttttattaatttatcttgctgcattgtatagctgtgcccattaataaatgtgaaatcccaaagggtatgttttaatgggaaaactaaattctgatattttctacatattgcttgaatatctaaattaaaaaaaaaacaagataaaatctattgtgttatatatgttcataaactagatttttttttttgcatttttttttaaatggataaatgtgtgatgtcgaaggggaacataccaggatcattgactgaatttttctttctcatggagacaaaccttttaaagtttttctttcaattcgaagtcaattcctcagaaaatacagtctagttcaataatactgtttggtttatgttattctccctttatgctacttttctgttttacactaacctttttggaatacttagaagatggccatgtattctagtttatatatgactatgttccaggcacattggtttggttgaaattgtgaattatatctggcagaagtttatttcatgttaagaacataaacttttcataaatttattactatgttcttctaaaaagtatcatttcttttaaatgtggcaaactgaagagaattttccatgtttgtaaatgaagggaataaagaaaaatttaaataaaaaattatttaataatatatgatgaaatatacttgagagaaatataatatttaataacaatgcaaattattaataatttactttaacacatttatttagagtgtaatggtagctggctaccaatgagtaatggtttatttggctactaaattgaaggtctaaaagatgagaagacatttaataaagttgttatatctctcctatgataatgctttttcataataatataaaagatcaaataattggcttgaactcttgaaaattatgggctgggcatagtggctcatgcctgtaaccccagcactttgggaggctgaggcaggtggatcacaaggtcaggagatcgagaccatcttggacagtatgctgaaacaccatctctactaaaaatacaaaaattagctgggtgtggtggcacacgcctgtagtcccagctactcgggaggctgaggcaggagaatcgcttgatccctggaggtggagattgtagtgagctgagatcgcaccactgcactccagccctccagcctgagcgacagagtgagactccgtctccaaaaaaaaaaaaaaaaaagaaaatgatgttggttctgtgaaagtagctcctcaatgaataatatattataaaatatgaaagtgaaaaaatagaaattattatggattctaaaaatgagaagatgaccaaaattgatgcagtaaggtataaaatagttattttgggaattatgaaagtaacgtgattccacctgcaaaacaaaagtatatgattattggaaaatatttcaactgtaagatgtataagccattgaattttgaggacacaagtttgaaagaaaaactgacagtccaaactacctgagactactgttgtaagctcgcaaaaattgaaaatcgattttccactactctttaacaagcatgttcatttagactaccatttctttggcgtccatgaaatttttaaggcaaatttattatttgccttaaagttttccatatcctacaaattagaattaaattgttcttatgtaaatgctaaaatagcatccttataacttagaaaatcatgctggtgtttgcatttctaaaggaaaatgtaggttacccaggtaatttgcactattttgtgtaaaaatcacctgaatgttgaagtataaaataggcttttaaactatagcaacctatgtgttaaaagacatctatctcaaagtaagacaaaatatgacttctcagtgagcatttccaatgaggtgttgacatgttaattgaagcagttgagaaattcattatcaaaatgctcagatatcaggattctagctgatgtgcttagtaaagcagaattcattgactacctttctaatgatctgttctgaataacttattttaaaatctttagagaccttagctgctcatctcaaaacaaacataatctatttaaaattaacatattagtgagcaaccgaatttttctcaattgtatctttccatatagctgagggtgagtaaagagttaatacccagcctgggctgttacagtagtgctgagaatgacccctgattcctaaagcatcatttccttgaaaacaatggagataagctacagggggaattggagtcggccttttttactgtgaggggctgcacctgcactgggggagctgtgtattggcctgaagacctttggcccatgtgactagatggtatgcaagtgtggtttggaacaaaggctgtgattccctgtgtgaaggcaatcataaacaccctgacttttgtccatggcagctgtacctatgtgtcctgtgtgatgaggggcaaaggaagctcttgagaacctgctgagtctcctgtgtgaggcagatgctggaggtctgatgggtttcctgcctcacatcctcctagggggctgagtgaacataaggttagattaaagcctatgggtgttctgagagtctgtatgacaattggaacctcaaatctcagcagtggtggacagaagctgaccaggctttcagatcctttgagactcaatatggccaaatgttccaggagggagttctgaggagaatctgatgctgatccaatccggttttgaggtagccaaagtgctacagaaaataacatgctgaatcttattattggaacatggatcgcacaggtttatcccctgttgaattggcagatggatgatctgtgagataaaattgagaggaaagtggctcaagagacagttaattccttgtttcctattaataatttcgggggctgggggcggaggctcacgcccataatcgcagaactttgggaggccaaggcaggtggattgcttgagcgcaggagttggggaccagcctggccaacatggtgaaaccccatctctaccaaaattatgaaaaattagccaggtgtggtggtgggcgcctgtgggcccagctactctggaggctgaggtgggaggattgcttgaaccgggaagcagaggctgcagtaagctaagatcgcgccactgcactccaacctgggtgacagagtgagagatcccatctcaagaaaaaaaaaaaaaactcatggaaaaaactactcaagggaaagagacacagccagtaaagcaagcagcttcatgacctgagctcaagatgaaaacaaaagcccagttggtacttggaaggacactgcccttaattttaatcttcccttctgcaactccaggcaagtgacactgcaaactagtgactatagtgcagccctgttccataaaaacataatgtgagccacaaataaaagccatgtgtgtgattttaatttttacattaactacatttaacaagttaaaggcaacaggtcaaaataacttcagtttgaaaaaaaaaataactcagtatgttcccaatatcttttcaacacttattgaaggaaaaattgagatagttttcattctttatttcatacaaagtccttgaaacctggcatgtgttttacattcacagcacatctcaattcagactctaaatttctagtgctcaataaccacatgaggctagtagctaccaaattggacaaagcataaagaagctgggtcactttgctaagaagtggtagcagttctctagggaatccatgctttcctacatctttaatttaattgactaaggagctgataacatatttttggatgcagtagtgtgaaaagtaatgtttggtgtgaatgctaacccccaatctgctgcagtgttaccattcaggaattactggcaggtgtaatgtcaatgactcttttggagtaggtgaagcctggggtggtataaatctatgttgaggactgagtgtggcagcttacgcctctaatcctagcactttgagaggccaaggcaggcagatcacctgaggtcaggaattcgagaccagcctggccaagatggcgaaaccctgtctctactaaaaatacaaaaaaaattagccaggcgtggtggtacatgcctataatcccagctactcgagaggctgaagcaggagaatcacttgaacccaggacgtagaggttgcagtgagccaagatcatgccattgcactccagcctggatgacaagagtgaaaactccatctcagaatcaatcaatcaatcaatcaatctctgctgagaaggactgactgatgctctcactgctgtgaaatgtaacacctctacagaagagtagatatgttaagtatagcagcaaatctggggtggccatatgacaatgagaaagaagcctacccaaaccatatcccccaaccaaaacttgggtaagcactgggttaggagagtccttaggcatgtggccctcattctgggaaggcaggagggtgttttgattcatgggtatattaactcttggagctactacactgggttttactgatgagaagaaaatctaggctgttcagaagaaagatcatggccagaggtacatctataagctctctttaggtggctgttaagacacaaaaagaacacagcaaaaattgacaggatttctgtgaactatttcccagcagattattgcctgctgggaggacggaaatctgttccaattttggcagcggactccactaaggaaccctgttcgatctgttcttttcagctcagaagttaaatcccacggtgccaatggggaatggaaacaaaaggcactgacataggttgctaaatttactccatcagttaaggcagctgaaagaaacagactgactcgaaggccaggatttccatgcccaattcttaatggggctctatggctgtgctatggttaaagatgaattgtcatgggggtagtgaacacagcttcttgcaattacctgatgccaaagcaaaatatgtggtaatatgctggggaacaggaaagcaatataaagagtcaaacagaagctgcttgagcagggaaggaggcaaaggatcagctatagtagcaggtatcatggtcacactaaaaactgtaggtaggaaaaaagagagtaagatatactcagtaggtggcactgcctttaaccaaatgtatgattggaaaggatgtgatacataaatgaaggatcttggcatctctggcttgagcctagtcctgggcaagtcattccttagcccagttttaattggatgtaataaaatgggagcccttagaattgcctaactcgtcctttttaggaagattacaggaactctcagctctgattaagggaatggcgcaggggtggtagttttcattaattctctctagaatagcctgtctggcctacgataaagctagatggatcctacaggctgactgctgactatttgggttcagtaaagaagtttcccaacagcctccaccatgctggctggatgtggtgaaaactattcaagagttttggacgcaaaactctatccaagagttcaggacagagatggctggttggatttgatagacttgactgatgctttgtttttagtctcattggtaaaaaaaaaagtcaaacacagcatgtcttcatgtgaggtggacacaattataatcttactgtccatccctaaaggagcctaaattctccagtatgttgtcacaaccggataagaaacaatttggtccagatcattgtcaaaagtaagttttttaataagtgatactttccctgaccaagcagaaagtcagggaagagtttggaaactagtggcacctgtgactaggtacgggtggctaattaatccagataaggtgcaaggtccagccccatgagtccacttacaaggcataaccttgtctgaggacattagctacaagtcacaaacattaagggacaaactgctatttcttctgctttctattattaaaaaaaagagaaaaaacttgtggcactgttaaaatttggcaggtacattttggatttctgttggccccactgtataaagtaaccagactgaatttcaaagggaaactaaagcagactgtgagagatctaaagcacgcagtagccaagctggtccctctgaggtcttaacattcactgattgtgcaagtatctgctgctaaaacacacatagactggagtttctggaaaaagctcaatagtggcactctaaggtggctgctaggattctagactagaaaatcctctgacactgtcagcaggtataagctacatgaatgacagctactgacattctcttgagttctgattagaaacagccgcccagaccaaaggaatctgaaaggcatcagtccatatctaggcctgaaatacctaccccatcatgggtgatgtcaaaaaggcattccagtctaagtgccctggcaaaattaaaatagtgtattcaagaccaactcaagggaagtgactctgctgaagtgtatcatgtccatgtaaaaaaattctgtgtgacaatgggccaatgatggaccctgcagctgagtacccagaatggtctgaacctcatgactctctttcaacagaggcaaaacagaccatctagtttaccagtggaaagtcccatatgtggtgagagcttgtcctgagtatcaacaagagaaaacttgtatgaaaattgcttttggcttgaatcttccatggacaagtgctaacacatagctgtagatgaaatacctagggttcttgcccttggcttctggaggattcagtggcttttgcctgaaattgacagatattccatcttgggttttgtttacgttgtaacaaaagccatagctgaatatactattaagggcttggaacaaggcatctttatattagcttgggcttctcagatagatctcactgaacaaaggaacacattttagcccaaaatgcacaacatggcccaagggcacagcataggaagagtacctcatatcccatctgcccagagagcaaaggcttaaacggatattggaatggccaattaaaacatttaattattaaagatgagatgacaaggacatggaaagtctgcatagccttaatttagctacttaactttatgattattggtttcttattccaggaaaatatttattatactacctatcagttcttttagggtgagagaaaatatataaaccaccggacaaagcactcaaattgctgctattatattattcatattttgagtgtaatattacattattctagaaattgcacaaagcacaataggaaagaatacaaataacaacttgaatcattttactattagatgttttaaactcagagtaaccaaactagcactaaaatactatgtaaaataggcctacccagtcacctgttctccaggtggccttgcatttgagcactattacactaaaaggttaaccaacagcataaaagtaaaaacatcattcacccctcaagtcctcactgtcttattattacaatacatgggttttgccatgtgactgctagaattccttgcaaatctaatttatggaaccaaagagtctttgtgttttaaatgtgttccatgaaagagtgcagatcattttgaatgtgcccatgagatgaggcatgtggagtcatatcagacccctttcagaaacaggatctcaactctgtgggaaggaaaggaacagactcctgtacagggtcctgtctgctctcgcagtaagacaggggatgagagagaccatgagcccctggaccttaaaaacatcaagttttttttttaatgacctaaacaataattttaagcatggatgaagcttttctatcagcttattattattattagattactaaattagaagaagcactgaaatattttattactaatttttctgctttgcattacccagtcataaattatcctgtgtttatgtatgcttacgtgtgcagtgatattccttattataattagcactcaaattttttttgagataatttaattttctggaaatagcttcagcttacattctcatggattacatgtcaaaaaagcaaggaataaaaaataagtctagaacttttgactcagagacattatgtgttagccaatatttagtggttataaaattaaggcccttgacaacataaaatatagaaagtgggcaaaatcgctgattaaaaagttaaagaagtagtttagtttacccacaagtaaaccttcttactatgtttcaagcaagttagaatggtaggcaacgaagaatggagataaccatttagctactgcacaattctttttacaggagtatcttttttctgtaaatttaaaactgacaaaaaaaaatttcagtcattatgcttctatatcatactgtgagactttgtatgtctcttttcattttatttcaattattatgccaagcactgattcatataaaatgcaagttatagctagaaatattagagacagacagaaaatagaagggtgcatacagtcattgaataaaattgcttcatctctgtcaccaaacatgatactgtatattaacacatgtgtgaggcaaggactaattttgtatcttcttcttagtcctcaaaattgaccagaaaaaagaaaacttatgtggatgtgagagtgatgaaggcatgaatattgctattgagtgtgaacaaaacattaagcatctagaacagcatgaagtattgattatgtgaattgctgtaagatataacagcattaaacacattatttgcatcttaaagtttctcccttagtaggtacctttggggcaatgcttatacaattaaagtattaaatagattattccaaatgtctttttgccaaatacttttttgtaactttattaccaaataggaatgtaaaaaacaaaggaaaattaaattgttattaatctctatttatatggtttcaaaatgtgtagattattttaaattgctaataaacagcaatgacttattttgttgggaaaaatcattgtcctttgagaatatgaagaacagatgaaaaatgtgaatgaattaaaattgtttttctaaaatatctgtctaaaataaaatattcagtttcatatatctacacacatttttatatcatttataaatggaaggtctaaaataatgcaattatagatgaggtttaaaaaatactttgctgttgtaagtcaatcgttaatataaaattatttgaaagttcactccaagagaaccctgcatttattatagatgacatctgaattagctattaattagccaagtatacacttggcatattaaacttagattcagaaatagtttggacattgataaatggtaaaatttaaatttaaaaagatgaatgttttagatgaaatattatagaggacggataagaaatcaatggaatgatttatttaaaaatctatatatctatatctagcataatatgttagattcacttactgccaacttataattacggagtgacatagggtattacaatagacatcatatgttaaaaagcagcatttctattttaattaacattgagatggaagtcactaaaatgcatgtaaatttgaacagagattatattattttattaagtattattttcctgaacagattttcagagaatatagctataagaaatagctgcgtttaacataaactaaatatctaaatatttgtttacagggaataactgaagtcttgcaatttttgtcttatttgagaggatgcgatttcaactcctgatagtagagtcattcaaacagaattttgtttgaatctaagttattgggaaataagttttcttcgggtatgcatgaaagacatttgtaggaaacactttatctatttaaagaacatcttagctctagaatagcataagctgacctggaatggaaagattattgaataattagtgtatatggatgccatatggctttcaaccgtgaatccttctcacgttcatcagaatagtatatacgtacgtttgtgtttatccttagactatagacttgacaaatgcacagggcagaaaatcaattatttattatccttagaagctatcatgaattatttttaaagtaagacagcatataaaaacataagcaaataaaataaagtttgtgtacagatggtcaaaatgcagtcaatgatatctttattttttcaaaagataaccattgtgcctagcaaaacataaacttggctaggatttcttaaatctagaactaatgatccattcctatttcatttgcatatataaataataattaataaataatcatcagtagggaaacaggcactagaatactgtgtgcctatgttttcttgcagcaaaccattgcactattacattgcattgtggaggaagctacatgaaatgcattaaagcaatctcatttcattcatatctctcaacaaataacatgttcggaaataccttggcatgtctttttaagcctccaggactaaagtaatgatatcatacatgggaatagcgactctaaccaaaatgcttccatatcatgcatacagacacacacaagcacacacacacagcactggagatagcatccatgacatggtgcagtgcgtaatcagcacacagcaggctgggacagtgtggggtggggaaatttggatacaagagcaaacttgtgttctttcacaatagatgcaggattctctggtaccttcacagagggaaaagtaagtttaaaaaagcggtatacaataactaagccaatgctgagcctagttaaaactttcctaggaataataattgcattaatgtaaggtcccctgttgtgacaaactttctacagtgagactattttatttactttgcctgttctgccaaattagagtactgaagaaaattcatgtaaaccagtactcatgacaataaagggcatagtaccaacattgagactcattttgattctatttatttcaaaatttagattactcagactgtttctaagcaaaatacatagttttaaatgacaaatttgatcagcccagagcattgttagtttagggaaatagttttcaacaagtcaaagaaaacaaccacccccaaatttgcccaatgcttgaaatattttaaaaacaaatgggatgtataaactttcttatgaatatatctgtgttatattattgtttcttctataaaaataagaatgtattgacttcccataagataagcctgttttttcattagagttttcataaagtaatatttaattaaataggtacctttcactctatagtttctataaacattaactgtttagctactggagatataattatgttggtctcccagagaaagattagagagtctgctgtatagtctaatacctacttgtatctataaatatatattgcaaacactatatctaattatgtaatttccatgcaatgaaaaatttacagttaagataatcaaataaaagcaagtggatcatgtgaaattatctttcagggatgaaaaacaaagggagaaatggatgctgggaaataagatgtaaactttagttgcaaaggacaatcgctgagtgattatatattataagagaacgtagcaagtactttaaaataataccaggtctagacaatctgttatgaggttgagattactgcaagaattatttaacattaagtctcttgcagagatgcttacctgcagtgtacaatagaatcatctggagaactacttataaatatagtttaccccagaaattaagtttagtagacagaactatttgtgtgtgacttctcaggctaaattcttggcttcagtagatttctgtttaattattgcatactatattatgaacccccaagttaaaccacgtacagacccaaactatctattttagattgctttcctaatatttagtcattatacttggacatgtgtctttgtgacctctttttatttgataatttcaaaggatgctgctatcaaaactaaattgttcacttgctataagtaacctcaacatattttaacatttagaatggattctaaagatacacagaaggcacgaagcattttgttgccttattttgaggtctcttgtgcagttgcttttagaatttgtttgtataaataaattttccatttattttcaactaattttatgcaagcatctgagtgtttcttctctggtgattattacaagatatatgtgatatttctctttaacatatatttttaaatcattttgaccaatcaaatagctctgttaataaaatgaagggtaatatttaaatatccttttattgatgagagaagacaagaataaagtttttagaaaaagaaaatacccttcttagctgaagggggatgatatttgctcagctttcaatacaaaaggggctgtgtttccccaccaaacactgccttggtagtgcagaatatgctgtctgctttttactgatgaccacattcctctatttagagttaagaaagtcaatttaccatatctgagaaacggtaaaacttctccagtgcaaaagcttctgtctgtgggaaggtaaagtggaccaagaggaattgagaaaccagagaatcaattcatatatgattaaatataattacacaattggttgtaattgtatataccatttgaacagacatatgtagcaattaatagattttcacatatgcaaagtatctaccccaacatacaaaactgaacttaaaaaaccttttttcttcattaaatcataattatgtttaattacatttgctccctgaatatatcaagtagttatcagaaaataataagatatgattgtttttgcatttctgcattttcccagggtaccaatcactggagaaaatgaatgtttccctctttctatgagctaaagaggaaggagcatcaaatattttaatttcacttttacatgtggtaaaactgaataaagaggcactttggtaaaaataattttttaaaagaaggaaccagaattgagcatctaaacttgttgtctaatactttttctactggatattatgattactggatgtgtggtggatgtaggatatgtctgagctttcacagtttacccatttggacaccggatgcacaatacttctcttttctagaatttacaggacatgcttgatacattctaaattgtataaggagaaggaaaaaggtaaagaaatggaaaaccaaaatgacaaaaagcaaatcataatgatagggaacatgcgtattgctttacttctaattaatgatactagaagggaaagtggtctttatcagttactagtaacgaagaaagaccagagtgtcatccctgtgatacagcatttgtactgtcgttgttcaaccggtgccagttatcatgaaagaaaagatgagaaagtaggcggtggagagggagagagaagaggaagaaaaagagataaaggcagaatgaggagaaatgagaaatgtaacagaccagtagaccagggtgaggtgagggaagaagataaagttaatctccccatcacaatatgtttcagtgtacaaaagatatgcgtctgttttcataaaaatttaattaaatgcaagtcttagcctgttttttgttcatgtattactaaatctcccgatgctgaatgctgatgttctttccacgtagctgttaattgtgtgtttattggagcagtgatgcttttgggaaggccaattagaaatgataagtaaagttactgctttagaatatgtttaatactaagtagattcaagcactgagaggtcaaagcttagtgctttttaaagaagtttaatcaatacataaattgcagtataatttataaagaaaccttaaaaaattgaaacctttaaatacttaaaaatgcacactatgtgaactagactgttaccattaaggtttatcttttgacaaatatgccaggatattggatccttgccacaattacacaaaattttgacattattgtccattgctttaaaagaccatttgcttttaaaatgtctgttggcacattcacattagaagtaaatgcgtggatctgcggttgatagaggctctctcttatagaaaaagaaaggggattggtcaaaaccacatgcatgtcaaggaagatgccattacagttctgcatagaggaagaacttcatttagggcatccaaatccaattaggggtttacttctgcaacttcctacggtgtcttcatgatgttctaagtttcctcctggtttcatcacttatcagatagtagccaggcaacaaaagcactttattgtgtttcccacagggtttcaaaagaaatgtctttagctcatgacaatatgcatcaagaagagaccacagagatttgcatgtatttatcatcatggtattagtaaataagtaatatttgatggaaataatgaaatgaattagctctgacaaaggaacatgaataattacatttgatgacttatatcaagtgaaactattagaaatgctctaacattgcaagtaagaaatgacataattcattaattaaaatttaaaaagtgttgttccaggaagcgcattaaaaagaacttgatataggtcccatgtcatcggatatgctgtttaaagtagagctaggtgtcatcattttctccctaaagctatttttgacacttttagtttggattggaaaaaaatgaaaggaatattatatcatttcatccccagtcccaattgcttctcttttcatctctattaaatacaacaaattcactttcgagtgaaaactggattctgccaaacccaatacgtttaatcacttaccttattctttctctttcgtcgaaatctcagaagttctttgtgttgtcttgatacaaaatttacagctgcatactccagaagtgctgaaaacacaaaaaggaggcatactgccatccaaatatcaatagctttgacatatgaaacctagccaagagagaaagagaaagcaagcaaattcacttatattgttacttcctttgagaacaaaactgagtttttctgattctgaattatgtcatttatacataagttttaaaaaataaagaaaatgacaattttttcttgaagtttccttagttatttttgtaaattttatgtattatgagcattttgttaatttttttcaaatttaggcaatagcccaaacacgatgaaagaaaacataagatgaaatataattttaccttcagaacagtatactgcttgaaaagtatgaacattgaaatatagataatgctgttggctttttagttccatattttcatcaatttttttaaaaaaattaaaattgtatttattaattctgttaagatatttttctttcattgcatttataaataatatatggttatttgctatctattttgaaatattttttgacttttataaagacatgttataagaatagtgcaaagaggtcaggctcagtggctcacgcctgtaatcctagaactttggtatgccaaggcgggtggatcacctgaggtcaagagttcgagaccagcctagccaacattgtgaaactccatctgttttaaaaatacaaaaattagccgggtgtggtggcgggcgcctataatcccagctacttgggaggctgaggcaggagaatcgcttgaacccagggggcagaggttgcagtgagccgagatcacgccacttcactccagccagggcaaaagagtagaattctgtctcaaaaaaaaaaaaaatagtaataaggactatcagcttcttcagtcgttaatatttaactacatttattgttgtgtgtgtatgtgtgtgtatatatatatacacatatatatattccctcaaactatttgagtgtaatttgtagacacaacaccatacactcaacaaaatcaaaaatttgacatttataacattgataaaatcctaccacctaatccttaaatccctcccatttcaccaattgtctcaagaatgccctttttaatttaaaaaacagactttttttgttatttgttttccagcccaggatttaatccatgatcatgtgctgcattttgttgccatatctctttagttttcagtgtgggacattatctgtctctccttgcttttttgtggcattgttacttttgatgagtacaggccagttattttctaaagtttgcctgatatttcctcatttacattcagatgatggatttttagtaggaattcccaaccagtgattccctgttctccacagtgcatcatatcaggaggcacacaatgttgatcaattgatgaaggtaatgtctgctaggttgctctattataaaattgctaatcttcccatgcatggaatattttgaagctatataagtattctgttactctttaaatcttcacacactagttttaacattcgttgatgatttttgcctgaagcaattattacaatgatggttactcagtggtgattttctaatttctttattcatctatatttatcaattagcattctactgtaagaaaaattcctgtcttctacatttatctgtttattcatttgtttatttatatgtgtataaacttatggataactgttttcttccaagtgatgtaatacattaacatcattatttattttgatgctcacattattctggattgggccattagaagcccctagatgttagcacatatatccgtttgacaagtcgccctcattatttgagcatttcctcactttctggcacaagatactccagattcatcttgtacttttcctgttcttgtttttgagtcagccctttctctcaggaactcttctgtagtgaagagtggtttttagaaaccaagatctgggcactgggtgtattcacatctccctaagtggtatcgtttctaggctctcatagtggacagagctagcaatcacacacacacacacatattcacacacacacataaaatgtagcacctgtgtaaatttctgtatcatctctatctatccatctatccatcaaacatgagcttacattacatctctatatctaactcaacaccacagggttccctttagcctataccctttctatatatgcaaaatttttctctaaaagtggaaaacttgactcccattatcctcaacatgtacttgatcattcaccgtgtatgtgactaacatctcaattctgccaaccatattttcagcctcagcaccttaatataatggtagaaccagatactgtgatcattcacctcatttttggttcttatgaaggtgctttttgtgtgcagattgttgttgcatttggccttcctgttgggaggattatggctggaggcttctatttggccaccattggccccatttggctccttgctcctggtcccatcccccaatggccccactggccttggtcctaactaactatttatcctgctccataggatctggcaatctggcagcatccttgactctggttccaccagacccagccagcctccttgattctgacacctgctcagctatggccctacaggtctcactgtgtcttgtcacctcaaaggtagaaaagggaagggaagaacaagaaaaagaatggaaaaaacagacaactttaaaaatgaacacaaagggaagagacaggaagagaagagtaaaaagaaaagctacgtccgtattttctagaaatagacttatacagacctaagtcccttagaaaaagtaattcagtaacctttaagcaactgttttcatactcagtttaattgggcagtgatttgaggttgtagctgaactcatatctgtgtatatgtccattgctcaaggttgaaaatttgcttgagtattagtttccgctcttattgtatacatgtgcatatattccagagttaaggaagcatatcttgcaagcaatgccagcaaaaacataccttttgtggagtgagcatgagataattcattttgtttcatactttatatagccaattagatgtgtaaaatgctgtcatttgccaagtattagaaataaaaatgagagatacttatatttatgaaaggtaagatgtttttccatctttcattggaaatggacaattagctacaagtctgtttccttgctataaaaataaatatccttacttccaagaagatgtggatctgggagaacagaatgtcaggctgggttcaaactaatttgccctacttctttggacccaatgcataattatcttaaggatcaacaccctacattttaagaacttgcctgtctttgtgctgtttatatcttctgtattctttcctctttcatcttcaatatttagtgcagctatttttatgaaacgttagcctgtgggaattttgaacagatttagatagtagttttaaaggataagtggctcaacatttgggggaaagttagggtggcaggagtggtaaataaagtaaggaaaaagctctttcctatctttcccagcaggttcttcaggtctcaggctagactttgcccaaatctggttcagaatctcatggtacctgtgctgacttgctgtgttaccctaacacattgcattggaattgttattccttgtttttttttttttctttttttttttttcctgtttgtaatgtgaactctttgagggcagatgacatctctgttttggtcaccatcacatcagcgtttgtcacatgtacatatctgctgagtgaatggacagataaatgaaggcattaaatggtaaactacaggcgtcgggggagaaactgaatcatagatgacatatggagattcactttctggagcaatgctttcttaataccttcaattgggttgattttctttttgaaagagtttatttcttgacactcggaagggtgtcaacttacatatgaagtatttcaacagggaagcacactgcatctcctcctgcattttaagtgtgacttctactgatcagaatcatctccactgggcaaagagcagtgcatctcactttattccagtgctgtatcaaatgtccatctgtttgcaagtatagatttaaatctcataaattctgtaattcggccagaaatttctggctgcttccaaatatatacagtcctggaacaagtaatatggctttcaaagatgctgtctcaagccacattattcctgaacgaatatgactcataaagtatttgtgcattcttgagcatcctgaatccataatgacatgaaccacagaaattacatcagaaatataatttccaaattaattcaatgagtgttttcagtgacaacaaatatgtggaaacatcatttgtgcctgtcagggttctgctaattgttaacagcttaaaagcattgagcctaaaggcctactttcctcatcatctcttcgaaccccttcaccaatttcaagtctgtttctcctcctccattctagcttctccgccaagtacagcaaacacaggacgtgggaagtttggaactttggggctagtaactttaaaataaagacagcagttcttacttcaatgcattcacaacacactcatgacacacagcgcactccccatggattcagagtcattaccttctttgctccccctcctgtatgtctcccttttgggcagtatcattccaatcttgaccaccttcccaaaagacccattgtccactggaatcctagttctatattctggaagaatgcctcctcggtataactctgtgaataccagtgtctatggaaataaaatctaaaggtttactaatgaggtgcactggtcaggggacctttgtcccagaaaccactcccaagccatcctgcagaagaaagcttccttctcagggggtgctctttccatggcttctgtgacctgtgttttctgggtttccctccctccactccaccccatcggctttgtggattctctttcttttcctgagctgcttagggagatggcctgggcccttttctattctcactgggacacgactcactaatccatcgtatctatccctatggattcagttcctcttctgtgctcatgatccccaaatctctatttcctgactaaagccccctttatccaggttcttccttcacggcactctgactgtctcccacgcctcaaactgaatttgactaaaaaggagtcaagaatctctaccagactaccacctcccccaccaaaacaaacaaacaaaaaaacaacaacagcaaatatgcacagctcccctctcttctcattaagagactccactctgcagttgttcacccccaaatctaggaggcttctcactctctcttttcaaagattcagccctgttaattatgttttctttccatttctcaagtttatcaatttctgttcttccttatactgtcatcacactgattgaagccacagtgtgtcctagtccctcagcgatatccttgacacaacagttagtgaatcttaaatgcaaatctgattgcattgctttaggcttacagttcttcatttgctttctgttaatttaatgttcaaaatctgttttatggggtataaagcccttcaaaattagcccttcataataattcatattaacccttcacataaagactagctttcatttttgttttttattcaacatttactgaatgccgatgatgaacccaagttctgttgttaggtgttacaggtatagagatgagaaagacagacaagctctattattaatggagcttatactcaagttagaaaaacatacaataaaagcaaacacatacataagataatttaaaagaagtgttgtaaagaaaatttgggagggtaacgatatgaaagactgggagaaggaggctatgttagatggcagtggccagggaagacctccctgtggaagggataattaccaccttatgccagtttcttaattgcttattatgtagtagctatatttcccttcttttagtttttgaaacctgaaagcaattgacaagctccactctgcctcagctgctttgtatttactttttttttttttttttttgctattactttggactggaaccctccttctttgggtaactactgttcatcctgtaggtctcagcttgtaagctacttcttcagggaaactatcttcaaatgcccaggccagaataacgcatctcagcatcccacttccacttttttcaaaggtcactcattacaacaataattatatttatttttgtggtagatcctgtaagatgtctgctggctagcaccacttgaatgccccaccatcagttaattactctatcctgcaagttttaagtgctttccactttccaaaaactttgattagaaggatgcaaaaattagtatgtccatgaagatttgaagatgagatgtctatcctaatatgttaacaaaatatgtattgatagcaaataccaaataactccattgtatcattgatttcgtctcactgtactgacattatccacttatgtatcttctgcttttaggctgttacattccatgagctaagacaaaggccagaccttatgcatttttgtatctctaggatgcagcacaaggttctttatggtaaaggctctcagttgggttgactcctgtgtattgacttgtaatcactggccatttattattagagaaataattatattaactaatatgccaggaaatgctcttcatacagtagtgttcatatggtaacacttaatccccacaacaatagagggaatcatccttattttaaagatgaggaaacagttgcagtgaaataacttgcttaaggccacatggctaccaagttgcaaaactaggatttgaatataactcatatggttccagagcttatgaacttaactactattctatatcacctagttattaggctgcttccatttaagatactactgcaaatcaacaactgtaaacaatgtaaattggaattcctctctgtatcttaaaattccaggctctataaatttcatctgatatttaagagtaatgtcagtgcacaaaatacatactgtaagatcctccatatttgctagctttgatcctaaaatctgacagtcaacttcctagtagacaacgtatgaaaagaaatggtcattatatttactagatgaaaacaaactagttgcccaggtgaagcaaaactattaagataagagaaatattttatcctacaaaataccatgtatgtcccccagcagtagtaaatatactaaagttgtttatgagccaggagacaggaggctattgtttacttgccatgtaacaatccaggaagagatcagcttgataaatgatcaatagagtacacaagctaggttattgcaaggactagtctttttcattctaaaaaaagttttataatttaggaaaaggaatataagcaccatatggtctgtagatttcttacacttttttccccaagaaattatgcagtttttcttttttgcaaaattatcattagaaatagagaaagcctgcctcttgcatctcaaataagaatatatatatatatatatattatatatatatatatatatataattggattttattgctgtcagtcatcttggttattaaacacagaatcaagtcactttggctctgagaagcagtcatgttcagggagcttgcctaaccatgagatttctccgtatctacccctccagtgacatgaggggtttgtcatagggaggattcaagctaggatacaatgcaagtagcaaacaaccacaaaatttcactggcttgaagaaacaaaggtatattttgctctcatactgcatgtctactttgagtcgaatgctgaccctgaaatggtgttgtcattgctatcctcacttgtaacacagcagcagaggaaaaccaagtcgctggtggttctcacatttggtcataaatgttccagactggtagtggcacaggttgtttctgctcaaagttcattagccagaactactcacagtcaaccctgatcacaagagcactaggagatgtaatcctaccacatgcctagaggggaaagtggccttcgtggcacagagcattatgataactccagagaaagtcaggagggcgatttctatttgtccttctgaaacaagaatcctcataagcacagaattgaggaacctgtggattatgatctgatcactgtgatatcttgaatagcacataaaggcagctttgttaaagagaaaaactcactgctttatggaaagaagctgtcaattaattagggtatgacaaagaataagaaatgtcccctgattttctgccaaaaatttcataaaacgatagtgtcaggtccaaattcagtaatatgaattgtaaggaggtacaaaaaagtagagtccaggtagtgctttgaagcactaacttaacctaagacagataatcaattctctagttgcagagagtaaagacaggcagtctgcaagccaaatttatgtatgagaataagtttgtttggactgcacaatatcttaaaaaagaaaaagaatatgcttctaagcacggaatgctcatcatcagttaaccatactgctcatccctcttcccttcattaattataccagaccactttgttcatttatttgtgcaactgacccctgaagtcatttgactttgtgctctttgatcctgatatggtttggatctgtgcccccacccaaaactcctgttgaattgtaatacctggtgttggaggtggggcttggtgggaggtagttccatcgtggggttggtttctaatggtttggcaccatccctctagtgctgtcttgtgacagagttctcgtgagatctggttgtttaaaagtgtgtggcaccttccctttcaatcttcttcctcctgctccagccatgtaagaagtgcttacttccccttcaccttccactatgattgtaagtttcctgaggccccccagaaacagaagcctggatagcccatagaatcatgagccaattaatcctcttttctttataaattacccagtctcaggtagttctttatagcaatgtgaaaaatggactaaaacaagtccagagaaatagatggtttgcatatatctcaggtaatccttcataactacgtttacttttgcacgaacttttgataggattattgaatagcagtaattttggatcatattccttaacaagtacattgagtgagctgtattataactacggcagtatatgctatggttgagagacctgccgagatgtatgcctttacttcagtccacatggaggtggtcaaaaggattttcctgtgaccaataaattcctgttacagcttatagacaacaatatattaatgggcaaagatatatttgatgtggctagctaaattataacccagatgaccattaatcaatggattctagaaatagaaatttaaatgtatttataaacagcatagtttaaacttaagaaaaagaaattgattaaaccagaacctggagtttgaatcacaaaatctcatctacacctacgtgtaggaactctataaggtaaatttccagggatcccttaagagagatagtttgtcaattcttttctcaatccaaacttgctttttatttgagaaaaaagtgtaataaaacatcacagtgtatgcttttgatgagctaaaatagccctttgaatagggtaattggttcttcctttaataacattcaatcctggtggattgccctagttcctcagaaatgtcaagtaaactgtgatgagtacttttggctgtgcgatgggcaagtgattgaagcctacagataactgctttttctctgagatatgccgaaaatgtctctgcttgtgttatgccttgttttgtgaggttttaatttcagatctcattgactattcatttaatcattcatttttaaaatacaaatttgtagtacccttaatcctacatttctccttagtgcaagaacctgtataagaattttacattttgtaacaggaaaaaataatattaatctcaaaagcatttcaaacttcattaagacctaaagccagcgagcaaggaatctggacaaaagaaaataataaataatgttttaaagacaggtgttgaagtggaatgaagctgatactgaaaaggcaaaaggaggtaactcaaggactactttctcggagcatgaataactaggcaatgaaacttacggcccaggatattgtgagtttcgacattctgacatttattatcctggagggtgactcacaacagtcttgctggtggaatgttcatgctgattatcatagtcataaccctcagtaaatgaatgatgcttctaacacaatatttatttttcacataagggatttttgttttgttttgtttttgtgaaagggtttttctctgtcacccaggctgaagtgcagtggtgtaatcataactcactgcagcctcaagttcctgggctcaagcaattctcctgcctcagcctcccaagcagctaggactatgggtgtgtgttaccacactttgctaattaaaaaagaaatgtggagacaagagtctcactatgttgctcaggctagccttgaactcctggcctcaagcgatcctcccacctcagcctcccaaagtgctgggattacaggtgtgagccactcacgtaatggtttttacttcatgagataaaatacaacagagaatcacataataacaaaacttcattgtttccaaagaggtgaatttaaccaatactttcgtcaccagacaaggaaagtacaaccaaaaagactaaagaattttgaaaagacacagttatctctgactcccacttcagtaactggagttttaccatcattttttctgtaggatgtagctctttttcttatatttaacactgatatgaaattgtcaaatctagatgtcactgaaaatgcttcttaggtgcatgccgttagacttcctggcatttcttaatatattacctttttttgatctactcaggctaaattataattgtgacctctcttttcttcatttttgtagtgaaggttttgtgcttctatagcatcatttttattgtaatcatataagttcctattcccttttcctctggagttcaagagcttcatttaaaacttcaaataggaatcatggagacagataaagcctgtaaaggtgtttgttttactctgattttggggcaaagtgctttctttcactggcgaagtggtagttttacattcacttttatcttttggggactcagggtacgattctaggatatatatgaacgtggtggatgacattgtttacgtagtctccaaattgcaaacatatctttgtttttaaacttagtttgatgtcaaagctgtggtatcatgccattttaaaacagttttaaagtttatgattcggccatatactttccctagttctatcagatttaagaatttatgtagcagccctgtctctatctcaagtacagagaaaatgcttgataatcattaatttttcagcttgatggaatctaatatttctagtaaagtaggtcctaagtaggtccttgatgaaatctagtaagtctagtaaaggaggtcctaagatgaaatgtagaactagagatatccatcaatttctatccttcttatcatagaatccacccatttttaggacttttttatttacaaaacagataattttttttatcagtaataaaattggatggtattcatatacattatatcttgtgataagggtatgaataaataattatttcattttctgggccttttttctttttccccttttttctaaattaatgtatatggaatcatattagctagtatgatccatgaacatttaaaaaatttagttgaatatgttgcttatatcaaacactgtatcataaagttaaatttattacacattctgtcacagtaataaacttaaaatgaactcacttggatcatgtttgtactgaacttgattgaagtaacattagttaactacattttcagtaaatattaaaatgttatgtttaaatggtttggaccaaaatattactgacaataataactattaattgctatattaataggaaaacctgattactatgtagctctcctgaccccattacattatcactaacacaatgtactctcctttaaaatttaagggtttttttttagaagaataagactgcgtatttgctaattagctatgaacacaacagtgaatataaatccttcatttttcttcccatttcctatccttttattgtaatcaaccacacatagatatctgtgtgccaacacaattgtggtgttcaaaaaatgtatcagttcaatttatattttctaatagttataatcatttttaaaattggtgttatgaagaatgaaaacttaatataatataaaagctatcctcattatttttcttattttttattatttttttgagacagagtctcattctgtcacccaggctggagtgcagtggtgcaatctcagctcactgcaacctctgcctcccgggtttaagtgattctggtgcctcagcctctagagtagctgggattacagatgcccgccaccacgcccagctaatttttgtattttttagtagagacggggttttgccatgttggctaggctgttctgaaactcctagcctcaagtgatccacccgcttctgcctcccaaagtgctgggattacagatgtgagccaccgtgcccagacgctatctctgaaaatgaggacagtttcacagagaaattgaaagggaaaaaatgagtggaattgagaaaggtaaaaggttctaagtaatcattgaccataaacagtttttggtgcagaatttgcaatctccacaggctaccagcttctgagcttctgtaaaatattttatcaaaaagccatatttgaaatttcaaggactcattattttttaatgtttagtagctgttttcaatgagatggccatagtgatgggagcagagaagtccacatagaatctccctaggatacttccctatttctttcctatcccttccacccctcttgtttttctgaacatttactgacaagccagagcgtggtctaagaaaggagaccgaaaacttaaacaaataattttcccaaggtagataagattatttacaattccctttttctttcttcctctccaagtcttccctgtgggtggagtgcactcttccaccctattgactttcggtttggccatgagacttgtataatttgtggaatgagaacagaagtgactgtgtgccaattctgagcacaagccttgcatgtttctgcttgccttcttgatctccagcactcctccatggaaagaccatgttacaggtccctgcagccccagaatgaggacacagagggagcagatctgaaacccactccacagcctagatccaagcccactcgaacagccaatctcagggcaagcgcagaagagatacaggcacctcacagtcctgtgagcaagaagaaatgttgtaaaccattgagattcagaagttgttatgcaggataattgcgatgtaactggattatcagccccaagtgccaagaatctcataatattaatatattgtgttaagagctagggtttggataaacttgaatctagagattcccccaccctgccaagtttctatctgtgtatgtgaatgtgtgcgttgtgtatagtgtgtgtgcatgtgtgtgtgtgcatctgtttgatatgctatgttcaaaagtctctgatatgataataagtttaaaagactaaaataaggtatgcatagtgacacttgtgtacttctgcagatgatatgaaacataaaacacacaacagacctggtccttagccagtctctatgaaacaggatgaaaaaaaatgatgagggtaggtctctaataggaattaattgattgttgaaatcataaaataaagggtaaggtgtatataatattgctgtatatttcaagatttctccagagttccctaatgtggattccttctagtactcagagtttacaaattaaaattatattttgtctcttctactgattttctctattcttacccatccccatacttaattccttcagtgccaaggtcttaactgaatattgaaatcaaatttatactaaaaataattgaattattattactatctcctctttcaaccctgatgaaatgaatcctcctaagaaggaggattttccatatctaaaaaaaagattacagaatgctgagatctcaaagagtttgggagtaaagttttggggtgagtgggtcttgcctttaaccaaactgtctaatatattctgtttatgggtagggatagccccgggaggggaacagagagagaagattttcagctggaggaagagagccaagcacaaatatatcttctttccctgtctttccaggctttcttccactagaaaaatcacctctattccacttcccaattcatttgtagtttacaccctaaagtctgagggctggatgtctttggtcagaactttggaagttcttagtttttgacaattccatgtgattgtcttgtaaatgtctccaagttaacatgttttagaaaagaacccacaattaacctttcccctaaccttccctattagtaactatcatctctacttgcctagttacttacttgaatgctacccttgactcctgcatttccctgaattttccatgttcaattcataagcaaatcctgtctgttttacttccaaatatattttttcagaaacatttacttctttctaaagccatctgctactctctagctctgttgctaccaatcttgccagatcatcatctgctgtggactacaatagcttgcttggtagactccttgctcccactctgcctcttctatctggtcttcaaacagaagtcagtgtaattgctccccttattaaaattcatcagtggcccattgctgcacccaaattaaacccaatcattaccaaggcctatgaagtcttccttgataggccccatgatcattaccatcttttctcactctgccccaagcacatggtgtaagaaagtgctcctaaagttacacaaccttgaaaatttgctgggaatagaatgcatatatcaccttcttatggccacctgatacagacactgcaaaaatgtaaaagagttcaagtttcaaggaatcaatcacaggagtgttcttgctttgagagactacatgcttgagttatcatgacattgtagaggctgatgcaatagaaaatatcagagaggaatatcagctctgtagttctctagaagctggctaaagtacattctttgagatttcattctctgagtcttacttaagcaatttctgagctctttcttatcttacaggagatgtattgacacagagcctagaccaaacactaggcaaagatcacaaaattatgatttattgtttcactgtcctatgttttatagtcaattttcctgaatgtaactttgttttcctacttcctagaaattgtcagtaggtaaattctgggtgttttagtggcaagactctcagacttctgagggttcttttgtgagattgagaacagaagatcttaaggtgcacggtctcacacatctgtttctaaatgcaagttataaagccctcacctcctgtctctctggcccaaaatagttgcagaatcagaattgtacttttaaagagattttctactcttttgaatggtctcatccaatagattaattcttttgtttatcctgggtccttggggtctgccctactaaaattgaatgtaagtaattaattatgccaaacctcctattcctgacttatcttgaattctaagatgatacagtcaacttcttttaaggtatcactttctcaatcaattccttttgtgggtcagagtcacacctgtcatcacatttttagatgtcattgtctctatgatcagagagatagactttgtacacatgtatgtgtatagctgaactcatggctgaaaatttatttcttctgtaagttcttgtggaaattaaagccttttaaaaatgtctcctatttcttgagaaaaaaatacaaagcagtcctagacattcttcttttttttaagttgtgcctccattctgtgtttttaatttattgcttgctttatttctgcatcctctactcacatttccatgctcccccaattctaccttactctctgtatctaaacgtctttctgttgtgccttgtagaagccatagattctcctttttctgactgacagcatacagacaaatgagctttcatttctgtttagctcatgaagatcagtgagtaaactgacgatttcctttacaaattaactatgaaatttccactattacccagagctcttgcaacgtttatccttacgtaaataagcattgagtattattagtttacatttataaacagatttataattttcacatgaaaaatattttagaaaacactagttgatgcgaacaattttgaaaatacaattaattgttaataaaagtagacattattaggaaagacaaccattaacttttagtgaggcagagcatgttaatatcatattttaatgataaaattcctattttcaatttttatttatatgggcatttcaatctaataaattgaatcatagaatgaactaatagaaaggactaagggagccatgacaatagatttataatttacttggtgtagcaagaagatagcatcaaatgcacacaaaaaaagttaatatgattttattgcattgaagtacttcatttcaatgaaagtaatagtaaagcttcttggaagctatgcagaattacttaatttagatgacagaaacttcttcttagacgtcattttaggggaagaaaataattttctatttctatgcagctaaataaatgaaaagagttttatttcactatatcttatgcaaagcaatattgggtcttttacaaacctcacagagggaacaattttattttaattctggcagctcagcatggatgaaaatcgtggaattagataaggtctccttcctattgacttatggttacttaaaagcaaaagggagaaaaaaacacaaaaataatatataccatattgggctcagggtgcagcactatgggcactctgataaaatacttgtagtataattggtatatttcttctggaaataaatttggcaatacatatcaatgcatatggctatcactgcagcaattctgtttataagaatatatgctaagaacataatacaaaatatgtgtaaagctatgtgtgtgtatgtgtttgtgtctatatatggatatatatgtgtgtttccataaaatatgtgtgtttataaatatagatgatatgtgtgatatgtatagacacaggcacacacacatatacatatatattcatatatataacatttattatagtatcagtcctaagagtgactaagtaaattatggcatatccatacaatggagtactatgccaccatttaaaattaccatgtagattcaacttaaatgtttaatatatttctaaatattttaaaacctattgatacaaataattccatagtgtataagagtattattgatatttaaataattgggaataataacacaaaatgtgaatagcggatatcactggtttgcagaatttttttcatttatttctgttttacatgttttctgctttggttatatattactttaaaaaccagtaatgccattgaaatgccattgaaaaatatctgaccaaagctgacaatgatatctttgcaagatttataagtgtgtgtgcaaagatgtgcatgctcattcagtgcacttacttttggcaaggaagctcgtgatcctgaactctgtgtagtcatcgttagcacagtggttatccccagagctaccctggccggtgctgcatccatgttgatccagaatgaaacccaggatagaataacaatcaggagactgggaatgtacatctggatcagatagtatcccatttgtcgctccagatggaatcgcacttctatacacgtaaactttcctaattggtggtaaggtaaatacagcaattagtacaaataggtctttgttacggcatcaaatatcacaatttctcttttttttttgagacagggtctcactctgtcccccaggctggagtgaagtggcatgatctcagctcactgtagcctgcgcctcctggattcaagagtttctcctgcctcagcctcccaagtagctgggattacaggcatgcaccaccaagcccggctaattttttttttttttgtagagatgtggtttcaccatgttggccaggctggtgtcgaattcctgacctcaggtaatctgcccacctcagcctcccaaagtgttgggattacaggtgggagccactgctcccggcctcacaatttcattttgataaggattctgttataaaactttccatgacaatgaaaagagtctcgtattgattcttgaaaaaatatttttcactgttagcatcaagaagcaatgtagtaaagagagcgtactcttttaggaaatagtaggaaactttattacttccgacttgaaaagtgctttacacttgtcaagatatccaaagatttattatttcacttgattacgacaattgcttctgaggcagacaggagaaatatatacttattatataaagatcttctttactcatagactgtttctggtgttttgagtgcttctttagagccaggtgctatttgttgcagaagcctttccattttctttaaagtaagtgctagaggataaacacaattgaacacgaattattccttgaataataaagcaaacaaataggaaaatatgtgttatttcccattaataaatttgaaaataacttaaaaacacactaaaaacaaagggatccatttgtactatacacttatgcttttatgtctctattatttacctctattttggtaagcaatacatagaggagtaaatgatggtttaataaacattaagtcgatattttttgcttgtgtcctggttctactccctactctattgatattgatttatactactctatgttatctctcctttataaaaattgttcttctaaatcacccagttcttggtttaattgtttttatttgagttatttcaagaaggatgaggtcagaaagttaacattctgctctttaagtaacattctgttacttatgatgaaagaaagatgttaaagagcaattgctgtcctattgctaggtagggctcagtgcaaagcttctattcatgtgacttgggccgtgcgtgattgcacaggtgatgcacaggcactatatctggatgaacccatgcatgtgtttccagagcttaagtctcaacaaaagttcataaagtccagaaaacgtggattccactcttaagtgaatagcaatcagaaacatatgtgcaaaccatacatgatccttttattgatttatcaaatatatacaaaatgcctaaagattcctgaaatatatgaaaatactttagattttaaagtgctattaaatataaagatttaaattttgctatgagaaataatgaaatggaataaaacaagaataactgaaacatatttataatatcagttaaataactcactaagtaatcccatagcataattagtaacaaatactaaccattcagatactttgtataaattctctaaatttcaggtgattctcaaggaaaaaaataagctccactgtgtttttatttaaaaagagtgtttttcaaagttcaaaatcactaatcatcagaaaaatgcaaatcaaaaccacaataagtgcaatcccagcactttgggaggccgaggcgggagaatcatgaggtcaggagatggagaccaacctggctaacccggtgcaaccccgtctctactaaaaatacaaaaaattagccagtcgtggtggtgggcgcctgtagtcccagctactcagggggctgaggcaggagaatggtgtgaacctgcttgcagtaagcggagatcttgccactacattccagcctgggtgacagagcgagactccaactcaaaaaaacaaaacaaaacaaagcaaaataagatattatctcaccccaatgaaataactattatcaaaaaggcagaaaataacaaatgctgatgaggaagcagagaaaggggaacacttgtacaccattggtgggaatatagattagtccagctaccggagaaaagagtataggagttcctttaaaaagtaaaaataaaggtaccatatggactacggggtatatatccaaaagaaagaaaatcagtgtattgaagagatacatgtttgttgaagccctattcacaatagctaagataaggaaccaacccaagtgtccctcagtggaagaatggataaagaaaatgtagtgtatatacacaatggaatattattcaaacaaaaaagaatgcaattctatcatttgtagcaacatggatagaactagatgaaataagccaggcatagaaagacaatatcacatattattattcacatgtgggagctaaaataattgacttcatggttgtagtaaagcaaatagtggtttcgagaggctgagaagaaggcaggtgaagaggttggtgagtgggtttaaaaatacacttagaatgaataaattctagtgttcaatagcataatggggacaattacagttaacaatactttatcgtacatttcaaagtagaaagaagaaaagatttggaatgttcccaacacaaagaattgataaatctatgaggtgatagatgtcccaattacccagatttgatcattacagattttatgtttgtatcaaaatatcacatgtacctccaaaaacatgtacagctattatgtatctataaaaattaaaaaatgtttttataatattgctgggaaagaaaataaagggatacacacatgaacacaaatatacaccattgcttgtacataaataaatatactcagtatatgtggatctgatgagataaaagaacaagttggacaaaaaaatccatcacttatgcatggcagcagaccccagaaatacagtgatcaacagaataaatataatacaaacttagggcaatgaaagaaacatgcaaaaaataagtaaacataaaattgaatgatataatttcagatggtgaaagcagaatttgggcgtttaacacatattgttacatatggatgtttcaagagttggcatttgaataaccctgaagaaagtgggagtattaggcttggaacaatttcaggaagaactttacatgcagaaggaagagcaagagcaaaggccctgagacagacagagatgagtttggtgtatataagcaagcaagtcattgtggcagggtattacggagcaaggggaagagaggtaaaagattttggagaaattattagaaggagacagatcataggatgctgtagcacataactaataaatacttcaggatagtgaaaataaaactgaataaatcctctaattttgtgcaattaatttgtgtatgaaaacatttttaacttaagtatatttcattttctggggggaaagggtattttataaatgtggttcttaggtaacctactattgttgtttgttgtattttcacaagcaacataaaaggtatatgtggtatctaggcctattattggaaaacaaaagattcttgtgtaatgtaaaagcaaatatgaaatggagtctgggatctgaagcaaattaaccacatacttgaatgaggactctatgagatgcttttattctctacataatttgggcacgttattttgcttctggacagtacagtgcttctagaatgtaaagttgtaagatctctacgataccacccaagatgtcccattccttgcttatagtaggcattcataaatgtaagttcttttcctttaagctgtaatagctcatttgataactcaaggaagtatgcaaacttactttacactaaggaagtgtcttgagaccctctatcataaaaattcatccctaattgatgtttataacttcacctcttgttctggattaaatgatatctccctaagattcatgtccacccagaatgtgtgaatgtgaactgacttgaaaataaagtatttgcagatacaatcaagttaaaatgaaattgtcctggataagagggggtcccaaatccaacattacttatgtccttatagaaagagggaaatttggacatggaaacacagacacacaggggaatcccatgtgactctggaggcagagactgaaatgatgcatctgcaagctgagaaacaaggttttccagaaataggtagtcaggaagagacagggaacaactcttccctaaagctttgagggaaagcacggccctgctgacaccttgaattttggactcctaccctccagaactgcgagagaacacatttctgttgttttaagacaccgtttgtgataggttattatggcagccctagaaaactaatatacctccctaagccaactctaggggatttttagcatctgtctaagggaactgagcaaggacagtgctattgacttgcctgctctttatctttgtgttgagatgttaaacttgaactccctaataagttagatatcagcttcatctctgagttaaaaggaaaatggtagtgactttttgatccgatattgtgaatttgctaaggagataagagagactagggactttgaatagtgaaaggtcacagcacagttctggaaaatgctgagtccacgatgaatcatagttactgtaatgaaatgataagaacagaagctgatgctagtgggaggtcatgtactcaccacaatggagtgatgcctcaatcatgggctgtttaatggcattcagagaattccattactttctaactgtatgtatacattctaactgtatagttagaatacgtcttatggaaatagcccatgttagttaaagcaactgaacagaatttgccgatgtacaaatatcacattgagtctctcaattcttagtgttgagaactatatctgatatttatctcaagtgtcttagtgtgaatagtagatgcttaggtaaaaatacactgaaatgcacgaaaatatgacaaagggaaaaattaggcaacaaagcttttttcttttttaaaaaatgcaatttaaaaaaaaatgttcttaacagatacagtgtttactgcccaagaatggttaaaaacacattttattgttcacagaaattaaaggaatagttttggaaacattattactatgtaattatgagcttttcattaaaaattatttaaagataattgaacaccaagcattactttcgtctcatacagaccaattatttaacaatatgcaatgaatcaaagtattcataggtttcaaatgcatccattttctgctatataagaaaaacattgatctatgaacagttaaataacttagcattataatgaagaaacatctggatatcataaaaccacaagtagtaagtgtaaagaacactactcaacccctacctgtattgtaatgtttagtgcagtatcgtaaatctttttcttctttcaacagaaactggggcaaagtgagtccttctgccacttgtacgggtgcctcatcttgccattcaaaaatgagatcattcattgtgtacccaactaggcaaaacataataaaaatatgaatagtctaaaaagggcattcaaagaaaagaaatgcaaattactttatagtcacataggatgagaagaccaaacagtgtcatcttatagtaactctgtggatggagctattcattgcccaattccgtttcataaatgtctgttgaagtctattcacgtggaactcccaccaaataatatgagaaaacaaaatggactcattaaaagtataccatggcatgtcaaaacttgaaggggcatgcatatacattctttccttgggatgggtagctactagattaattttgtaattttcattttgatttcattccatctggtttctccttactttctttcaaattattcaggactttctcaataaaaactgaaattgtcactcgttagaaaatgactttttttttttttgagacggagtctcactctgtcacccaggctggagtgcagtggtgtgatctcagctcaccgcaacctcagcctcctgggttcaagtgattcttgtgcctcagcctcccgagtagctgggactacaggcacatgccaccatgccctgctaatttttgtatttttagtagagacggggttttaccatattggccaggctggtctcaaactcctgacctcatgatctgcctgccttggcctcccaaagtgctgggattacaggcgtcagccaccgcgcccagacagaaaaatgacttaaacttagtgtaagaataaatgtcagaaatctcttaattatatacagattgctcaaggatttaggcatgttaattttacttctgctgtgttttgaatctctccagagttgcatgtagatagcatttatttctgtgcacttaaacccatttagaaaatatctacaaagcaaaaatggagaggaaatagaaattgattttttcgtgaagattttgatacacatttcatcatttaatgattcaccaatttcttagattaatttgaattaagtacttaattcaaagagagggtagcattcattattgatatatatgggcttttaaaatttccatcctttataaatagtcaaggtttgggccagacacattatatttttatcatggaaaaatttcaactccttaagccataatgttgaatagaattggagtattttctttagaatttcttgaacaggcaaatgaaagcttattatagaactcatgtattttcttttctctttggaacatctacaccagtatattgctggcagctattgtattttaaaaaaaagtatattttcactaccataaaggattctctttttccccctcatgaaaataaataacaacttggggttaaaaaaaaaagaaaaagaaaatgacttaaactataacatttgtgggggaaaagtactaccacataatgcctccttgatttaatcattaaacatgggacagtttgtggaagtggaaacctttgcacataatatcagggaattcaggatagaattgattaatggattttgtaataggtcagcagcctttagtaaactaaaatttcatatttctatatgggaggtatctaagaactgcagatttttatcttctccttccctctgagtgagaagctattgaaatgtatgtttaaagactactgcacaaaatgagtcaaaagtgaatgagacctgtgaggcagaattgttgttactttgatcaatgagtttcttgatgcacaattaccatggaggtagagagaggaggcacggtgtggcctctgaaccaagtcaaatggtcggtatgttaaaagcgcttgggcgcagtgtctcacatctgtaataccagcactttggaaggccgaggcgggccgatcagctgaagtcaggagtttgagaccagcctggccaacatggtgaaagcccgtttctactaaaaaacacaaaaattagccgggcgtggtggtgggcacctctaatcccagctacttgggaggctgaggcaggagaatcatttgaacctgggaggcggaggttgtagtgagctgagatcgaccattgcactccagcctgggcaacagagtaagaccctgtctcaaaaaacaaaacaaaacaaagcaaaaaaaacaaaaacagaagctccaggtctgtgaggcagcacagaagggaaatggtcccaaacaaattctcctggaaacaagcttgtattgtagagaagaggctatgtgagtgactggaaacaactggcatggagctggttaagctgaatagaacattgagtagggaaaggaactgatcaccttccaccctccccaatacctgggaaaaactctcccagacacagtgaaatctgctccagctgtggtggtagtgactggagccagatgccctaccacacttgacccctaggtatatctcacaccgtccactctacaggcagtggagatggtagtagcaagagcatcagtaaccagatctctttagactgtatgggattctgcttctgaagttttcagcagaagtatcatcagtgtgacggctcattatggagcaagtgctattcggtagagtttgtgaaagtcattgagattgaaggaagcacgcatctacatctgaattttgactccagaacagatgtgggaacctgaaggactgtcccctaggctgatggatttaacacagcagggacttaatacctgcttatactagaatacatttcattgacccctgcaattaataatgatttgattggtaataatagaaagctttcactttcattcataaatcctttaatatgtccattataaataccattttaccgagaaagtagatgcacatttctcaatgatttaaggatagcaaaataggcaccaattctaccttctgccagataagacatgtttctcattcttccacacctataatcactgaagacaaaatatatgagattgtgtcccaatttagacagatgaatggaaaaatgacctgaaacttcaattcatttttatattctaaatttttctcaagatattctgtgaaatgaaactagctttatgaaattccttcaaagacaagctttatttagtggctaatacaatttatagacagtatatgtatcttgcttttgtttaaaacagtcatccacattagtttaggtatgtgtatttcatagtcatactattctacttcactatggttcaaaaaatacttaagtttgaaaccagaaggaaaatagtaagaggccatggttgggggcaattcctttatttgagtaacttactggttgttaatgataacaactaagtggtaatattgtcttaataaactctcaaacataattttaaaaaatcaatacttttttacacaattcaaaatgttttaagatccttatgcttttggttggcagatctttatacaagtctgagaatgctaaagagaacagactggttaatgagatcaagcttgtgagctgaattacctgataccacaataagcttcccaatgaaaactaatttattcagggaacagacattaaccctaacttcagtcaacaatctcatatggtagctacaataaaacatgtaaaccaatggctcagggcaaccaaacgcttgttttaccaaatagttacttattgagtaccaactgtaaggaagatgtcctgctaggcttcaggcaatgtgagatattattgccgagtaaagagtaagtggcacgagacaggcagaaactgctgtgtgcatttagcgcggggttctgtgatatctacctaggcctcatttgagctggatcttgaaaacaaggcaggggcttcatataaagtatgcaaaagaaggtgaggcacttcaggctcaagaagcagcaaaatcatttgaaagaaactgcgaactcccaaggtttataatagcaatgggaacagcttcatttgtctagagccagtttgcatgaagaagcatataaagtgtcaaataatgtaagatgatgtaaagttcaaatttccagtttaaaattttgatcattggaatcttttgagcaaggggtgaaccacaaaatttgtgcttgagtagcattactctaccaggatcctttcatggaattcacaaggtcaaaactgctttcataaccataataagacatttgcctttttcattgagtcaacatttgccctgatgttgaaaaaacaatggtgggtaaaacttctagtgctttaacacaaataaaggggctggcaccaaactgtgctaggagttactgtatttttactgccatatcttgcagcaaaaacaatcccatttttatttatgaatgtctttgatccttcatgaaacagtaaatatcttacagtaaaaacaatgccacttttatttcggaatgttcttgatctttgatgaagcattaacaattattaattttagtaaatttggaccctatgtaagtaccttttaatattctgtgtgtcaaaatgggaagtctgcacaaaatactcagctgcaggctgtaatatgattctttcaaggaaaatcactggtgtgtttgagttgcaagctgaactagcttggggttttcgtgaaatactattttttatgtgaaaaaaatgggtggaaactggttactgtgcctaggtatttggcagaccattttctcaaagatgaaggaagtgaacttatctgaacttgtcatgttaagggaacaacagacagtatttgctgtcaatgataaattttgaactttgaagtcaaaattggaattttggagaaattgttgttacaccatgagcttcatagcttcccaatacttaagagattttttgatgggcttgatggtgacatccacaaatgtgatactttgatatgtacgatgaagtgtgtcagctgtttggaagatctaaataactcatcaatctgatattttcaaaatgaccaaaacatgtttaaaaagcatacatgaaagacccattcaaagtgcaaggtagacaagttagttttaatttaaaagagtaggaagagttcattgatatggtttccaattccacattgcaattaatctttaagagactaaaagttttttgccttcagaagaaggcaaaacaaaacaaaacaaaacgaaaaccctctcattcttctgcagtggtccacaaggattataagtcagaggtaacacttcagtagataatttaaccaaaattggcacataattaactatgtgtttacagaaaaaaaaggaaaatttcaaagttttcagtctaagtcactgacaagtagctatgcaacaatatttgcttgtatttcatacctcatgacattacagtagctttctttgaccatctaataaaacacctttcctccagttgctctaccttacctattttctgtttattttttccatagtacttatccttacctgacatcatatatatatatatatatatatatatatatatatatatatatatatatattcatcaggttttgacattatatatattcatcagattttttattttgttttcctactttgtcccctagaatttattctttatagaagcagagacttattctgttttagtcagtggcatattttctattacctaaaatagtatgtggccagcatatagcaggtgcttgaatatttgaattagaaatagagaagggataaaggggaaggaggaagtgtgtgtgtgtgtgtgtgtgtgtgtgtgtgtgtgtgtgacgttattttgggttgccttgaatttgagatggtagcagaagatgcaggtgttgagcctaagaagtctcaacattgacttatatgttgaaggtagttgaaatcatggaactagatattggaaatgagtttaggattggagatttaagttaagaatcactatctacatatactaattaaaattattgattatttgaaaacatcagagagggaatatgtaaatgaagaggaagagctataaagaatcttagagaacgcttaggaagagaaaagtgatgacaggaaagtaataatcaaaacagaaaatccaaagaggtacatttcagctaaatagaaatgagagtatctaatggaattgtctgatcataggattttaaggtgataagtttcccacaagcagaggctgggaaatcatttttcaggtataagagacattcaatgttttagttaaaactaactggtttatttaaagtagatgaactctaaggctttccaactctttggttttataaaacaattaaatatagctttacaaacctgtctaattaaaatgcactataaaataaaacaataagaagcatttggttctgttattgaaataggaagactcatcaaaggaatcaaagataaaatttagaaagaaatctaagtatgtatacacatctaataattgtactatttgcaagtattgcagtaagaatagtggaatatcaaatggaccatagcaatatgaatatctgtgtagcagcaaagtaagatgtagatataatcttgagagatgcggaaaaagcctctgaagcctgacttctttatattttgcataaatttatggagtacaagtataattttgttacatgcatagattgcatagcattgaagtcacggcttttagagtatccattacccaaataatgtacattatatccattaagtaacttctcaacctccccctcttcccaccctgtcagccttctgagtttcctctgtctatcattctacactccgtccatatgttctgcagcactatccaccgtagcaaagatatggattatttatgaatctacaaaatgctctaggctaaccttgaatgtaaacaggctaaatgccccacttaaaaggcacagagtggtaagtcgcattaaaaaaaaaaaaaaaaaaaaaaaaaaaaagcaagacctaatggtatgctgtcttcaagagacctatctcacaagtaataatattcataggctcaaagtaaagggatggagaaaaatttgccaagcaaatgaaaaacagaaaaattcaggagttgcaatcctagtttcagacaaaacagatttcaaaccattgatgtccatcagtggatgactagataaagaaaatgtggaatatatgcacaacggaatactattcagccataaaaagaatgaaactatgtcttttgcatcaacatagatgtaactggcggccattatcctaaataaaacaagtcagatgcagaagacaaataccgcatgttctcacttgtaagtgggaaaaaaataatgtgtacacatggacttagaagttatttaaacactataactttatttgtatatttgttttctgttagaagggcctacttctttattattttcaaaactacctttaccatgcatagacttttatatttcagattaatatccaattgaaaatcatgttagtattttcatttacattgcattgaaattatggctcaattctgagagaataacattttcacaataatgtatttaaataacctcaggaatggacaatttagatgaatggttcaaaacagagtccaaaatcagacctatgtgtggaaatttaaggtaaaaatgacactttttgttgtgtagtttttgtttgttattattgtatttatttattcagttttaaattttaggtttgagggtacatttgaaagtttgttacatacgtaaacacatgtcacagggctttgctgtacatattatttcatcacctaggtattaagtccagtatccaatagttgtcttttctgggcctctcccttctcttcctctcccacctcaagtagatgccagtgtctgttgttcccttctttgtgttcataggttcttatcatttggttcccacttataagtgagaacatgaggtatttgttttttgcttcctgcaattagtttgccaaggataatagcctccagctccatcaatgttcccacaaaatacatgaccttgttcttttttatggctgcatagtattcccttttctatatgtaccacattttctttatccctttatccagcttgtcatggatgggtatttaggttgatttcaagtctttgcaattgtgaatagtgctgctgtaaacattcgtgtgcatgtgtctttatggtacagtgatttatattcttctgggtatatatccagtaatagaattgctgggttgaatggtagttctgcttttagctccttcaggaatggccatactgctttccacaatggttgaacttatttacactctcactaacagtgaataagtgttcttttatctctgcaacctcagcagcatctgtcatttttttgactttttagtaatagccattttgactttttagtaatagccattttgactagtgtaagatggtatctcattgtggttttgacttggatttctctaatggtcagtgatgttgaactttttttcataagaaaaaatgtgctggccacttgtcttcttttgaaaagtgtctgtttgtcccctctcccctctcccctctctctccccacggtctccctctccctctctttccacggtctccctctgatgcccagccaaagctggactgtactgctgccatctcggctcactgcaacctccctgcctgattctcctgcctcagcctgccgagtgcctgcgattgcaggcgcgcgcgccgccacgcctgactggttttcgtatttttttggtggagacggggtttcgctgtgttggctgggctggtctccagctcgtaaccgcgagtgatccgccagcctcggcctcccgaggtgccgggattgcagacggagtctggttcactcagtgctcaatggtgcccaggctggagtgcagtggcgtgatctcggctcgctacaacctccacctcccagctgcctgccttggcctcccaaagtgccaagattgcagcctctgcccggccgccaccccatctgggaagtgaggagcgtctctgcctggccgcccatcgtctgggatgtgaggagcccctctgcctggctgcccagtctggaaagtgaggagcttctctgcccggccgccatcccatctaggaagtgaggagtgtctctgcccggccgcccatcgtctgagataaggggagcgcctctgccccgccgccccgtctgggatgtgaggagcgcctctacccggccaccaccccgtctgggaggtgaggagcgtctctgctgggccgccctgtctgagaagtgaggagaccctccgcctggcaactgccccgtctgagaagtgaggagcccctccgcccagcagccaccctgtctgggaagtgaggagcgtctccacccagcagccaccccgtccgggagggaggtgggggtcagcccccgccaggccagccgccccatccgcgagggaggtgggggggtcagcaccccacccggccagccgccccgtctgggagggaggtgggggggtcagccccccgctcggccagccgccacgtccgggagatgaggggcgcctctgcctggccgcccctactgggaagtgaggagcccctcttcccggccaccaccccatctgggaggtgtacccaacagctcactgagaacgggccatgatgacaatggcggttttgtggaatagaaaggggggaaaggtggggaaaagattgagaaatcggatggttgccgtgtctgtgtagaaagaggtagacatgggagacctttcattttgttctgtactaagaaaaattcttctgccttgtgatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcagaaggccgcggggtcctctgcctaggaaaaccagagacctttgttcacttgtttatctgctgaccttccctccactattgtcctgtgaccctgccaaattcccctctgcgagaaacacccaaaaatgatcaataaaaaaaaaataaaaaaaaaaaaagaaaagtgtctgtttatgtcatttgcccacttcttaatggggttgtgtgttctcttattgtaaatttgttcaaattctttatagatgttgggttttagcctttgtcagatgcatagttttcaaatattttctcccattctgtgggttgtctgtttacactgttgatagtctcttttactgtgcagaaactcttaaatataattagatcccacttgttgatttttgtttttgttgcaattgcttttggtgtctttatcatgaaatctttgtccatttttatgtccaggattgtatttcttaagttatcttctagagtttttacagtattgggatttacctttaaatatttaatccatcttgagttgatttttgtatatggtgtaaggaaggggtccagcttcaatcttttgcatatcactagccagttatcccagcaccatttattgaatagggaatctcttccccattgattttttttgtcagctttttcaaagatcagatggttgtagatgtttcatcttctttctgggctctctattctgttcagttggtctatatgtctgtttttgtaccagtaccctgctcttttggttactctagccttgtagtatagtttaaagttgggtagcatgatgcctctatattttgcttaggattgccttggctattcaggctcctccttggttccatatgaattttaaaatagtttttttctagttctgtgaagaatgtcattgttaattttatagaaatagcatttaatctgtaaatcgctttgggctaaccttaaatgtaaatgggataaatgccccacttaaaaggcacagagtggcaagctggatttaaaaaaaagacctaatagtatactgtcctcaagagaccaatctcacaggtaatgacacccactgctcaaagtacagatatggaggaaaatctaccaagcaaacggaaaacagaaaaagcaagggttgcaatcctggttttagaccaaacagatttaaaaccaaaaaagataaaacatgacaaagaagggcattacataatggtaacgggttcaattcaacaagaagacctaactgtcctaaatatatatgcacctaccacagggggcattgagattcataaagcaagttcttagagacctacaaagagaaacagactcccacacaataatagcgcgagacttaaacactccactgacagtattagtcagatcatcaagtcagaaaagtaaaaaacatattcagaatgtaaactcgacattggaccaaaaggatctgatagacctttacagcactttccacccaaaaccaacagaatatactttcttctcttcactacaaggcacataccctaaaattgaccatgtaagtggacaaaaaacaatcatcaacaaatttaaaactaatgaaatcataccaaacacactcttgaaccacagtgcaatcaaaacagaagtccgcactatgaaaattactcaaaagcatgcaaacacatgacagttaaacaacatgctcctgaacaactttggggtaaataataaaattaaggcagaaataaagttatttgaaaacaatgagaacaaagatacaacataccagaatctctgggacacagctaaggcagtgttaagaaggacattgatagcagtaaatgtccacatcaaaaagttggaaagatctcaaattaacagcttaacttcacaactgaaagaattagagaagcaaaaacaaatcaaccccaaagctagcagaagacaagaaataacaaaaatcagagtggcacagaaggaaatcaagccacaaaaaagccattcgaaagccaggagttgtttttttgaaaacattaataaaacataggccactagctagactaataaagcagaaaagagagaacgtccagataaatataattagaaatgatgaagagaatgttactactgactccacagaaatgaaaacaaccatcagagactaccatgaacacctctatgcacacaaactagaaaacctagaaggggtgcttaaattcctggacacatacagtttcccaagaataagccaagaagaaattgatttcctaaacagatcaataacaacctccaaaattgaatcagtaataaatagcctaccaaccaaaaaaaatgcctgggagctgaaagattcacagaatggtagttctgaattttaccagatttgtacaaagaagagctggtaccatttttacagaagctattccgaaaaattgaggaggagggactcctcctcaacttattatatgaggccagaatcatcttgatactaaaacctggcaaagacgcaacaaaaaaagaaaacttcaggccaatatccttgaagaacatcggtgcaaaaattctctacaaaataatttcaaactgaaaccagcagcacatcaaaagctaatccaccatgatcaagtaggcttcattcccaggatgcaagattggttcaacatatgcaaatcgataaatgtgattcatcatgtaaacagaacaaaagacaaaaatcacatgattatctcaatagactcagagaaagcttttgataaaattcaacaccctttcatgttaaaaactctcaataaactaggtattgaaggaaaatacctcaaagtaataggacccatctctgacaaacctgcagccaacattatactgaatggtcaaaagctggaagcattccccttgaaaactggcacaagacgagaatgtcctctctcaccacttttattcaacatagtattgaaagtactaggcagagctatcaggcaagacaaagaaataaaggatatccaaataggaagaggggatgtcaaactacctctgtttgtagatgacattattttatgtctagaaaaccccatagtcttggctcaaaagttcctccagctgataaacaacttcagcaaagtttcaggatacaaaatcaatgtacaaaaatcactatcattcctatacaccaacaacagccacactgagagccaaatcagaaaggcaattcaatttacaattggcacaaaataataaaataataaaatacctaggaataaccagggagatgaaagaaagatctctacaatgacaattacaaaacactccttaaaaaaattagagaagacacaaacaaatggaaaaatatcccatgctaatggataggaagaatcaatatcattaaaaaaatgatgctttaaattaatgtggcaaaattttaataaatgatgatgagaaaaaattctatccacttagaaaaaggagtgacgcaaaaagaaaatctaattgtatttaaaatataaacataatttgtgctatacaagttctggattaaagtaaatgataatattttgtaatattggcatgtataaagcataatttttaaagaaaaacaaattttattatatgtatatttaaaactttactatgaaagatattgtaaagttgaaacgtgaataacatatggaaaacaacatatgtaacaaatataatacaatacaatataatttaatataatataataatattataaaaatgaaaagataattctatattaaaggtttaaacaggcaacttacagaagaaacagcaatggttactaagtatgcaggaagaaaagctcaaactaaaggaaatgaaaatacaacaaaatacaaatttatatccatgagattagataaaaaaccttaaatctgacattaagtggcaatgttaatatgagcttggtacaaaaatgtttttaaatttactgtatttttgtttgaaatatcttttggatttataatcattcatatagtataggtacatacacatatgtattcatagaaacaaacacaaatgcatatgtatgacagagagagagagggagagaaagtaaggaagagaaagtaaaagggaactggtaatgaggcaaacaaagtagctaaggctagaaaggaggattatgagtagaggctactaatgcattcatttttgtttgtttctcagtttctattcaaatttcctagcacaaacataccagttttgaagaatacattcaaatttattacattatcactttttaaaaatcataaaatctttggtggtttaaaaatagcttaaaagactacacatgagaaaagaggttatataaaactttacacaacgggtaaatatataaaagaagcacttattcaaagggagaatgtgggctgtgaatacacttaagttgaaaacgagtttaaagatttactaataaattatagattcacattttgttttaaaagtaaaccagaatcatatttggtccagctatctcaaaagttaggcagggttagggtggagacagagagagatttctagtttgacccagtttgcaaatgcttatgttcttaattagcagctggaattcaaaaagcagaaggaagaaaatgctcactcttggcacatgctgactattgctaggagaaatattgctcaagtaaatttcattgacctgacaaggaacaactgctatgtcaaaacgcatttaactaaaacatttttatttataatttgtgcatttcatttgaatactcttaccataaatcaggccattacatgtggtttcatttaaattattggtctggtaaattaagcatcttcttagcaattacattttctctaaaacttctggtatagctgacctatcaccattatcttatgagacattttaacgtatatcacagacttaaagtttccccctttctcttgggaaaagtgtggatatataatttgtgacccctaactgctcttcttaaatgacaaacacaacaataactttgttcatatttctcaaaacttcacaaaattgccacactttgaacacacaaagtttaaagtttttgtgagaaatttcagtgaaaatcagaaaatgacctgaccctgagcccattttaatgaggaaaggcatcgtggttggttggatttcactgtaggagaggttataagagggtcttgcccgactacctttttggaataaacttcaggttgtgagaaaacattctgtgtctgcctcccaggatgttggaggttcagatctgctcaaatttgtgaaataatcaattcactaaataggccccaaatcataaccgacactgtgagccaaaccactttagcaatatctgaaagttgtgtaatgttttgaatagagaatagtaaggcaataatgctttgactggtcttgggtttttttatttttgatatatttatatattttttagagatagggtctcactctgttgcccaggctggagtgcagtgaagcaatcacagctcactgtagcatcaaactccgggacaaaagtgatcctcccaagtagctgggactacaggcaggtgtcaccatgcccagctacttttttgggtttttaatttttttgtagagatgggggtcttcttatgttccccagggtgatctcaaactcctgggctcaagaaatcctcccacttcagcctcccaaattgttgggattacaagtgtgagccaccatgctgtgcctgatcttgggatttttgaagcctgatttttcagtaccactatttatttgtaagaaccaaaacctatacaaaaccaaaaccaaaacaagggaagaaagttctgcataatattagcaagatgatccacttcaaattcatattgctggaagcatttgaagagtattattatgaaaaagtctttgtaatactataaaattaaaattttaacatgattggatagcttaaacatcagagaataaaattatatattttgtgtgcaacttctccttaaggtgagataaaaaatgtctattattgcaatatatttattgaagtacttgagagaggtaattagcatggtatggacagatttcaaacactaaaattcgcatttaatacacagtataataaaaactgatgcaagctattctggacagagacccagacattactgtaaatcatttattattatataatttgccatatatataaagccacattgttcctctcaggtctcagaagcttataattactttttttttttttttggagacggggtcttgctttgttgcccgggctggagtgcagtggtgtgatctcagcttactgcaacctccacttcccaggttcaagtgattctcctgtctcggccacctgagcaactgggactacaggcgtatgtcaccacgcctggctaattttttttgtattttttagtagagacagggtttcaccatattggtcaggctggtctcgaactcctgaccttaggtcatcaacccgtctcagcctcccaaagtgctgggattacaagcatgagccaccatgtctggccataattactttttaaacttactttttaaaatttaaacagaaaataatactgccagacaaggcaaaagatagctgatgttttacatgcaatcaaagcctacaatatcaagtatacctacaatgaaaatgacattggcacagaaagatgttcaagtaattggaagtgagcaactccacagtattctgttgcaccttaaaaatataattatatagcaaaatcatagctgtgtaatagaattatgcaggaaagcactaattcctaatatattgttatgaggactactgtaataataaaattctatctaagttagtatgttttcaaatgtggtatatcttttggatggaaggatcacttaagaagtatttaaggcatattagttgaagttctgcaggtcttaagttgctcatcacaaaggaaccagaacttcaaatttgtactgtttaaattatccttattttagagaattaatatttgttaaatatttaacattatttgttaattatttaattaataattaataatttatttgttaattattaattaataattaatgcattaattatttaattaatacttaatttgttaattatttaattaataatttgttaaacttaacaaaattatttgttaaatgattcaattgtgttgtaatccacactcccaggatatgttttctgtgtcctaatttataaattgttaagtatatgctgatttctatcataaaaatgaaaaactaactcaaggtacagagtttgtatagcccaaggatatattaaggctattttctaatggagatgacagaaacagtgattgtaattaggtagaagatgaagttttaatcacaaatgagcaagttaactatagccagagaaattttcaccattttctgtgtctttactgcaggcatagcttgttttattgagcttttctttattgtgctttgtagatattgaatattttacaaattgaagatttgtggcaaccctatattaagcaagtctatcagctccatttttccagcaacctgtcatcacctcatgtctctgtgtcatatttcagtacttgtcataatatttcaaactttgtcattattacgatatctgtaataataatctgtggtcagtgatatttgatgttaccattataattgtttttgggtgctacaaactacctccctatatgatggcaaattattagccaattaataactacgaagacctttaagtagtcgctgaaaggaaaagcaacacatctctcactttaaatcaaaagctagaaatggttaagcttagtgaggaaggtatgttggaagcttagataggatgaaagctaggcgtctggcacctaagagttaaccaagttatgatggtaaaggaaaagttattgaaggaaattaacagtgctactgcactgaacacatggacaataagaaagcaaaacaaccttattgaagatatggagaaagtttgagtggtctgcatagatcaaaccagcaacaacatttccttaagcctaaaccaaatctacagcaagatcctaactcatccatattatgaaatctgagagaggtgaagaagctgcagaattaaaattggaagctagcagaggttagtttatgaggattaagcaaagaagccctctccacataaaagtgcaaggtgaagcagaaagtgctgatgtagaagctgcagcaagatatccagaagacctagctaagataattgatgaaggtggacacattaaacaacagattttcaatgtagatgaaacaatcttctattggaaaaagatgccatctgggactttcatagctagagaggagaagtcaatgcctggcttcaaagcttcaaagaacaggctgactctcttcctaggggctaatgaagctgatgactctaagttgaagccagtactcattcaccgctcaaagatcctagggcccttaacaattattatgctaaatctactctgcctgttgtctataaatggaacaagcctggatgacagcccacctgtttaccgcatagttaactgaatactttaagcccacagttgagacctattgctcagaataaaagattcctttcaaaatatcactgctgatgccaattaacccagtcaaccaagagctctgatggagatgtacagggagattgttgttttcaagccttctaacatagcatccattctgtggcccctagatcaaggagtaattttgacttttagtcttataacttaagaaaaacattttgtccattctgtaaggctatagctgccatagatagtgattcctcttatggatctgggcaaagtaaactgaaaacctacatgtaacaattcactattctataatgacgccactaaaaacattcatgattcggggaggaagttgtaatatcaacattaacaggaatttggaagaagttgatttcaaccctcatggatgactctgaggggtttaagacttcagtggaggaagtaattgcagatgtggcagaaacagcaagagaactaaaattagaagaggagcctcaagatgtcaccaaattgctacaatctcatgatcaaacttgaacagataaggagttgcttcttaagcatgagcaaagaaagtggtttcttgagatgaaatctactggtgaagacaccgtgaacattgttgaaatgacaacaaaggatttagaatattacatgcacttagttgataaagcggtggcagagtttcagaggattgattccaattaggaaagttctactgttggtaaaatgctatcaaacagaatcacatactacagacaaatgtttaatgaaaggaagagtcactcaatgaagcaaactacattcttgtctaattttaagtaatttccacagccatgccaaccttcagcaaccagcatcccatcaatcagcaaccatcaacactgaggcaagaccctccaccaggaaaatgattatgactcactgaaggctcagattatcagcatttttagcaataaagtatttaaaaattaagatatgtacattatttttagacataaaatgctattgcacacttataggctacagtacagtataaatataacttttatatacactgggaaaccaaaaaattaatgtaactgctttactgtcatagtctggaactgaaccagcaatagctctaaggtatccctatattcaaatatattccctcagttttaaaacagctgtgttgggaaaatttgtgatactattggtgagttagaaaaaaaaaatcaccattcctagaaatatttttattttttgagacagagtcttgctctgttgcccaggctggggtgcagtgccgtgatcatagctcactgcaaccttgaagtcctgggctcaagtggtcctttcacctcagcctcctgaatagctaggactgcaggcatgcatcatcacacctggataattttttaattttttgtagatacatggtctcactatgtttcccagactagtctcaaactcctggcctcaagtgagcctcatgcttctttagaaaatattttaaattctattgatggtatatttgaatcatattcatatataaaggacatactatagtgaaccctcacatttaatgagttacacattataattacaatttctaatcaacagttctttagcaggcctggtgactggaagtggtatgaatctcccttactcacgcccagtgctaacacttgggcaaggttttgctttttgcaaatctgcatgtagattttcctgatagcagaactcagagaaatcaacaaattgccaggaactggggactataagtgggctatgttgtgaagaaacaggctacttggaacttctgagagctcagaaatttgatttggcattcttcaaatgccttagaaacttcaaatcctctggattgagagtggaacatttgtcatacaaacaatgaagaatccactggtgaggatctatgaacttggctgccctagaggtaaaagtataaaggaagcagtggagccattgccttcatgattcacagctcctgggctttgatctcagtatggtatcaaaacactcctaaagtccacctcactcatttattaatgtaaatgcttgaatcacactctgtgtaccttttcaaaaaatagattattttctctaaatttttattgacaaactattatttattatttccattttcctgttttctagtttggctggcttccctcttgatcctcactacatataattcacactgtttttgtttacttattaggttttgttttcctcttgatcctttttacagatattccatggttttccaatgctatgttcctaattcacagatttgtggtcttctatgtttaaagaatttatggaatcctagagttgagatgacttttgctgtcatctaatgccgctcacttatcttataaaatagaaaactgagcctctgaaaatgagcggatttatataacttatatagtttctcagtgaaagactgaagggtatgttttctgaattcctccttttatgcaggtagcagccaatgcactgcataatttaagggattgttgagattgaacaccagggtcctgtttggggatatgctaccaaagttttgaaaaagcattatctggaaaggccatttgatttaggggaattgaagggatatgagggttgaaggaacagattattttgagaattaattaaggatgaaagaggctgggcacggtggcacaggcatgtaatcccattttttgggggtgctgaggtggttggatcacttgagatcaagtgttcgagaccaacctgggcaacatggcaaaaccccatctctatcaaaaatacaaaaattagccagatgtagtggtgtatgtctgtagtcccagctacttgggaagctgaggtgggaggatcgcttgagcctggaggtggaggttgcagtgagctgaggtcacaccactgcactccagcgcgggcaacagagtcagaccctatatacaaaaaatggtgacagctctgagtagtaaagaatagcagcaaatggcaggatcacagaaataaaatgctttaaattacaggtgatctagggtgttctaaaaagtctactgattctcacacaaagaagatggctactatctgaatcacacatcctaacaagtgttggcaagggtgtaaagaaattggaactctagtgtactgctggtggagtataagatggtgcagctgctataaaaaatatggctgctttttaaataattaaaaatgaatgaccatattatctagcaattttacctctggatatatgtccaaaagaattcaaagcagggtctcaaaaaggtatttgacattcgtgttcatagcagcattactcactatagccaaaatatgaaagtaacccatttccatcaatggatgaatggagaaataaaatattatatacatacaatggaacattattcaaacttaaaaaggaagaaaatcctgacatatactataacatagataaactttgagaactttgttaagtgaaataagccagtcacacaaagacaaatactgtatgaatctacttatatatgaatttagagtagctaaactcatataagcaaaatgtggaatggtggttctcagtggcaagaggaagggggaaatggagagttgtttaatgaatgtagagttcagttttgcaagatgaaatagtttgggagattgcttgtacaacattgtgaagataccaaatactactgaaccgaatgcttgaaaatggttaagatggtacattttgtttgtatattgttatactttgaatgtttgtcccttcataactcatgtttaaattcggttgcaattgtagcagagttaagaggcgagacctttaacaggagattgggtcatgaggtctctaccctcataggtggaattactgccattataaaagggtggtttcagcccctttttgtgccgggcccttctgtcttctgtggggtgatgcaatgaaaacgccctagcagatgctggcagcttcattttggattttccagcctccagaactgtgagccaatacatttctatccattaaaaatgacctaatctgtggtattgtgtcatagcagcacaatacagactaagacatggattttaccacaattaaaaaataaaagaagaaaagactgatgaatttctgggggaggaaataaaagagggatgcacagtgtgcagaagaccttgtggtatcatgacatgagttgaaagtagaacctgggtaaatacaatgaattagcctccaatagtcttttcagttatgtaagagaagaggggagtcattccggacaaccaacttgatgttttctttaatggatctttgggtgaaatatggctacaagtgggctatattaactgcactgtaaaaaatatgaccaaattattgactgtcgttaagagaaacaaagagatcactgtcttaatttttgctagaatttctagtgataacaagtgagaaatgagagacattttccccgtctacatggaacttgcatgtagtggggtgggggtggggagggcaatacaaacgttatcagaaataaaataatcatttcagatggtgatatgtattttgaaataaatttataatttaatgggataggaagcaactggggagaagagagctaacttaagaaaagattatcacactttgggaggccaaggtgggtggatcacaaggtcaggaatccagaccatcctgtgtaacatggtgaaaccccgtctctactaaaaaatacaaaaaattagccgggcgtggtggcgggcacctgtagtcccagctactcgggaggctgagacaggagaatggcgtgaacccgggaggcagagcttgcagtgagccgagttcacgccactgcactccagcctgggcgaaagggcgagactccgtctcagaaaaaaaaaagaaaaaaaaaatgttcagaaatggcctggcggaatgatccgatgggtcaagctatcgataaatcttcaggaaacacattttaggcagagagaagagcacagttttatctgacataaggattatggtaaccccatcattaataaccacaaaagcacaatgttgaaataaatagataagcatttcatttgacatcaaacatctttgtaacaactgaaaaagtatacaaaagtgaagtaaaggaggtaaatgataagccaaacacaacattgaaaccaaaagtaacaataaatattttcttgatgtattcaggctatacatttaatttcatccatattgaagttgaaaatgcaaacaaaaaagggatcctcgggttctataagaatagaaagaaataggaaccctgcttgagcaggacaagagaaagataaactttttatctgtatcttttctccgaaggaaaataaaattccagagcatgaagatgtttgcagatgagattgctgatgctatatggaatctcaaaggggtgataaagaattttacaaagctgctaagagactaatgttgagaatattttcaagtttattaacaggtagattctgtgaattttaaaggagcgtaacaccaaatccatacaattccagaatagttaagattatatctgtgaacaggtagagcaggaagctgtggtcagtaggagccagaattagggtcataaaggaaaagccatgctacattgatatcatattataatcttattaccaactatgctagaatattaagggatactatagtgttctcagcaagatatctgatgaattctaatgttattcttataagcaaggatttcaaaattttgaaatggatatccatttaagtaatttatagctgattgaaaaagcaattgttgatttttttcagtagtaataaatcaagacaaatacctgtagtgcactgttgcaaggttttcagtcctgtccttctgggagtgtataatgatatattgttcaattctctggatgattaaccagcagagacatggatcatcaaagtagaattatggactaaaactagtaagatgatctttaactagaaaaaaggtaaagtactttgtatttattccagtgaaccaatttagtaaacatggatgggggacatagaacttagttgtagtactcagatgactgtagatgtgttctgagtcaagactgttttgcagctatctctaatgtatgtgtcatctgaaactgcaatagtaacagaatgattggcactgtcacgggggggaagccctactctgcagtctcggtttaggccaattttaatacatggaaagacgtctaggggaagggaaataggcaaaggagggaactctaagtcttttcatatgagaaaacgaatgaaattactgggtgtgtttaacttgcagagataatttaaggataccacaattacaatttataaatatttggaaatcatcacatagattttaaaatgaccaatggttgtatgaaaagtttgtgagctattaaatcatatcgttttctctgtccacttcacagttgtgtgaccttgggaaagtcacttcacttctcgaagcataatttgaccatatgactgactgtagtcaatatgcttagaatacctgatgatcagtaaaaattcaacctagaaagatgtggacagactagaagagaatggccattggtgttgcataggatggaatacttaatgtttaagtggagatttattttataagtagcgagttcattactgtatagttttgtcttgggaggacttctgttttctagctaacactgtaactgcagaggtttaagcaacaaatactcagcaaacaagaaccatctgtatttctcactaggcaaacaaaaaacataatattattttgaacagtatccaaacttttaaattatgaaagagcttggataagagtagagactattataaaataattgcaaaaaatcatcaccaaatcttatcttttgccttagctaatttagcataaattccagagtaagcggtctgagtaatgtcaaacctggtttttaaatgaatctgagaaattaaatcataaaatcctctcatctctctttagaaatttctatcccaaaaccccattaaagtgtattctatctttatatatttctatccaacaatactactaaagtatatatcaagtttcttaaagcttttgttaattttttttttcaagttggcccttaacaattaccctgtaattttcgagatttaggctgttctttttggcagacaatacttcttcactgagtcattttcttatattgtcttttcaaatctaaataatattttaacttttactctttttttttttttttgagatggagtttcgctcttgttgcccgggctgcagtgcaatacattcctctttagatatgaactacagaattagaccctttatggaagtagtaatagtttatgcaccatgtgtcatcaatgcctgttaactattattctgattctaagaaattattatccaatgtttttccatgattaaaaaaatccttcctggcttttttttttcaactagcaaattaaaaaaaaaaacagttaggaattttccttttaatgtaaataaaaaactgaaaattcagttttgagtttttttcctgcctctagccctgtacatcaacttccatcaagcattccttaggggcatagtctagatcttaatataggtagttgtacctctttctcttctatatcattctatattagttatttcttttgcgtcaaataaaataattataattgcatttatgtaaaaatgtatttataaattgtgatataaatgaaaacgtatccgttgaaaattacctcatgttgctagcgcttcaaacagctttaaaaaattcaggtaatggcatctgataagtaatcagtaaactaatgcaatctaatcctgagaaggaaggccagtgatcactttagtagtttgtcttcactaggaactttcctcagtttcatttattacaatcaagaactgcacataaaaattggggctcaaatttaaaacagttagtgaaaaacaagtcttcattgcagaattctctgtgtggtatgtatggtttgatatttttattgttactttcttaggtttctcctaataaaatatgaattttgagaataaagtgtgaattttggatatgcatattgtcatgggaactggcctgtgtcttcttaccgactttgagagtgaaaaatgagtattaaaaagagagaaaataaatgaaagcaacacgttttcttcatacctaaaagcaaacatttatagtatttatcccagaatgaagttgaattaagtatgttctagatcagaggaataaacagtatgttgaacttctggcttttatacaagcagttacatgaaactctgttgagatttgaggaataagcacattcccagagaggcctttataatttgataagggaaacatccgaacttggaacatataaacggggccacattttttcctttgacttcagtggaattctcagtgatgagttagcattctaaattactgtaacagtaaagattcaactttagtgcagttattttattttgatttttaaatggcagcagagtgaaacactatgataaataccacttgtgttgcagctaatacatttttatacctaaatattgaagaaaacataatgttgattttcttttttttttttttacctttaatgagtctaccctccatgaataaactagattaatcatattttccaaatagcctctaggaaacatattgttaaaatatcacaaagagttccttattgtctttctctgtttcacttcttccagtttttctaaaacttgatgatgctgtctttctctggctctcttttggtggtcgttttctatgctatctccagaaatttcattgattttcatgtctgcatgcttatccatgtctcaataagcagtacttctaaggttgtgtctctatatttgtacaaacattcctaattcaagctctatcctaaaatttcccataactcaaagtaaatttttagttgaacaaaaattttcacaaaaaacacagcacagttaagcagacatcagctctgatctactttttccatgaatcaccttcttttttcagattaatgtaaacaaagctaaatatccagttctcccgattgagaggaaacttgaggaaatcatctttatgcataattcttctttttatatagcaaatatttgaacaggttttcaaaatgtttgttgttgttcctatcattattgtctccgctcttggaaattctcattaatttataacaaagttagctctttacgcggacgtttttcccccagtcttccttcttgttttcaaataaaggttttggctgagtttcctttccataactatgactgaaaaagatagaattgctcaggattttctttcattgcttttaagctggcatactacgattatttctatttcttcattctgtatttttgatattcaatcaacctaatttttttttctttaaataatttctccagggatgtgtctaggttctgagatttttcaaagcaccaggtttaggggtttttgtgattctttggacactctattgtgtctttttggtctttttgaatagaatgcttagtgaaatcatttttattaaaaaaacctggcttatttgtatctagaaattttgatatattgtgctttcattgtaacttaacatcaagtttttcttaattttcactttaatcaaatagtcatttagtatttgtttttcattccagttatacaagtgtatattaatatataataatgtatgggaatttgtagcaacttacagtaattctatattgttattggtttctaattttattgcattttagttagaaatcacattttataacatgttgattcataagaggttactgaaacttccttggtggtgtataacataaataaatgtttccatatgctgaaaacaaaatttaacaaagaataaaaattctctctctctatgatttgttttgttcaaatatactgtgcttgtacaatccagtaaattgttgatttatctgttttttatgcagttcatcctgcttttgcttattatatttagaagttatatggttacatacttagattttcctaattatatatatatatatattttttttttttttagagagagtctcactctgtcgcccatgctgagtgcagtggcaccatcttggctcactgcaacccccacctcccgggttcaagcgattctccagcctcagccacccgagcagctgggactacaggcaagtgccaccacgcctggctaatttttgtatttttagtagagatggggtttcactatattggctaggctggtctcaaacacctgacctcaagtgatccacctgcctcagcctcctaaaatgctgggattaaaggcgtgagccacggcatattgattttttaccagcatgccactcaagtgtttgtgcctcataatttttttctgccattaatttttttctggttaaaattattctggactttttcaaggtacatttctcagatatacattttttcatttttctttaccaaatttttttgtgtggtattcttagaaagtgtctagttgtcaacatattgttgggtcttaatatttgttaacatctagtttgagaatctctttttttctacatgaatttaacccttttattctatttttattctttgatattatccttaactcatactttttttttctcatcaatttctaatgcaagtcttctcttaccctggattttccttgcataagcctcttccccaataatttcttttcctctaactaggaattttgtatcatccatggtttcaattataagtcataaatgtacacttttgagggcataggatcattgatagtttagacaaagtagtcttttctaagttagttattcattgttaattttgttcttctcttattcactttctcctttgttttaacagtataccattaagatttgcttatcatctttaattgaattattatattggcataaatataatttttatcattatatttcaggtagcctctgaaattcttgaaacagagacttttttgctttatttattgttataccacccaacataatatgtggaatatattaggtatttgataaatatttttcaattgatgcctaaatgaaagaatatttctcaggccacttggaacagttttgaccattgacatatatttattgaacttttactgaatttaaggaagttgtaccattgcaagccattaaagtgtttgcttttaaattatgtttcctttttgcctacttcccacgtcttaatattattgaacattttcttttcttcctttctgcagtcagatttcattcaaaagtggaccctgggattctgacagctcttgctttccagtaggttaaactctttttgcctactttccagtgggttccaccgatttacaatcttttatcttgtcattttaaaccactatttaaggagaaaagaaaaaaatagatacaaattgttcttaaaacatgcatatatacacacatatatatgtagatttgtatgtatgagtatatatatacacacacatatatgcatatatatacacacatatgtatatatacacagaaatgtaggcatttcttaatatatgtatatattatatagtatattacatgtgagtgtgtgtatgtatatgtaattgtcctaaaaaagttttaagaaaaaaacgccttgaagaacttgacttcagaagcttctactttgactgacattagcatctgccacagaggtttaataaacaaagtctctatggttagctaaattaaaattaattcctaataagagagcaggaagtgcttaatgactgaaatattaaagaaccccttgaacaatccactcatatttcttatagaggaattaagaaacaaaggggaaagaaaagaggctctcttttctcatgttgagaaatgttctgagaaaggcagacacatgggaggtcttactatgtcagcttttgtgtcctgcaaaatagccccagtaagctttccttattcaaaacataagcccagtgatctaaccaaccctcaggcactgtactttttctcatctttctttaataactaacattcttggaataaacgatttcacttgctgctcccacttcctcatcactcacctaaaaacaaaaaacctttttagattccagctttgaccatcattattctaatcacatttgtcttcgttaacaataacaattgcttttttcaagtaccttacaaaactttctttgcagcatttgattttgttacacagaactccttcacagtcctttctctttcgaggttgaatcgtgttgattttaatttgccatctttgcctttgtctggaattttttccaacaacttctaaatgtaggcatttcttaagcgtctgttcttgtttgtgttttatttcctctctacattcgcctcttcagctatttcatctgattcttgaaccactctgtatatggcttttaatagttgatcttcacttttcactccctctttggctttagacctaaatttcccagacctcaaacatattaagatggattttatcaattgtcccatcaacatttgcttctcatcccctgttccctttcttcatcaatgcttctaatctgatccgtttatctaagctatttctctctgacacacaggcattcagtgacttcacaaccactgcgaatcagcctctcctgtttctaccttccacataattgctctttgtcctactttctgttctttttctggaaaattatgaaaacttcttaaacaatcttggttcatttaactaaaataatctttaagaggtacagcaaggaccaaacaattttcttgccccttatatgttgaaccattttagggtgccacttagagggtcccgcacattttaaactctttgccctaaatgtacttaatttttcaaccaagatatacaatcagcctgtcctcaaattgcccttcttcaatttcaaaatcaggtctgctgcttctccccatgtagattgattgctaagtagccccccaaattttaatttattttatttcctctcatttacgttagtactttatccatatgtatgctaattatttaagaactacttataaaagtaatcaatttaaattttccaaggaggagttatcagagaaattgatatttccacttcttaagaaaaaccaaacaggagagggaggggtatagtcacgttgccccacaaagttggtctgccatctagtgacagctccatcacactacaagccttgtctttgacacctggagtctgaggctcggccttcaaattttcctcaaggaatgtgtcaaacagtccttttattccccctcggataacatactgtcataaggtaaaatattgcatattgcttaatttttatatgagattaaacactgtaaacaattaatttaggactaattatatagatcagagaaagggtaggatgtgaaatgttcatctgtgttaacgttgatcagtgaggcatatgggtctactttgaaagaagaaatgtagaggaatacctgaaagcttgaataaatctgtgagaaagtgtgagacattttttcttctgagctaacatacataacatacccagcagagtgatattaaaataataaacattgcttatctgaagcagcataggtttggaggcagtttgtcactgtcacctttgtgagttggagccgaatactcaaccattcaacatgaccactttcacatttgaaaacgtagggataacaatatctttgttgtcagtataagaaaaaatatatatagacacttcgttgagaagaggctcccaataaataagtgatagtttgtttttaatgattaccatccttttcacttctgatgatgtgtatggaaacacatatctaaatatcaagctttgaaaatctgttatttttagatcctcaatttgtttctttctcatagtgtggagtgcatgtgttgataggtatcattattttcagtacctggtgaaaggttacatgcctattcagtaaatatgtgaccaaaatgattacaaaataaattatccatattaggcattaaaagcttgtatctactataatgtaaaagtattttaaaaagtaagtggttcatacttacagctttccagttgcattatacatgtttgtacatccatgggaaaattcttgagatccattggacaggaaagtgttaatgttaatctgaaagtcaaagtaattatttttaaaggaaatttatgacattatattaatattctattgtacaggagaaacaatgttgctttgctggtgactaactcagatttaagtaaaaatttctccagcttatgtatcctacttactataaaatagctatgcccttatatacaaatctggctttggtgggctgggggttggataattgcatatcttaggctggtgctaaagtaatcgtgggttttgccattaaaagtgctggcaaaacagcaattacttttgcactaacctaaatataagcatcccgtcatatttatatatctatatgtttatttattcaattagaaagggctgtggatgtctagaaaatgtctgtattccaagacgacatcctcaaaagagaaattcaagagtggatcctataaaattaatgccaaacgtcaaaaggtatctttccttgcaaatcacatgctatattccagaggcattagagttctaaacgtggaaaagcagggtggagaggagcaatcatatgtaacgttcagtcatcattctaacgaccctgatgttgtcagtgaacattcagcagtgtatttagtaaagtgaatctggaggacttgaaaagttcggcctcatgttccccggtgtgggataagggaatcatcagggtcaggaaatagccctctagaatattcatgatctgattctatgctcatcaaacaaacttctgatttggcttcacacaaaggataacctagatgctgtataccagtattccgctcattggaaaggctctcctccaacttccagagagaattagtatgttgacattccagaaaattcatcacctttgaatactttttgctggaaaagcattctacccagatctcttcagggtagtttttctggttcctacacctgaggaagagatggtgagatccactcaagtttattcaaatgaagttcttttctgagaactctttagcaagcctcttgcactgagaatattcccattgaaattcagtgtcttcatgagcaccctaggtggattagtttacttaaacttcgtgaccctaggcagattacttcaaatcccctatattgcagttttctcatctttaaaatgaagataacaatagtacctactccagagagttgctatgagcagtacatgcgttaacacacataagtgcttagacaagtgcttaagccatagcaaacactcaacaaacagtggttgttagtgattattagtatattcagccactcctagactccttcatttactcatctgccaaattctatagtgtgggcacaaagatgactaaattaaattacatattaagaactatttagccaggcgtggtgtcttacgcctgtaattccagcgctttgggaggctaagaagagaggatcgcttgagcccagtagtttgtgatcatcctgggcaacataaaaatactctatctctacaaatatatatatatatatattttaaattagccaggtatggcttgtgcacctgtaatcctggctactcaggaagctgaggtgagagtatggcttgagcccaggaggtcgagactgcagtgagctaggctcacactgctgaactatagcctgggtgacagagcaagatcttgtctcttaaaaaaaaaaaaaagaaaggaaggcatgcaggaaggaagggagggagggagggagagagagagagagaaagagagagaaagaaagaaaaagaaagaaggaaagaaagaagaaacaaagaaacaaagaaaggagggaggaaagaaagaaggaaaggaaggaaggaaaaagaaagaagaaaggaataaaaaagaactatttaagctttaacaaaaaatagtctgcagctctactaaatataaccacattcgtcaagctgacatttttatgtagaccatagacataaagttagaatgatgtatagtctacagagagtatgcttggtgagttaggtccaattaacataatttgggacacataaatggagagacagtgaagctgctgaattttaagagtcttaggaggataatctggtaattcattcgagtcagagtccataacacactagaataattcatggagttcaacattcaaaaggaatttttctcctggctcagctaggttaagtatgattgtgtaattttacaaagttctctcttaaaaaggcaattttaaaattaggtagacacaatgttttttgccttgtgaaagggcttattagaagtgtatgcacacatatattttgaatgtacacacattaattttccaaatatccaaggctctcagacagccagtttcaaatgttgacttgcagaattaattctgtgaccttttgtttggaagtaaatagcattctcagaatcttttccatgctctcaccatgcatgtgatgtcaaattcatatcctggctatttttctggcataaaaaaagagacattacataattctaaaaaaatagcacttgaaaggaattatttggcaaagaaaaacacagtttgtaggacttcggtcataaatcatatcctgaaaaaatctattcatcgacttttctttctttttgtttaaggtacaatacaattgctcctttcacagcatactgaaaaatacgtgtcaacttggtgggtttgatactgaatttctttgtcaaaacactacatataaattaaagacatgtcttgaccacatcaaaagaaaattaaatcaagaggcaattaatcacattctactgttttggaaataaatgtttacttgtgtaagagagacactaagttctctttctgagacaagatacataaacaggatatggcgtttcttcttttcctttaagaagtcttgggaaagacttttaacattagtacttagtgaaacagtaatgtttaaaaagctgataataatttgtgacaaacaattgacctcattaaaattcaattattgaccacttttgtacaagcattgtttcatgtgtctatctcaaccactagttgaattaaaaaatgtttgctgactctattatagactttgtatataaatgagtatttttattagatcctaatatttctctatttggtgtcttaaaaacaatggcttcaattagcaatttaatcagttttaatctatattatctgtaatatcatattagctaacacatctattagacaatgtttactgtgcagtaggcagtattttaaacactttgtgtatgttaactcatttactccgtactacaaatttacaagaataggtaaatgatatcaccctgttttagagatgaggaaacttagaggttaagtaactcacctgacattacacagcaaaaattgctacagctgaatttgcagccctggggttctagttctagatttcgtgctttttttttttttttttttttttgagacggagtctcgctgtcgcccaggctggagtgcagtggcgcaatctcggctcactgcaggctccgccccctggggttcaccccattctcctgcctcagcctcccgagtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctcgtgcttttaacctttaagtatactgcctctcaaaagcattgaagcatttttcatgaaaatgggttctgtaattaatatgacattttaaattatgtatttcttataatacaagaaatgatatattgcatgcacatatcagttatttatagtgaaattatagttatattatagtgaaatttaaagtaaaacatgcataaataatttttataaaaacctacataaataattcttccaaaagaaatcagagaaatgtagttaaactgtagaaaatataaggaatttccccagagatttgatatatttgaatgatttggtatatgattatgaatgattttctaaggggtaaatcactcttaggagagattagattgctggagcactagaagggagattagaatgagcttctgtaacctacttctggagcttaattgtcatctgatcatagagacaatcattaactcagcaacccattaccaaagcaatctcattattgttgatggtttctttatgaagctatggaccgcttaagaaaaacatacacaattaaatgtatgccaaattcttcttacgacatgcattttatagcattgtaaattgattacccttgaataaacagcacttaaaaaagcaactgtcaaaataagtttgctttcttatttaaaaattaatggctatcaatgttaaaaatacatattctcatacaagtaaactttagttattttcacaaatttcacagagtgattatatttagcttaaataaaaattaaaattatatcatgatctttgtcaagttgctatgcatagcatctttaacataaaatttcttcccgtgatctgatttttaatgcaagaatgcctctgtactacgagtagaaaagttgggtttcttagtaatattagtaaagtaagaaagtatatcatatttaactgcctatgatgggattccattattctgtggtaaagatattactatcctctttttacaagtgacaaaactgaggctgagacatcttaataactcaagagtccatgcagtacaggtttatggattctgtaaaaaaacagaacgtatacttttctttaaaggtaaaaataacaactttagtgcctattgtatgtctggcactatgctgggtgctttatttaatgtattttaatacattatttcaggctcaaggtaattagtattgtcactgccatgtatctaagaaaaaatgagccttttagaagtaaagagacttaacccaaatcacagctagtcaatagcagagcctcgatctgggctgggagatatatttctccttgatcctcttgtgctcctatacctcctctagcttgtatgccaagactgcaaagctctaatcattctttcatctgagccattttccagggttgtttatgcagctgataattttgagagatgagaacatctttcaaagagaaggcttgcttacagcttgctataaaagtagtggattcccaaagtcagtggtagagagttaaatgtacatggagtatcatatcagggaaacaaactctagttttcctttataagaattaatagacaatttcaaatattttaaaaatcaagcatgatattacagcaacttaagtatatgaatgtgagtggtagacaaatagctaaacaaaggctacctctctgacaagccagaactgggtgtaaggatgggcagggcaaaagtacaactgttttttatatgttttatagaactgtgtgaactttgtgtgtgtgtgtgtgtgtgtgtgtgtgtgtgtgtttttgagatggagtcttgctctgtcatcagggctggagtgcggtggtgtgatcttggcacactggaacctccacctccctggttcaagagattctcctgcctcagcctcccgagtagctgagattacaggcatgcgccaccacgcctagctaatttttgtatttttagtagagacggggtttcaccgtgttggctaggatggtctccatctcctgacctcatgatcttcccacctcagcttcccaaagtgaaaactgtgtgaacttttaagtgacattcatgaattatataaagatttgtggttaaattaatattcagtgtttacatgttataaatatgtaattcttgctcctgattaagcttggtagtttgttatagcacttgtataactttttgttatatataacatatatatacacacatatatataacatatataacatatataaacaagtaataattatgttacaaatttcataaaattttaaatatatttaagaatgaggcactaaaaactatctggagctcagttagtagcagatggctcattgagtaatggtcttgactgtaggatagtaatatggctgctcagaggttctccaaatgccagaatgtgtagatcttttctcttaggcaaattagttttccagatacatatatatctatatatctaagacagatataaatgccatataactaagaggaaaaaaatatgtgtgtatatatatgtgtgtgtgtgtgtatatatacatatagatgtatatgaaaaaatatgtgtgtgtatatatatgtgtgtgtatatgtgtgtatacatatgtgtgtgtatatgtgtgtgtatatatatatgtgtgtgtatgtgtgtatgtgtatatatgtgtatatatataacaaatagggaaactaacttgcctaagagaaaagatctacagattctggcatttggagaaactctggacagccatattgcctatacctgtatctataaggtataatctatctgtatatctatctatatctatatctatatctgtatctatatgtatcatctgtattcttgtctactgctcagtggaagaagtttaagtctgcctttcagcattttagggccagcaaggggtcctgtcattcttattttgttggtatgatgcctcatgacaggtagcagttgtgcctgaaacccctatgcctaaagcttttgaaagagcctctccagcattttctgtcctcttgcttcctgcttagttcaaaaggtaaaaagggcagtccctaacctgagtgcatgggaaggaaatcaggaatagagggtccacttgtcctacaaagcttaaataaattatactcctcttagatctcttctggcctctactttctgaagtcccaggtgctttacatttctaaaaatttgaaaatattaattattctcttccttttgaattcccctatgttgacgtaggtttccactatctctgtctaagtcagttttcagaagtgcattcatttttaagtttcctaaacatgttatcactcatctgttgctgttttttccccattactttcatcctcctgtgtgttaacgacatttttattctttattccgtttatttcctttttttaatggggtttcagaggaaatacagataaatatgtaagttcaattagtcgtctttgcaaggaccttcttcttctttctttaaaaaagcaggaaagccagatctctcatgaaacataacagatgctccatttgtaaattcaacaagattttttctttttctagcacaatttttgttaacaaagaaactgaagatatgaagcatttgaagatttcaaagtcctgtgagattttcaaaaacaactcagaaaaaattaagttttggattgtgcaagccaggatatagcaaacaaaatctaggagccgagagaccatctgtttcatttgaattcatactgaaagacaaaagatgcatttctaaattatttcatacctttcttcaaaatattagaagaaatgtgagcaattcataatggatgatgtcatttataagagacaaaattccagttttattccaatactttatgacagaaaatacttgagcatttccaggggacatagtagcaagatctcattaattgtatttaaattatttaagtgttcaatataataaatttagtattctttaatataatgcatttgaatgggcacagttaagggttttagtacaactgtcatcttgaaatcttcttaataacaagatctatcctatttgacaaatttttaggatggacggaattaagcgcttttgtctttgatgacatattgttagtaagaagcctctcaaacaaaaagtagtctaggttttatattctattttgttcaatgatcagggaaatactaaaagctcagtagtgtgttctttgtgttgactttctccaactccaataagacttaaaataaacaaatacatgttgataatcatgtaagatatgttacatacaaacacacacaactacaataaataatctagatattctatctttgcaaaatgactattccatgctacctggtgatatatttttgcaacctatgcaaccccaaatctgtctgaagtgaaacagtacttcaaaatataattaaaaataaaatgacaccttttacaaaaataatttttaacttagcaggaaagaatgaaatttattttatttataccctgtcatgggtcccctgataatattcttgagcccacagcacagaggagtgaagaatcatgacctcatgttaagagactttataacttaaaatatatgtgtttaattcataagtgatacataacttgttatgaaaaattcaaacaatataaaattacatatagcaaaatgtacagttcccctttattcctgcccaaattccactattcctattcatttctaaattgtttggggttcgtctaaacttcttctatagacatatatatgtatatttttacatacatagctatgcatatatatatttgtgtgtgtgtgtgtatatatatatgtatatatatatatatgccttaaaaatatacaaaacatttttcttgaactgaaatatatcatgtaggcttacactcaggtctatctcatgcaagttatttcataatatggggttattactgtgttcagtcatgttcttattagtgaacatatataggcccttttttgttgctatttcagtgtttcagtgggtctctttgtaaaagatatcttatgtacacatacatatgtaatttagattcctagaaatagaaatgctgaattgaaggataaatgagtttcatatttttatatatcttgacaaatcctcttcccagttaacatcaagtcatgtgaccacagaagggctattagacagctcgaaatcttaccggtctcattaacttctgtcaatgcatttataaaaaaagttatctcatttgtttctttcattttccccttacatctgtcttataatttttgcttgaactgtcaaatataatttaggaaactcaaaatgagaaggaaagtctattgtattcactcatatttttgcttcctgtgtccttttttccttcttgatattcgtatgcttcttcttttatcattttcttttttttagaaagcttctttgaccatactttccaggcagatttacttgtgattaattctctattttcctttatccaagaatgttttgatttcccctttattcccgaaggatatattccctgggtacaagattctcagatgagagttccttcctttcagcacctaaaaaaatatttgtagcttctttctggcttcagtgacgtctagaaaaatctactctcattctcattgtttttcctgcataagatatcactattttctggatgctttcaggatttgtatttagttttcagaagtttatgcattatgtgtcttcatatggacatctttggatttatcttgtttgggaactcaacttcttgaatctgcaggctcacgccatttgcaaaatgtattaacatttcagccattgttttctctagttttttttagcttcataccctttccccctctatctgacactctgatgacatgaatgttagatcatttgttgtaatctcacagatccctgaggctgtttcccaggccccacggccaatctattcatctctgttgctcagattgggtaatttttgttattctgttttatggttcactgattctcttttccatcttctccattttttttggtccacccatacactgagctttcattttgattattgtatttttaggtctaaaattttgatttggtttcactttgtagcttctatttctttgctgaggctatttttctcatttgtttcaagcatatttgtaattgctcactgaagcaaatttatcatggctactttaaagtctttgccagatatctaacatttttgtcttttcttttgagacagggacttgcttttttacccaggctggagtgcagtggtgcgatctgggctcactgcaaccgctgcctcttaggctcaagagatcctcccaccttagtcttcctagtcactgggaacacaggtgaacgccaccttgcccagctaatttttgtgtttttttgtagagacagggttttatcacgttgcctgggctggtctcaaactcctgggctcaagcaatttgcctgcctcagcctcccaaagtgctgagattacagggtgtgagccaccactcctggcctcatctttgtcatttggatgttgctatcagttgattgtctttttccagaattattgaacatttatggttctttgtatgatttctggttctttgtatgatgaatgtttcttggttgaagcctagacatataaatactattttattagactctggctcttatttaaacttttttggttttctctgacattgctctgcttaggcaagggaaggtgttatcttgtgtctgtttcctaaccactctctatacaggcctgtgaggggagaggctccgccttattgctggatgtcccaggtgtaagcatgatgtccactgacactatggtgagagtggcctcagaactgctaggtgatgttgaaaatattgactgtccactaagtcttctctaaaaccacctcagcagagagggaaggtatgccttgtttctgcagggaaagggaggaattcctggctttctatgtggtcttcctggctctgtgaggtatgaagctcactataggatggtggggcatgaaaatccagttcattatttgtcctttcctgacactatcttgagttaggtgtgatggtacctcaataccacctggtaagactggaagtctgggctccccatttgggctttgctgtcttaagggggattgcatttcttcctgtggtgttgggctggagtagagcagttgtctaaagcttttctgtcttgctaggcttcccctttcctaacctctagggaatattagatttgctagagaaattaggcttttgttgggactttgatttttgtctgtacctgctgatgttgccatgttgccagtttcttcatcttcaagtctaggatgtacgaagcaaaaggaaaattctgggaattcacctccacgttgttcctcaggttccaaggtacacagccagcctgtgcttatatccaccactgggcatctccctaagtttgttatacatactgtgtccaggttttttagttgtacttagcaggtagaatagaaaaaagtatgtctgttccatcttccccgaagtgagattcttgctatcttttgatatttagtggtggggcggggttgggggaggggtggacttttggtaatttttttaaaaggtgcaaaattatcttgcatagacctggaattcaccattaatttactcatccatatgggagtatagggcttattagtggtggaacctgaaatcttcctttgtgccatatgtagcagttaatcacttaagattatattagtacatattagttgtttctcagaattctgatgaaagggtcaattcacaatagagtgatgtcaccctgtcacttttagaaatcaataaatctatggaaaagaaatctgttctcatgaactaggtaaatgtgaaaagcagacataatgtattgggatgcagagatgaagagcagacatgggataaagcattatttataaaaccactttgcagaaaaaaacattttcaaaatcactaagctattaagattacattttagaatcctactattttatccctgatattgggcatatgaactccaaatcaaatacccccattcctgatgagaaggaaagtttacaaaagagaagataagagagagataaaacagaatgaattaattttaagcctaagacctcaatattaagcctaccttgataccttttaaaacatgatactggtgaaaaaagtatttaaatatttggctcttgctagaagtataacatattctccctcttctaagagacatgacatgaattctgttcttacgtcctgttcttcacaactaaactaaattagaaaaacaattatggaaaatttttaaataatcactattttagaagattttttcagatgtgacaaagatcatcaaatatatcatgtaagtagctatttactgactctacatttgtttcatatttaatgaactgccaaagttaagtgaatcctagagttcaactgtcaaaaatttttattagtgtttattgtttggtattaattattattcaatattgggttttttttaatgctatacacttttctgataagtcaataattaggaacataaatgtaaataaggtcttttccagggattgtgattaaggttttgtcatccattttcacataatacagtgattttttttcttccctgccttgttcaaagtttattaacaaatcatcactttgcagcatgttagaaaggatgaaacttgaacagttagggcaaaaatgcaaaagaatgaccagagaagctcaaggatatttttaaaaaacaacacatatacctgaaaaataatctatgtagaatgtatctcagatgagaaacctaaacatttcttaacctgtaaatatttaaagaagacatatatacataaaagtattatcacaatgcatgattcagctgcctttcactttgcctttaagattcctgacaacctggctgatattaagaatcaccagggacatttgtttaaaaagtggatttccaagaattacttatatagttcctgaatctggaacttgggtctgttattattgatcagacatatttgggaaacagtctattagaggaactgaagtgcaacaatgatagcacttgttcaaaaatgtcaaaactttcaccaaacaaaccaaccaacaatacaccatgatattctatttcactgaaatcggcaatttaagtccacgactcaccttattgaataaagaacatttccatttttgaaaattcttagcaatttgttgtctgtagtgacttcatgaaagttggcacccttttcattggcaaagaacaaatcaggtttccaaatggagtccaacatggaggggtcgaggtctaaagagtcgtcaggatattcactgtacgcgaggcggggatcattccatttctgacgaagaaagatattcactctgtaatcctatgataaaataatgaaagaaagaaaaaaaaaaaccctgctttaaaaagtttaaaatccatagtgtcagtgtggtgccaaggcaggctcatcaactgtagaaaatatacccctcttggggacggggtgtatagttaatggaggaggctatacaagtgttgggacagagggaggatggaaatctctgtaccttcttctcaattttgctgtaaacctaaaactcctctaaaaaataaagtcttataaaaaagagttttggatcttatatactgttctttgggtttttctgaattataacaggaaccaatggcatcctcgggtactcccatcccccaggatcctcactgattaccacgtaaaacagtcatcctagttctgaggttttggccatgtcttcagtgacctatatgcctccaaagaaaagaccacaatttatcatgtttaaaacttgctgttccattcaaattttactttcttgctttgtcagaataaaatgttggaatgctgttagacacttagagaaagatattttcttctttgcatttatttttagaataatttattttagtagatatccaataacatccagaatatatttagtgaacttttcttaaaagctctctgtgttacaaaaatgaccatatacactttttcacaatgaaagcccattttctcatgtttaatatagcatgtaagttctatgaaataagtaatttgagaaaaataaaagctgattttataataatgaaagaataataaaggacgattattgtccataatacttcaagaagatttggctaaagagatttcccaattagatctttcatagttaattttaaaaggagtcaatgatttcaactaaattattgctcacaattttggactaacgcgtagaatgacaaatgttgacagctgagtatatgtgtagtgtttgtatatacacagtatatgaaaataagtaccatatatgtctttataaatatttttttctagatttttgaaatgagccaataaattaaatatagacctcattgtaagcatgattaaagcaaacattataagaccacttcatttgcatgcaaaatagccaaggctgaagatactcacaagaactgaaaaccatttttcatctatttttctatttcttgaataccaaattatgagacatcagaatatagtaaccaaccaatcacaacggatgctttaataatatcagaacaggtagattgcttatgttattggtaggtcaaagtcagagtttgtactgaatgttacaaatctgtacatcctcttgatcaatatttgtgccctgagactatattctaactgcaactaaggttacacaccagaaaatattttttctgcttgctagctgccccatgtatcttccaaagtgacaatggagcagaattcacttcagctttttgccagaaagctcacgatattgtggaaatctcactcgccacaaggatctacagaacctgtaaatggggatatgtgaacaagcttctaccagcctagaataggtcatcttctcttagcctgtagtccagggcaccaggaagcacagctccatggttggtggccagttcttgtttccttcgccattctccagtgtgtgccctcaataccactaaaggaatcagtgattgaccaaatcagtttctctctgctttatagccaggagaagactgaacaaggtcaagttataatcatacctgccaggaaagataactgactagtaaagaatgtacatttgtactgatttataagatacataatcaagttgtttgaagcacttttgctgtaacatttcttgatttagaactctctgtagctgttcaccacacttaggctaaaataaaagtactctttaagttgcagtatatgtaataaaatttggtagaatctctttatccttatgttattagtactagtgataaactttacagatacattttcatttcttccgggaacactttttgctccaaatatgtgctagaaaagatgtttagtatctttcagcttctaagtaatacaaggaaaaagcaacagtcacctgtcaccaaggccaaatgttatcatatacccattgtaatgctctttctgaaatatctctatctcttaatacatttagtttagggaagtaagaaccacatgaggcccctggatgacaataatcctgtcattcatgacagcatggaaaatatgattttgtggtctattgtactgcatggtaagtacagttaataataatgtatatttcaaaatcgctaaaagaataaatttttgacattctcactcctaaactatattaagttagtgagatgatgaatatgttaattagcttgattaaatctttctatgctttggttcagggccagggttcaaagcaaaacaaaaataaccatgtcctgaaaaccttagaaactaagattttactgctccttacagttttggttttgctttgcctgcaaatgaacattgagatggaaagctattaaataaccaaattcagcatttcaaaaatgtttttttaaggctgattcttcatagccacagtatcccattatacccagcaaccaattatattaattatttttgaattttggccatttgtgaaaatgtgtaaagaaaggggcaagtaaacggacagtcaaaatagtaccaccctaagagaagtcctaataactagacttgaaataacttgcctgtaataaaattccctggagtgaagaagaaaaagggccttgtacaacacattttgtatatggcaaaaggttaaattacatctctacatgacgctactcaagaaggcaacttggagtgaattaaaagttcaaatatgatgggtaaaattttttaaaagaaaatttagcagagtatgtggccttgaggtaggacaaattatttaaaaagcacaataatattgatcataaaataaaggttaataaattctacgatgtcagaattaagaaattctgttcatccaaaggtcacttaaggttaatgaaaacataaattatactgcaagaaggtatttgccacatatacaactgacagttgattattaacatgctttaaaatatttcataccaataattgagaaaaagagaaacaactgagtagaaaaatggccaaaacaatcacaacattttactaggcaggcattgcaaatacccaagaagtatctgaaaaaatgttcaaccacataagtaaacaaagaagtgcaaattaagatactaatgagataccattttatatttactgggctgttaaaaatgagacttttgatgatatcagaatttgtcaaaaatacagggcaaaatgatcctttatacatcgccgcgaaaagtataaaaagatggaaaaaattggccaggtgcagtggcttatgcctttaatcccagcacttcgggaggccgaggtgggcggatcacgaggtcaagagacagagaccatcctggccaacatggtgaaaccccatctctactaaaaacacaaaaattagctgggtgtggtggcgtgcgcctgtagtcccagctacttgggaggctgaagcaggagagacgcttgaacccaggaggcggagcttgcagtgagccgagatcacgcctctgcactccagcctggcgacagagcgagactccgactcaaaaattaaaaaaaaaaaaaaaaggaaaaattaacattgtaacataaatttgatatatgcacactcaggatacaaacattttagttcaaaatacaaaacttaaatccttatgcttgtgcaacagaagacatatacaaaagtatttatagcaacactgttagctctaaggaaaaaccaagacaaaccaaaccaaaacctggaaccaattcaaatatccattggcagaaaaatgcgtaataaactgtgccacgtcaataaaatcaaatacctagtagtgaaaataaattaccaccatttccaatgatgaggatgaatcttacaaatgtaaaacagtaaaaacaaaaaaagcaaatgctggagatataatgtatggcaccatttttgtaaaattcaaaaccaagcaatttctctctctctctctctctatatatatatatatttatgtgtatgtatgtatgtgtgtatgtatgtgtatgtgtgtgtatatacatacatatacatattcatcaatatagaattataactaccaactttatgatagtgattagctagggaaatgctggggaatgagatagtgaattatacaggtatctttaatattggtaatgttttagctctaagtctaggtaaaggattcaatagtgtttatgttattaaattatacatcatcacatatatattatgtatgtaattatataccaaaagaaattgtgttatcataagaatccttatagctgaaagaggaggaagagagtcagtgccaaaatgaggtgatgtgaaactgactgggtctctggtagaggaaaaaggccaagaaagagccaaagaatgtgggcagcctctagaagctgtaaaagcaaaggaatggattttctcctagagcctccagaaggaacacagccctgtagacaccttgaatttagtctggcaaaacacactggacctctgacctcaagaagtgtaaggtaatacatttgtgttgtttaagccacttgcagaataaatatttttaaagttttctgtatgttgtgtttttttgacatcttaaaaaatccttctggctgtgaagagactacctctccccagtgccagtcaaatttcaaagatagcaaagggcccagcctggagcatgtcttgagtaaacaaactcataacctcagaaccttcccccctctatcagccagtgcacccagaagacagtgttcctgtgccttagtcatctcagggctaggtaccaggcaactagaaaccatctctatagcccaaagcctggcaaaattattcaaacgaggcaaccttaaataaacagttcaccttgccctgcctgcctttgcagaagaaacctcaataaaggctgtggcttaaactttcatgctcctaccttctgcttcctgaccaccatgatgtctttcccacatggccctgcatgggatgctgtgcctcttgtctctaggacccgtgagtataataaactgtgttttttcctgagtctccctgtttcttctgtggccacatcagactgaccatctcataaaagaataaaaacaccactcaatttgtggcaatgtgttacagtagcaataggaaactattatatctttttgaactgatttgcatacaatattattaccagttttcgaagacatctctaaaacaatagactttcttttttttttggccggtaattggagatggtagaaaacttaaggcaaataccactggattcatagccagatggaaaaaataatccagaattctttctgttttaaaaaatcctaatcagagatcttggcaaatttcaaaatgatcagaaaataattcacctttgtcaaataatcaagaatgaagctcagacttcttaccaatgtctcactggtttagctgcataagcttttacagttctgaagtgctgtacaatataggttcccatgcgtcaggaagcacagaataccgacacccaatggtgcaataattgcttctaacatcatctctgtaatatcccccatgttgcctataccatctgctctaagaaccccgccacagggagagttgtcgtctggggccactgattctgcagtaatggcccattgggaaagtgcctttcaattctcagttactaaagcaacagggaagaaagtcattttataagaactatttagaggcttaaaaggttatcttaaatctccctctgacttctccattatccatatgtacaattattctcctagaaaaaagaagattttaaaattccaaaatttttttaaaaagcaatctaattgtgtaccagttctggaaacatgcaattaagagggattgattagaacataaaatgtgctgaatcaattaaataacactcttcatatctcatttagtaacctctgcgtaaatataagattgaaaattaaaatactagcaaaaacaatacaaagctgtattccattaagaatactacccattctgtacactcgaatgcaataatttctggagaggtaaacttagttcatgggaacactctttcagaagttgaaataaattgatttcaattaatatagctcattcagtttgtgggcacctcgatttaggtgtaaacacctacaaagggccagtactcctagtagctgcttgctgtcaatgaaaaatagtaatttttgttgctcttggattgcaaggtaacaaattaatctcccgctaaggtgctgcacagctgtgctccacaagcccccattcatccaccagccccttctgtctttgatgctcacttaatatttctattcaattctcctttgtctgctaattgtatgactaattttcagccttaaaaaaaaaaggctagataaccaggtggacttcactctgtccttcacagcaagttgtgtcaacaagcctgtgggtaggagaaaaaaatggcagaagtttctacatcatttttctgcccacttctcagctcctaaactccaatttactccattttgtgtcaaacccactaggaagaggaagctcatctacttctcctggtttagacaacatggacatggaagtctactaatacttttgctcatgacctgaaatttgcatcacaaatccactcattccaacagaatattgtctctggattgattttattgctgcttgatgttaattacacaatttacatgttaaaataaacataatcgtttacacataagacattagtttgtattttgtatatttatttatttattttttgagatggagcatggctctgtctcccaggctggaatgcagtggtgccaactctgctcatggcaacctccacctctctggttcaagcgattctcctgcctcagcctcccaagtagctggggttacaggcacctgccactgcgtccatgtaatttttggattttttagcagagatggggttccgtcatgttcgccaggctggtctggaactcctgacctcaggtgatatgcccacgtcagcctcccaaagtgttgggattccaccacgcctggcctcattttgtatatttaatatgtgggcatctgcttactattatttttggaccttcactaaacaattgttctactactggaacatatgacgtggctcctaaaacagtgaaaatctctggggaaatgaagtatcatttggtctttggaacattctattatcaatcaacactacaaatgatcttcaaatcagatttctaagaatttcttcccagtaatgggaagaaaattttttgagaaaagttggagatacttcaaaattttgaggtggataagagtgtcatagaatcataatgattttgaagacattctaactactgtgtttccttaaatgtctgatataaactgtattctattttattaatgtgtgtttttaaaatttaaaaaattgtggtcaaatatacataacatttatcatcaaagatgataaatttaaatttaaaattttaaaaatttaaaaatttaaaaaatcgtgatcaaatatacgtaacatttatcatcagagacattttatacattaacagtattatgcagtattacagtattacgcagccatcaccaccaccacctagtttcacaacatttttttcaccccacaaggaaatcctgtatccagttagtgatctcctttcctcctcctctagtctctggcaagcactcatctgcttcccgtccccatagatttacctactctggatattttaaataaatagaatcacactatacgtgaccttttgcatctggcttcttccacttagcataagtttttacaaggttttatggtacatttaagaacacagaggtcatttgtttatagaagtgtgaagggcctttttgagagaattatgtatgtaaggtgatatgtaatatgtaatagtttcagagatatatttttggaagtgagtgttctatacacaatgatgtatatgtacatgtataagccatcacaatgcctgtatatatgtattatacataaaacccatgggaatccacaatcatcataaaatatgaaaacaatagctactattaataaaatgatactaactttcaggcataaaactagatgctttaaaaataatttggaattgaagaaataataagtaaaattgccctgtatataaagtttcaggatcatactgatgcttgtaaaggcctaacagcttcatcttgcatacaagtacttttcatgatagcgacatctgacactgtcagggtttatctatttacttcacactaatcagtgttttttttaaaatatcatatgtaatttgggactaatgttatagaactaacaaagaaaaaaagatttattttgggcctgtgtaagatcaaattttaccaaaataaataatgtgaaccaagtttgtttacctcaagtgtttccagtttaaagatatctagatttttagttatacacacacatatttaaaaatttcatctatttaaaggttcacacttcccttcacagttttattaaactattaacacgtagtagcttggcatttgataaaagatatggtttagtaaataagaacaaaggaatagacattattggcaaaaactttgttgtatttgacatttgtcctcagtaagaaaactgaacataaatataattattccaataattattttcaaatttttctgaatgctaaggcttttttttgtggttttttgttgttgttgttgttgagacagtctctctctgtcgcccaggctggagtgcagtggcacaatcttagctcactgtgacctctgccacctgggttcaagcaattttggtgcctcagctctaagaagccaggattataggtgcccaccaccatgtctggagaaattttgtatttttagtagagacggggtttctccaagttggccagactggtctcgaactcctgacctcatcagatccgcacgcctcgatctcccaaagtgctgggattacaggcgtgagccacggtgcccagccaatgctcatgcttgttatcacagttttacattttaactgatatttaaattttcagaaatttaaaccacttattttctttgggaatttttttaattcatgaggacttttatggcatacaactaactatgaaatgtgagaggttaaaaattaaaggaaaaatgttccactttggaagaattttagttaatgaaatattatgtcaaagaaaaaaaataaattgcatttgttttctttctgagcaattcagataattcttacatagttgtttattgatttggagattggccaaggaactctgtggaggttaagtgtactgtaaagctggagaggaattaacttcttttagaaactatcattgaatattgctgcctcatttaggacagctcttgacagtaacagatgaaatgtttgcttcttctgcaacaaataaaattttaaagtccacaattcactcttaactgaataagacatatataacctattaaaatcagaattaaaagaaaaatgtaatcaatcattagatattttctacttgggtagagaacaccactcattttaatatttctacatttacaggtatttgggtttatgcatacatatataaaggtatttgaatgtagggtatcacaggcaaaagataggttgcaaaattttggtgtgttcttgcattgcatacaaatatttggcaacctgtgagtattaccttctatttgagcatgtaaacttgaggaaattcatattttgttgaatgtaaatcctagtgtaggtttagcataatgttgcagctgaaacttttagaaatacttaagtatgattatttcatttccacattatagttttgatctgttcggaatcgattgatatttcttttctctgtaaaattagcttgctatttatactcgaatactttcatgacaaaaaaattatttgaagtgatgagaacacatgtactaaattaagcatctttaccagtggtgtattgtaggacaagaacaacaactgagatctcactgcttttcattcaggccttttgctatcaaaataactcagcatgccacataatatactgcttaccacaagtgacaccatctcataggcaaggtctcttttatggtggcagattattttctctcagggactatgcccatataccagctgaattccactgagcaacttctgttcaaaccatgtagaaaaggctcagtaaagccctgctcagatctctggcttacaaaatcatggcatgtaatgaaatgtttgttttgtataaaccacaaagttttgggatagtttgctatgcagcaacaactggaatagaactaggaaactagaagtgggtgctgctctaagaagaaaacttaaaacatgttcccttgactctgggagcaggtagcaagaagtaggttgcaaggatttgaagagattgttgtgatggttaaaggaatgagaaggaaattcttattagaggagagaaaagaaaatccacccctacattgtggggcagaaagcttgacaactcatttcagtaatgtagaaaacagaatatgcaactaatgaactgttgcatttggccaagaatattttctggtaaattcctgaaaaattccacttcacttttttgtgggctctgggtaaagatcttctcaaggatgtgactacgaccccttgcctatacttcagaaatattaaaaatgtgcctcataaatgttctcaattagattaaaaagtttctaagaatcataagagcattatctcaaagaatcttgattcccaacccaaggtagagaatcataggaagcccacaaaaatgttaagagaattagactagtagaagcaccattggcttcatttgaaatgggcagggacagttcaaaatgcaaagagcttgcaaggttcccacatttctatgagcaggaagcggtatgaaaaggctactttgtagcaaacatggctcatttttaccgaaaaggaaagatgactcagaaggcagaaacaagagccaacacggtaaagtcaagatccacattttctgggagcaggactgggccttaataatgtaactggaaggatatgctttcccaggctccagaattgctatgaaccagtgactacaatgtacttcccatcaccctttccctattgaatgggaacaccttatccctattgcagttttcctattctgtatcgcctctgtaggctgactttgtgtgggatagaaaacctgttcttaaattcacaggtcttttgatcgagaggaatcataagatccaccttttgggaacctcatttgcactcgcatctaatttagttgacacaattccagacttcaaaacaatgctatagtgggacaaaaaagctggggtctttaggaaggggtgtttatgttttgcatattggaagaatgtaaacaatgtcactagaaggccgactgtgtcagattaaagatgtcctatgggttgtaagaatcctcaaagcttttaccctgtctcttgaagcgctctgagacacagctggctgccatgtcagaagttagaaaccccagagaaactacactgaaggagccacatgtaagaactctggtcaacagtcccagctgggtccagatttccaggcttcctcaccaagacactaggcatatgaatgaaaccattttgaatgctgatcctccagctgaaaccagagattttatatcaatgacaagaggagcagaaaagttacccagcaaatccctgcctatattcctgatccacatacatgtgagacctaataaaattggtgttgttttaagccattttattgttgatgttcctgctttaatttgttttaaaattcagatagagcttacatacagatctgtaccaaatgcatagagatgtgtaatcaccatcacaggcaggttacagaatagagctctcacccacagatattccctgtgttgcccttttgtcttgaaaccatccctacacctattccctcaaagccagtgatgccttcttcatcctcattgttttgccttttctagaatgttgtataaatggaatcacacaatatttaacattttgagtctggctctttcttgacttaagttattgtgtgtatcagtttattcctcctaattgctgagttgcattcaattgtacgggcgtgccacagggcttattcacccattgatggacttctggtgtttttccagtattttgtgattatggataatgctgatgtatacacttgtgtatgggattttatgtaagcatacgtgtttgtttctcgtaagtaaatatctacgagtgagattactgggtcatattaagtgcatgtttacatttagaaaaaaagtgctaaactgttttctagaatggctgtactatttgcacttccgtcaattatatatgagagttacagtttctttgcactcttatcagtaattagtaaattcagatttgtttaaaaaattaatttcaccttttctaatatgtgtgtagttgttctcattgtggttttaatttgcattttgctaatggctaatgatgtcaagtagtgttttctacctatttgcaatgcgtatatctttttagtgaagtgtaacaaacatttaaattgctcattaaaagtattgtttttattttactattaagtttctagagttctttataactattctggatacatatcctttgccagacatgagattggcaaacttgttttttcacagcatgtagcttttttttccttctattaacagcatttttcacagaaataaaggtgtttaattatgataaagatccctttatccattatttatattttttaaattgtgcttttggtgttatatctaagagctcgttacctaacccaaagtcacaaagattttctatgtttttgttttcttctaatcattttataattttaaatttcatatttaggtttgcggtcaactacgagttaatttttgtatgaggtatgagtacgtattgcagcttatttttttcttctgcatagttgacaaattattccaacactatttgttgaaaagattagaatgctattttcttatggtgcagaacctaggaagagcagatttaaaactgtgtgaggcaagaggttatttgttcacacctgagttttgctcatctttgaatccaaatatataaaatgttttttcttttgctcagacacacagaataattggcattagctagaaattccctagcatggtttttgtgagagtaatgattaaaaaacaacaaaaaagtcaggtatgacaaaacacaatatatcacagcaattttgttgttaaaagaaagtaattttaaaaataatagttaaaattttaagaaatcttatttgttagaaagctgacaagctaaaattgaatctgtagttcaatatttaacatcagtagaagctgtgtgaatggatattgaccaaggactcacctaattaagttgagggtaagaaaatatattattcgaggtttttaataagctattttaagaaacataatttgaagagtaggaacactaaagcttgctttgagtattgttcagaatgaaatagttgtataacatattctgcaataactctggtactaaaattgtcaagagcaagcaatttagtcttaatataagtaataagaaagagaaactccagaaaggaaagagaattgcaaaaatatgttgcattctgaatcaaatagccactgggcttttacagggcaagacactgctaaactcatggggaaatttaaggaggaaaaatctctctctcctttgtttctgatgtttgctttttcttcagtgttttgagagtaaaaagaagatagatggaaattcagacttgcaatatgtgccattagaaaattacaaagcccttatgatctcagcagaaaaatgatagcttttaaagcctgttccctggtgcttcatcacctttcccagaaggatataaattactggaagataattgctatgaatacatcattctttttcttgagattccctggtccttgtgaaactcaatctatgtccctaggagcagagttggtggagaaggatgataccatagaagagagaggcaaaattattgaagatccattctgttggcttgttttgttttactttaccctccccatttaaaagaatcaagaaaggacaacctatttgattatataaaactctgtatctgttgtggaatatccatagctgttgtgggataaaaattatttcaaaaggaaattcagaattaagctatttcctctcttttaaatttagtcttacagaaaagttgcagaaaataagagtttctgtaaaccttttatacagcttctgctaatgttaatattttacatattcatagtagtttttgaaacctaaaaattaacattgatacaataccattaacttacctgcagacctattttgaatttcacgagattatgaaaaaagaattcaagattataaaattaaagaatctaatatcctctaatatccctttttttctcgtgtaggatctaatctaggatcccacattgcatttagcttttaacttagtctcttctaatctgtgacagccccatagtcttttttttcttttttcatttttttctgtctttcatatccttaacactttttgagatataccagccagttattttgttgaatgtccctcagtttgggtttgtctgatgttttctcataattagattggtattagtcctttttaacaaaaatgctgcagaaaggatactgtgcccttctcattgcatcattccaatagcacatgatgtagacctgtttcatgggtgatgtttagcttggtcacttgattaaagaagtacctgccaggatgattcatggtaaagatatagtgaagcttatttggtactatttgcatgatattttaggtttccttataacccttgcatcttggtggatttcaacaattcttatagatatttagtgcatttttgaaacattttgtaatttctaaagttgagatattacatacaataggtgttcaaattgaaaaaaaacacaaataatgtatcttagaagtgacagctctgtgcctgggtttatgagtacagaacaggaccccctctcttgatccatacaccactgcagctgcagctgttgctgctgccattgtaggctgggacaggcaagccagagggctgccggtctgtggctgtgagtggtgactatgtccccactagtagcatggcctttgtgcttgggctcacaagggaaggagagggttcttcccctactctgtatggtgctgtggtgctgcagccatcaaaagtagttaggcctgagagctatgtgtctggggctatggttggcaacccagcattgcagccactggcaacaccaccgtgcggtgcttgggacccagagggttgtagtgccactgccactgccattgcccacaccacactggctgctcagggacctaagaacgcaatcacctacgtggcctgtgactgccattactggcatcagagcaagccacttggaggaccaagaagaggcctgcctggtcctactgacacaggtgctggtgtatgctgccctgggagccgaagaacaggcacattcgaaaccctgctacccccactgggaccaggacctaaagactggcccacctggcgtccctgcccccagcaaaatttaaccataccctccactagttcctgtaccctaaaccactgaggaaatcacaaataccaccaatgctgtttatagtcaagtaaatcatacaaagattgcacgactgcatgcacccagaatcaaagccaaagggttctaaccaattgaaaccattgatacatattcaggaaaaagtcattccttgtgaattcaaagaattgtaagaaatgactattacaccagttacatatatatcaacataaggacaccagaaacatgataaagcaaagaaatatgacgccttcaagggaacacaataattccttagcaacagatcccaactgcaaagaaattaacaaaattatgaaaaaggaattcaaaattatgatattaaaaaagcttagtgagataaagagactttgaaaatacaatacacagaaatcagaaaaacaattcaggatatgaatgagaaatttacaaaagggatagctatcttagtgaagaaccaaacacaaattctgtaactgaagaactccccgaataaaatgcaaaatacactcaaaagcttcaacaatagactgaatctaacagaagaaagaaccacagaacttgaagacaggtcttttgaaataactcagggaaaaataaagaaaaaagaatgaacaaaatctttatgatatgtgggatagcataaagcaaccaaacatacaaattattggtattcctgaaggtgaagaaatgttaaaagggtttgaaagcctatttaatgaaataatagatgaatacttcccaagtctagcaggatatttagacatccatatacaggaggcccagtgtcccccaaagagatacaatgcaaaatggtctccgtgacactttataggcacactgtctgaagtcaatggcaaaggagaattctaaaaacagcaagagaaaagcatctagtcacccctaaagtagttaccgtcagactaacagtaagcacttactatgtattttcacagttttaggtcgtacatttaagtatacttactatgtattttcatagttttgggtctaacacttaagacccatttaagtgctgacttttccctataaaaaggacattggtcttggcaaagattttatggctaaaacctcaaaagcataggcacaaaaataaaaatagacaaatgagaccatattaaactaaaaagcccctacaaagcaaaataaacagtcaacaaaatgaggagataagctgcagaatgggagaaaatatttgcaagttactcatctgacaggtgactaatatttggaccatataaggaacttgaacaactcaataggaaaaaaaaaaaaagttccaaataatcccattaaaagatgggcaaaaaacatgagtatacatttctcgaaagaagacacagaagtggccaacacatatcttaaaaagtgctcaacatcactatcattaaggaaattcaaataaaaaacacaattagatattatcttatgccagttagaatggctattattaataagaaaaaataacagatgctggtgaggacgcagagaaaagagaactcatacactcttggcaggaatgtaaattagtacaaccactatgggaaacagaatggagatttctcagaaaactaaaagtagaactaccacacaatccagcaatcttactactgggtatctatccaaaggaaaataattcagtatatcaaggggatacctgcacttgtacgtttatcacagcactattcgcagtagcaaagatatggaataaacctaactgtctattaacaggtgaatgagtaaagaaaatgtgtcatatatacaccatgggatactgttcagcctaaaaaaagtttgaaataatttcattctcagcaacatggaaagagctgcaggtcattcttttaagtgaaataagtcaggtatggaaagacaaatattgcaccttcacactcatatgtgggagctaaaaaaactcatcacttcacggacatagagaatagaatgatagataccagggactggggagaccgggtagtgggaagagagggattaagagaggttggttatggttataaatatacaattagatagaagaaataaattctagagtttgatagaggacgagaatggctatacttagcaacaatatcatgtatatttcacagtaactggaagagttaccaatatagttaccagttaccaacacaattcctgagtcaccaataccaatatctgccaccaatatttctgataccaatacataaaaatggtaaacccatgtgaaaatgatgtatgccccaggtacgctgacttgaacactacacattctatgcatgaaacaaatactcacatgtacccaataaatatgtaaatcattatattaggttggtgcaaaagtaattgtcattacttttaatggtgaaaaccgcaattatttttgcaccaacctaatatatcaacaaaagagggaaaaatagtgacagaatcttagattgacatgtactcacaggaagaatgaagtcttacaattaaagaatatgggcttgtctgtgttacactcagaatttgtttgtttacataattataatcaaactacatatattatggatccttctattattggtcaccaattattctggcttctgcctttgtggctctttccttgaagaagaattatatatccctgctttgctgtactcaggagtggccatgtgacctaagaggtgaatatcaaagagttagacaacgaggacataagggcagtggtggaaagagtagtcgatgaaggaacagcaaatgcaaggaacagatgtgagataaaatattgctactctaaaaagtaagagttcaaagggcattctgaaatgcacagtgggttaggagatggggtggggcgagaattcagtctgatgacttaaggtgagacagattatacagggctagtataagccatggaaatttgaattttgctccaacaggaattatttgagagccaatgaaagagcagaaaaatgacaagatcttatttgagttttagaaagatccagggtagtgattgggtgggtagtaagggaggagcagagttagattctgtgacggttcctgtcacaacagtgagaggtgatccccaaagtggtgaaaaagtgacatatctgggaaatatttgcggggtagaattgctgtgcctttgtgattcattagatattgagcttaaggcaggaagaaataggtcctcaattttctggctgactcaatgagatagcaaacaggtgaagcagatttggatatgatgagctccaggaatttgtacaattgagggagataatcagttcagatatttgagaaaccaacttactgattagactactgtgtcagtgtacagttaatcttgcctttaacattatagcatatatatatgctgttccaataacattatagcatatatatatgctgttccaaatactatgttttaatgttattttggtttgttttatacttccccatgcctttcacatggagacacttgggctatagctattgactggacaattaccactatacatgtggatggccataaagccaaggacaaggataaatgtacatacagagcatatgtgtagcaaaggcagtgcctctgattgaaccttaataatggctggcattcaagaaatagaaagaagataatagtgcaaatagatttgggaaggagtggccagagagtcagaaaaccagagatggttgaattagaaaagccaaagtaagacagttttcaagagcataatcaacagtggcagattctgcaaagatgtcaagaaagtttaagcttaagtggttcattgttgttattgaatactttggaaatagcaattttagtgaagcgattggtgaaaaaccaggaattgaggaatagcatcaggtacaaccatttaaagtaatttggctgtgaatagaaagagaaatatgggaataactagaaataaacaaatccagggaaagctttcattttaggagggcagttagcaaatcaaaacattaaagggagaagacacataaagaagagttgaaatacattgagtgtggtcctggagtaaaaaggacttcaggatttgatgtagaaaaaattgggaactaatcttatataaaaggagggaaatatgcctcaatgtatcagcaggaacattatacccaggttaaattttaggtttggtggcaggttgctaaaaggtttcttgtgttccggtctctacgttttctgtgaagacaaaggtaaggtcatctgttgagaatcagaagacaggtttggaggttaagggtaggtttgtgtgaaagactagcactcaccctccatttgacctgtcttgtaacctgtcagctagtattgcagaaattagaaagatagaaagatattaaagctagggaccttgatgtgatttctgtttagtcaattacatgcacttgtgggagattgagacaaagccatgatctgctcattctgagtttctacttgcaagtggatttatgggattatagtatcattgagtttttccacagtagtgtcaatggagattccctgtcatgtcactagtttcatgattgttgaaagaacaaataaatgtaaattatctagtaataattataattgcggctcagtgactgctattgtttctcgattcgtagatttcagcagtgtgttcctggagccaactgttccagtagcagccttcccacttcctgattcaggcaagggtagcagctttgcttacaagccaaatctgtggtataatcctcctcccccagctttccagtacttttataaacatctgattcccagaaataaattcctttctgtgaggtggctggcatggtttctgttacaaccactgaatgcaactggagcaatctttgccatcagaggagttgtgggaataggcactttgtactgttcagttggcctatttgtgtttgaaggccaggcatatctgaatccattaaatgataggatactagaagtacacagaaaccagtggcaaaatcagttaaattttttacctatggccacctgaattgaagtacatgattttgcaaaccaagtattgaaagccatagcaaagaataatgtcacaggcatgagggagtcagggactgagaaatgggttgcctgcttctgattgcattggggagctaaaagaaaaaataaaatctggtgcagaaaattaaattctcatattaaggcatggtcagagaaccagggatttttcatgactctcctgaatgtgtatcttatctcttgtaccttcatggatgaagatggtagggctgaaaactaaacacaaaggattaatctgtggactactaaactaaaaggtacattatattcactctcttgcagagtgacatatatgagtgttagctccttggttgggaaagagtaaaagttcaaatattagaaaaataaaattgggaagatttagaaaattctaacaaaatctaaggctcttgtgttagcagaagcagctcctcctcccatgtatgatgaaggaggggtatacctatttttcttatatcccacctcaaccttccatcactgccctcatggagtagatctctgaaagcagctagaaagccaattatactcaatccaaggaagagaagttttgtatcctaaggaagtgctagattttaccattttttgtgcataaattgttatatgtggaatagattctgagagtgctagaccatggattatgaaacaaaattttagaattggctaaactgattgctataggtgtgtttacagagattctagatgctgtgtattagctcagatagccaggaatggctcctatgggttatttggctgactgaaagctgggcctagcaggggactatgctgaatgatgtttatatattacaaatttcttagtctgtcatatatgagacatccaaagacatagaaaataagagacatagaaacggatttaatatgtatcctcatttaattctcttttcccagctatgtaccctaagagggcccatttaccaagggattaagattatattagtaaatgaaaggccagcatctttaaaaaaaaatgcattgtgatggctgtcctctgtaagctgaacatattgctcctgaaatgagctcccagatttcaatagtgataattgccaaggtgacagataaaaacttagcagtacttaatccaagtagcaaaatggatcctgttatcataaatggagcagctttggagtggtattcataacatgtaaaccttagtgatctttgactgcagatggttgctcaggaggttaatagacttgaaataaatgggtagctcattaaggaagatcccacttgttttgaataatcaaaataacactgggaaataaagggcccaggacatctctaggctggaagctttactgatagatgaattaatgatcttcaaattcttaggggaagttttcagacaaaacttaagaatgtctcatgaagaacttttacatagggatctatctaggacagtttcaaaacaaagtttacccttatatcagctaacccagaaaaaagagaagcctgtctgtctgtctatctatctatctatctatctatctatctatctatctatctatcaatcatctatctacctacctaccttcctgctacctacctatctatctacattttttagtaagtcacacctttatagaagctttttctggttaaagcatgatagaaacatcataagtgtggtgtaaatttcacaaagaatttgttgccatcgaaggagacatcaagaatgaactccatgtaaatattttgagaacaattttatcaaataatgaaagacaggatgcaacaatcattttatgagtgaaataaatagataaatataatcacagcagaaaaagaaagtaatatggcccttgcatcagatgtggaagataaatgtgaaacaagtctgaatgtatttataattagtacacgtgtttgtgtgcaggcacacaaagaaagtttaaaaaataacatcaaagaataaattcatacaaaaataaaagagaatatagtttgatctccagtttataagtattactaattttgcaaataggtaggggcataatcatgaatcccttcctcgtcagaatacccagtgctcttcccattatatgacagcattgctgttacgtagcccactgagtaatgagtacagaaatattactcttgggcaagtttactcattagtatccttataaatatacactttagagcacacattattttcaaagaggacagtatggttcctgagggagcaaaaattggttcttggtgggtgaaagaatgcttaccctttttatgtataattcagagatatgtacagagcatataaataaatttacagttcatctgaagtactaaaatttcacggggagggcaattagggaaaagatgtctaaaaagtgtctttagggaggcataatgaaaaaaagtgttgagaaacactgctttaggagaaactaaacagaaaagggatgcaaagcatagtcatttctttttatgtctgctgtcaaattttgattaatcatcttaatcttatagtgcatggatgaggaatagcaattatctttatagctagttataatatgaaaagaagtaaagtatatttagaatcagaatttttagcctttttagtagctgcttcttgagatgcatatataacaagcatacgatgtagggtatattagcacagtgagtgatcattgaaagacggagtgagcagaaaaacacaagagaagctgatgcaatgtatgaaatgatgctcatagggagaaacagtgaaataacaacctgaagcaaacaaagtgacttccatcagggaaagaggttaaatttcatctcataagctcaaagaggcacctggctattctcttattacctctggtagaaagtcttgtgccagttccgaggcttcctgagagactggaagtgaaacaatgtcacagcttagcatcattaaggagtggaggcaactccattggagagagagagaatgagagaaaggggtgggtatgagtccttataggaaaaggtagagagtaattcttcactattccgaaagtttgacgatagaaaagagtcccagaagcgctggaagacttaatggagaaggaagcactcccaaatgtcttccttaccgtaggaggaaattaatacttcattaatatccatagtaaagtgaatgggttttgcgggtgaaggttgcccaggatttatcagtgaatattttcagtttatcttcttaatgttaatatatgttataagctcatttttgttaattatacctcttaatataatcttgtgacaagattatttgtcttatgctttatctagcctctggagtgttggcaatattccaagaaactactaaaatttttgaaaagatgctgcagattatagtactacctttgtgacagtaaatccatgtttcttcatgttctccatagaacaaatggcttatgttatcaagcctccttgatgagattgagaataacttcccttttgttttaaaaccaaatttttaagaactaaattcattttgatatacatatgtcattgttgagaaggaatctttcagtttctcattgacttcctaagtaacaaggaaggcttaactcttgcgtgcatctgttctacttgacaggacacttgtggcacagccccaggttcttgtcagtctggcatgtttgaatccttctgaagcatttagttggcttgttgttttgtgggtaacctggaagtctcatcgcagcaacagaaatatgccgtttgaacggtccagagagctacagtgttaatattaactcacacatctgtcagagattcagcctaagagctgaagagctatctgcaatttaaattgattgccaagaacttaacactaattgacatgctagattcataactaagtaacacattatgactagtgccagtcatcttagagaacacaattcccaatcttgctgcccattttatctttagaggctgaaatgacattttggagaggattctttcagaaaatcaaattctcttagaaaaatgtgatgatgatgaatataatgaagaggaatagcattgctgtgatctgttcatgataatctgatcatttctatgttatgagaggtggccaagagaagtgtttaattgatctctacgataccttcctctagagagatccttgaccaggtaatggtcattttccattgcaaattaagaggaggcagaaaagagaagagttgaatttgacacatatctttgccattacatttaactctacaatctttatttctctttcccagcccaaatatttcaaatgccttaaaaatgcaatttttaaatttacttgtcgaaaggaaactctacaatgatatacagtctgataaaggagatagcttatagaggtctgtgcctgacgactctctctcaggatacagattttttttttccgttgtcattagcaccagtttctccttgacatttccctccacagaactggaaatgtgccttttaacattgttttaacaacattatagcactaataaacaattgtattctctatgatattctgtatgagatttttacctttgtgaacaggatctgtagacagtccctttctgagcatgatgattataaggatgacttggtggatgaattcattaagcagagatttattcatatgcctcatggggtcaccaaagtgtataacattcatgcatacttatcttttgcaagcatccccataaataagcccatttctgattgatgcttatatgtgatagatcagagcacaatcattctgccaatcactggttactcatgcatggaattaaaaatcttccagatccatgccatttctatatttggtttggctttacctattactcaaagtaagaaaaaaaagagaaggaggataagatgtaaacagatataattttaacattaaaaggatagcaggatactttcaggctgttccaaaagaactgaaatagcatcaatctaataatatcctacatgaacattgttgaatttataaatatgaatgacatcggaatagccactgaatgctattatggtacttacaaatagtgaataaatgtacctttgtaagaatttaacccattggcattagataaaaaggaccaatggcacattttaggggaagtttacaaaagaacagaaaaaaatggacttttcttcaaattacacacattttatttcagttgtgataaaaattactgtaaaacctagcctgtttatgaaatagttgcaccctaatatttttgatttttgaaaattattcttggatcactatataaataggagctctaatttcttatcatggagaactctccataaaaatttcagcatttttcacaaaattatctttctataaacatgcgtgaaagagcaaatgcttttagaagaaagattatagaattacactgaaagatttgaataaaaaagccaagttcattaaggctatattatccaacattaacttgattgtacaattagctgcttaattcatattttagagactgtagcattgatttatgacaatgatcaggactcagaattcagaaacagatcatattgcaaagcagtaaaaatagcagtttatccacttgtgtcaagaacacataatgaagttctctttttggaaaaaaatagtcttttttggccagaataaatacatgcttacatatatttgacaatataaacttaagagctactttatgctgagcatgtcgctagctgttaatgatacaatgatgagcaaatcacagagaactgctgccctatggacactgcattacaaaattttaaataaatattcatggctttaaacaaaatattaaaaaaagaaaaaggatacttaaaagtaaattggatgaaataatagtatgtcattgaagtatgacaaattagcataaggagaaaaggcaattccaacaaagccaaataaagtagcacaggaaaatatcatcatagactgtgaataaattgcctttatgtaagtcattaaattgttttcagtgaaggaatctaaaatggattgatatgaattataagttatttgggatgtttatgaatttccaataagttatttaccagaggcaattcttaaatatagaagtataagagatagaaacacagaaatataaagagatattatagaaactctgacagagagattaagatatagagaaagcaatcagaatatacagtatagtaatttctgcagaaagaacaaatgaagagacaaaaacgaactattattattcatagaagataaacattaattataaattcagaaagcagcaaaaatatctatcagaacgaataaaaatacacccatatataaactaatttaaaaaatgagtgaaaaccaaattacccgtaagaataataaaattggaaacattacaaagacttctcatcttgcaagataagatgtggtaagtgtatgtaaataatttgacaaggaaaggaaaaattcattgaaaaacaaaactattacaaaactgatgctatgaaaaaccgaatagttttatatctaaggaatggaacttggaacttaaaacctttacacaaataaaatgactggcttggatggcattactggtgaattttaataaacactcatggaagaaataacagttcatcaattttacatgaaccattttaaagagtagaagaaaaaggaacactttcaacatagttttaggaaaccagcataatactgataccacacgccactcttgacattgtaagaaaataatagttcaacatccaaagttaacacagtagcaaatatcctaaaccaaatattagaaatttaaatctagcaatatataaaaagaataataaattatggtcaaatgagatttatacaaggaacgcaagaaggatttactacttggaaataaatcaatataattaataatattaacagagtgaaggagaaaaacataatcatttaaatgaatgttcagacagcattgaataaaattgaattccttttcataataaaacatctcagcaaacaacagtggaagtaaactcaatctaataaggaggatttatgggaaacctacagttaatgccattcttttttttctttttttttttttgagacagagtctcgctcttttgcccaggctggagtgcagtggcgcgatctcagctcactgcaagctccgcctcccgggttcacgccattctcctgcctcagcctcccgagtagctggaactacaggcacccgtcacctcccctggctaatattttgtattttttttagtagagacggggtttccccatgttagccaggatggtctcgtctcctgacctcgtgatccacccgccacggcctcccaaagtgccgggattacaggcgtgagcccccgcgcccggccaaatgccattcttaattgtgaaatgctgtgcgcttttcaactgatgtcaaacaacaaaaagacaaaggtagccattctccattgttatttagcattgtacaggagttctgaaccagtgcaataaggtaagagggattggaaaggaaaaagtacaactgtcttaacagtttgcattaacatattcatagaaaatacaaaaaattggaaaagtactagaactattgaattaagttatcaagttgagaatatgtcaatattgcaaaatttattgtttgcccatatattaattagaaacaattggtaaataaaatttaaaatacaacatttacacacacacacacacacacacacacttccaagctctgtctgctgtgaagcctagacgcaatgaaacctctgtagcaatgaacacatctggtgatcagatctgggtttctactaccattctccaattaaaagaaaaagaattcttgcagaaatgactgatctatggttggggtgggaaaaatacaagatgagtctggaacatcttatatttacagaacacaaatgctcaaaaaccaaagtggtaggaatgtgtcagagacacagaagctaagggaataaactcccagtggccaaactgaacaatttgagcagcaaattaaataacatagcttagaattttaactcaaagcataaaataaatgtgcaagagtctatattgatatgaataaattattgtataaataaaaaatgggaaggaataaatctctatcaaagaatctcaaataatatgcagaaatggttccctcaggtaggtggaacataatctctttatccccttaagttgggctacatgcagtgacttactttcaaagagtgctgatacagtttggatatttgccccttccaaatctcgtgttgaaatttgatccccagtgttgcaggtggggcctggtgggagatgtttgggtcacgggggtggatccctcatgaatggctttgtgctgtccccatggtaaccaatgagttgtcactatataagttcccgcaagaactgcttgttaaaaagagtctggcacctttccctctctcttttcctgtactctcgtcctgtaatctcctcatgctggctcctgttcccttcctacttctgccatgagtggaagtagatgctggtgccatgcttcttgaacagcctacagaactatgggccaaaaaactgttttctttataaattacccagcctgaggtattcctttatagcaatgcaaaacagactatgacaagaacagcacagtgaaggttaaaaaaaggagttactttacaatggaaaaatcagacagataccacctcagggctgtaatcaagcttaacatattcaataataagtcatattgatagtatatactcttgataaaaagtaatgagagtggtactttacttctgtgggcttccttccaaaaatctcataatctaatctattcataagaaaaatatctatgaacccaattgagagacattctacaaaatacctgactaatactcaggttgaggttataaaaataatgtaaaaaattttcacaatctagaggatcctgtggaaacatggcaactaaatataatgtagtatcctggataggataacgggacagaaaaataacattagtaaaaactaaagaaatccaaaaagcacagaccttaattaataataatgcatcaatatttgttcacaaatgttaacaaatatatcatcctaactaatgtaacatggtaataatagaggaaactgggcatgggatctaggaaaattctctgtactgcctttgcaaatttcttgtagacctaaactattctaaaataaaaaggttatttttaaaatataacatgtacaagcatgcatccatacttaggaataaactaagagatatgacaacccctgaaaaacatagttctgagtaactgagtaactgaagaaggcaaataaattgatatactatgttcatggattagagcacttaatacctattttatgtttgttttgtatttaatgcttttcatattcttcagaaagtatggtagagagaactttgaattttgataaaggatatttatagcaaactcaagcaaacaccatatttattttggaaacattagaaatattctctttaaagccaggaataaactcaatttcatttaacattgcttttgttgaaacatcaagacaagaaaaagtggcagagtgtgtaagtactgacaggaagaaattaacatgttactattcctaggtggtgtaattatatgaagaaattataaagcatgaggactaaaatgagagtattttgggcaatgtaaaaaataatcatgttcttatgtattgacaatgaagtgttaaaaaataactaaaaggttataattttaaaagcctattttaataatgaagtataaataattaaatctaaaagatatgcaagaatttatgaggcatatgcctttgttaaatgatattaataatatttaaataaagagagtgatgcatcgtattcatggacagaaagactcagtagtttgagatgacagtttccccagtgctcatctttatattcaactcaagtttattttgtggaatttgacaagataattctaaactttatgaaaagccaattcccaagaatactaattaatactttaaacagaatttttaaactgtgtgtttggtaagttgtcctattaaatatcaagtctaatataaactgtactaaacaagacaacgtgatatcagtgcaggcatagacaaatagatcattagcatagaacttgaaaccgacccattaaatttcattacaaattattggaagtaattattcaattgtgaaatgaaaataaatgcctaccttacaaattacatgtacgtatacatatacaactgtacaaaactccaaggggactaaaacctaaacaagaaagcaaaactcttttatcagatagtataagaaaatatctttatgcacttgggtgagagaagaatttcttatggcaaagaagcatagagtattaagcaaacaaggttaaattttgtgaattaaaattatttatacatcaaaaagaatgccttgaagagtagaataaatgtttaaaatgcatatagctgacaaagtattcatcttcagaatattgtgtgtgtatgtgttaattgtgtgtgtataataaaaacaagcaaccttaaatggagaaaatatattaagaagcattttgcataaagaacatctgaatcatttattaaaatgcttaacctcactgtttatcaaggaagtacatgataagcaggaattaagtccaactttacaaccattatgtaagttaaaaaattagaagtgggtaaatactaagtgttggagaacatgtaaaacaataggaaatctcataaaattgctaataggtgcttcaaacagaatgaccacattggagagcaatttagtaatttgaatggggagcaatttagtaatttccaagtaattaccaagttatctcactcctaggaatataccctgtagaatagcttgcatatatatactatattagaaggtaatacacaatgattttttttttttgagagggagtctggctctgtagcctaggctggagtgcagtggcaccatttcagctggctgcaaactccgcctcctgggttcaagcaattctcctgcctcagcctcccgagtagccggaattaccggctcctgccaccctgccggctaattcttgtttttttagtagagatggggtttcaccatgttggccaggctggtcttgaactcctgacctcaggtgatccgccctatgcaatgattttcaatgcagagatgatctgtagtattgaaaacattagaaacaacctacatgtctagcaaagtagaatggataaatatattatgaaatactgaaatgaaaatgaaaaaaaccttgtctacatatacaagcatggagtatctcaaaaaaaacataaatttatacctgaaaaatgaagccaaactaagctacatgtgtatacttcaatatggtcattttgattatattttcatacatacagaatgaacatttatatcttaatatcaaactcaggaataaagcttaccttaagaaaggaagtttcatgtatttgtactgtttaatttcttaagatggtgatagttttttttagtgttacttataatccatgcatcttggtatgcctgtaacttttttttaataaaaaatacttcaaaaagaatgtctagtagtttaaagattcccttaacatatatatagatatatggagagatagatagataatatcattttttatgctgtattggcttaggtatctctcgagaatctaacgactcaataatttaaagtagcatttatatataagtgcttactgttgcaagtaaaatgtgagcctatcatttgtatgaaaattgaaaaactgtaggtttggacacttctgtgagatcacactggaccctcagatccttccttccaatgtgccatgcatctatgtacaccgacacctgaaaaactattaacccaaaatgtctcatcttttttgttctcattttataaaaatggtttattttatgggcactggtgaaaagtaatggttcaatgtataaatattgatttaaatcacatagcagcacaattctctaactttctaacatatgtgtaacaagatggagagtcatctgttttttgaagatagataaaaccaatatgttcatttaaaaatactgtactactgtatatacatgcccaaactactatggagactgtgaggggtaggatttaaaaggggtataagcaggctctgggatgctacttttgacttgagtgtggttacatgaatgtgtgcactttgtattaattcactgtacttcactcctataatttgtgcacttttttgcatatgtattgaataaaaagttaggaaaaggaggctcattattttatctttataatggaaaaaagtttatgattcagtaataagtaaagaagtgatttgtcagaataaaatgattacatcatcctttgtgcttagcaaaatgtttggttcattatatgctcccacaaaaagattcactgaatgaatgaatgcataaaccatgtaaaaaatatgtgcagtcaaaacatttagaagtaaatataaatgtagctaactgctaatagtgctgggtttgtgtgggggcgttatgggtggttgttttctctctttttcaaattttaaaataaataatggacttttaatgtcatcgtgggtgtagccagtcccataaggtgcttctatgatggaaatttctttcttgcttctgtcatagttatgcttcatagtgtgtgtatatatatacatatttctattttggagtttttcttaaaagtttgacagttagctgagaacatctggaccacctatagccagcccccatccccagatcagatcaaatggaattcccttttacctatatcatggaagctgcttatcatctcagtgatttttttcttcaagattattcatttttggttcttataactaggtattttaagtactggaaggcatagggttagagaaatcacatattaatgctgtagacattcatagtcctgcagactttttctgatgaaaaataaaagctttcatttaaagctttttgtctaacttctaacgttctcacctgtgatcaccaaatagatatgctctgcctgacacacttggcgtgttaaattttaaatttgtgaaggtttttgtttacttttaaataatcttttgaattaagatataacagccattcataacatacacaagtctgcagtgtccattaaaagattctgacatatgcatatacctgtgttactactacccagatcaaaaaatagaacaattttggtacccagaaggctccgtggtacctcctcacaatcagttaccaaccacctcccacccctgaccaaagatagtctatcagaattcagaagtcttttatcatcagaattgattttttcatgttattgaacttcatacaaacggaagtaattggtacatgttctattgtgtttgttttctttagctcataattatgtttatgagaaatatccatgttgttgctatgtaatattccattgtctcaattgtgaaaattaatgatgtgacttggggttattacagtcatacccaactagatgggagttaaggaccatggggaaaaagcactcaggtcacaaagctcctgctccaggaactgtctggcaagccaggctgcagaaataacttgctatatcttaaaacccattttacctagtaactgcttccatgtaactgctaccttccatgcctcaaagattagtttaccttccaccaagattagttttacctaccaccatcactcaacaattacagcttgccaaagctggaagaacttgtctaggccaatgaactttctttcaaaacattttacaaaacttttctcttaaccaataaaaccccaatcttttcttttgttctgtggacaccctgaagaccagccaggtctgtgtgtatgcaccaaattacaatttggtttttgcgtatatttccaaagaaaacctttctttgcatttgcatttctttgcattgttagacccaacttaacaaatgctttcatcctggcacataagccttatccacaactcatcataggtttgcaggagcacacttcatataaaagccacttaatgtggagatcttaagcttcccctcattgaaataatcacgtgcttcttttatcatcacagtttaaaaggcaggacagatgtgcctctctcgccaagaccatgttcccaaacagtaatgatggtaaactagttttatttttaatttaatatttttaagaacgggaatttccagtagttgttaaatcattatctgtttaagaagaatgtgaacttgaaataattgaggtggaacaagtccttaaagaatctcattatgactcatatatgagggtaataaggaagttaaaatgctcataatatttgtagaaaaaagtttggtgactatgtgtaaaataatgaaactgtactcaagtgagaatggttggtactacatgaaattaatcagattaacaatattgggaaaggagtttaacagctaaaaagagatttgagtttatattgttaaactgcacacgcatttttttaaatttgtgcaagaaaaatatgaaaaatacattgtttgaattaacttaattaacaaaaagtggcctaaaaagtagactaatagagaaattttcccaaggattaaagaataacctcaaatgggagagctgtatttaaaagtgagacataccagttatagactagaccagcagagggagctcaatatatttagccagtaaagacattgaagacagttaagattcttgttaagcagacacatatggaagaggataattacgtagttttattttaaatatgaattctcagacataaatatattcattaatgattacagataatttgagattccatcctctcaattttaattgactgccttagttgaattcaattattcgtattataagaacagaagtcagcctgtgcgacagactccgtctcaaaaaaaaaaagaacagaagtaaactatattcagcgtaagaagtgtgaataagtttaaaaaatacattaacacatatattagcatttttactgaattaaaaaaatacagcaatagaataatgagataaagttttgttgtagagtcgtgatagtggaccctgtgaataaaatacaacaacttaaccaagtgggagcaaaacattttatgattcttatgatagaaatatactaacaagttctaattttctttgtgcctatatagatgaacatcaaaatcacagctattttagctgataccattaaaaattaataaatattgaatctgatcattttaatggaaatgatatatgtttagaaatttggaagaataaaaagaaaaataccaaggtggacatgattaggtttgtaatacttaacttctgggatatttgaacaatgttcattgacactgcttgagactgtgaagaagtgagtgatagatgctcaaagtgatttcaaaaggaatacataatgatggagtatgtaggtaaggaaaggcttgcatgctgaaggagagaaataaaacttatggtgagagtgtgtttgcaatatcctgcaagcttttgcagaatgctattctataaagtctggctaaattgttaaggtaagaaatttaactggtgtagccatcttatagattgtgttataacagttttagtggtagactgatgaattatgtcataaaaaaggcactttcagaaaactggcaatctttaagtcttaatgggaaggaaatctgcctatgccctctcttttttccaagtcccttccctccctaccccataaagatgggtaagactttaaatctttccagctattgctgtgggaagtatttcatggacgcaatcatgtaaaagaaaaatatagagaagtatatttccaggtttttaggattacacatgtatagaaacaaaatgagaaaattgccagggctggaaatacaatttgagaagcctaaatagaacaaagccaatagtgattccttcaactgtggattttatggactgaatatgtacaaatgttgggtataaatcagggccaatttttccacaagaatctagaatatatcaaagtctaaaacaggattatagccactttagagaagaaattgcaccagaaccagactgtttctaaccaaatgacatacgtcttctctgcgtttacattcatatacacacattcatgttaacttagattgtatcatattgaagataattctatataatgcctccaaatttaaattcagttcttttccacaaatgcttattgtagttaagctatactaactttgaatagaatcacagagatgctggtaaatgacttatattgcatacatgagggaaacagctttttttttttaaatgatgcctgtataaagcctcttcctgttgagatagattccaacacacactcacacacacctctacacacacttacaccctcatatatgtaaaaatttgcatattagattgtttttcctagaaaatttactacctatttactattctaagtaaatagaacataattctctaatattggttttttaaactaataaatccttaagtattttatatcatcttttagttaatattaactttgagaagtatcacaaaccatacttactaaatttacaaagacaattctagctaatttaagaatcatcatctatacagtttcaaaaaaaataaaattggctgctagacaattttatagatgttcagtggttcatgtgtctatttctgcattttattacagttaaattgcccaataaaagctaaagggcaaagcagagataccatgtgctctttagaaaaagctataaaatttaagacagaagaaatttggtctgtaatgacaatttttatgtttttctggctttaataacttgattatataaaatgttttcaaatacagttgataaaatctataagtataatgttttggcaaataccatattcatttgaaaaagtaatcgaattgaatatttaaaataacattataaacaaatttgtaagtggggtacagagtaaacatgtaagtatttactactctgcttatgtctggatattaaagattattggaaaaaaataattgctatggtgacattttagcttttaatttgaagtttaatattagattgttgaatggagaaaatcaatgttgttttcacttatatttatatactctaatataccatctctaactgaaatgttattacctgcaggtgactgtaatttaattatactattaattttacattttaaaatcttgttatactaatttgggttttaaattacataaaatgttgccattaatgtaattacagattactctagtgtgaaacttgttgcaaagtaaaatgcctaccatggtcgtctctgcgatagagccaaagctgttgatgaatatgttgcatgtgacattaactggagggcctgaaaaagagatgaaaacataagggctgtttagagacttatctaaaacattttcaaataattccttgcattccattattattattccattttacacacacacacacacacacacacacacacacagatgcttaaaattgaagcaataattccacacaacaatatgtactgagaatcacaaggttcacaaggaacactgatgctgatcatttttttacctctcttggtcttagtttttaaaatctagatgtctctaatggctctgtaatgcctgatgctgtaagtccagtttctaagctcattcagggatagtttctattgatcttttccccgctgcatgggctatacttttctatttctttgcatgtcttatatttttttttgttgaaaattgaatactttaggtaacataaagtggcaactctggaaaccaggccttcccacctccaatccaaagtttgttgttgctggtttttcttgcagttgttgtttgttctttagtgacttacctggaccaatatggtaaagttttcatttccctagagtgcacagccagtgaaatctccatttagtgagcttagtggtaaactaatatttgattagagatttctttaaagccttgagccaataaatcttccactcttgccaagggtcttccatgggtttggggacatgtcttcagtgctcaggcagtttacaactctaccttacccttcacttcctgcttgcacagagcctgatgtccaccagaagtgagatactgggactctctgaggacttccctggacaggcacacagccctatgtgcatatgtaaactccagattgcaaggatatgttagagcttttcagagctgcctaagaacatagaattttccaggtcctttataatttttgttcaggctcttacttgtcccaactagtgtcacagccttaggcagctacaatgttaaacaatcttctaattattttccacaaatgccctagagatagaaatttttcccaccaagtgagttcttagtgaagtcaaataatggaaagctctttgagtgaggctcttccagggagctaccagacaggcagaatactgacaaagctctggggatggaccttctgaggaattccaaacttggtcagccagctctggtggttttacaacttctattgtttaggggtggctggattgcaaggctgctgtggaactgggaaggtcggtgaaattaatatcccttctgttcttacagaaattcatcagtttttcttgaataaacactcttcaggttgttgtaagctttttatcaattttaaaagttctaacggttaatcttgacaattttgccaatgtttttgttgcttttttggagaagtgaacttattgagtttctcactcctccattctggaaatttcttattaatgcccgacttagtattcatcataaatccaaggatttttatttttataaggcccatttattcattcctttactaaatatccaaagcctttgcacacaaaactgaagaagacacaaaaagattatcatctagcagagaaggaggagcagaaattggtaaattgttgtaagtttcttgctgccaggcactaccttagctgattcatagatatttaatccatagtaactctgaaagagggaaatattccatcattaacattttagggaattaaagcacagtgaccctacgtaagatgccagtaggtagcacatttagaacgtgaaccattgctctgattctagaaatcattcttttcccaccaccttgtttatatgaccttcaaaacatttcattatctggccacaaactttgttattaggcagatacctgtataaatagaaacgtaaaaatattttgtgctaggggctaaaatagctctgagttacactctatgtaagttagtcggagaacaccacatacagaaactaatatctaagactaatttctttgtttttttttaaactgagcgtaatttttgagtaaattgatcttacaaggtttgctacaaaaatgcctagtagccccttgacttatttctgtttccctctttttcagagataattacttcaattcatttaatcatcaattcttcggatatttacctcaatttctctacataatatgttttttcttttagacacatcttctgatgcccacaaagaagataaagatttagccttttttcatacatcatccctatctctactaacataagccttttttctgtcttcctgttatccaatatttttgtatgaaaaaaggcttggtcttttttgttagatcaatattcactttttacattaatatgacaaggtagatatttaccccagccaaacaatagaatatgttatgcttactttttcctttcctgcagaacattttcctgatattggcaattgcttcatatataatatttcacatagctttctccacatgaatcgttaacttatccacaagccctgaaatgtctaagttttgattcaatatgtacagatccatcaggttctctatgaactttaccttcctctggatttacagaggaatgtaatgagaatgttttgctctggttcaaagcaatcgttctatgacctcccaatcatgctaggaattacttccatagctttctgttgtgggatcctcgttcatggtcccatacttctttcttggtttatttcttcattttagtggaacatatgctccagtaatgttttgacaaatgctgcataaggctatgaagcttttgagagagtccttgttcatcaatgtctgtttttttgcattcacacttaatgtatagctagagttggtagaaacttttaggctggaaatgttttcttcttatgaattttgaagatactttttcactattttctatttttcagcattgccattgaaaagcccaaagccattttgtagatgacctgtttttctttctgaaaataaataggatgtttcatttgttccaatattttttaaaaactatttcattagttagaatggtctaaaatatcatttgaagttgcaatttacatttatttgattactggttcatgattttcatcttaatttgcttttcaacctattctctagatggctatttatcttgctgaattaaggtagaggaaaaatcaataaaattatttaaaaataaagtttaggtttcaaaggcctttaaatcctatactacacattgaaatcacctggcaatctttacaaaccatagatgcttaattctcacctatgttacttggtatggcatgcaaccaaggcatcagtatttttaaaagcttcctaggtcattataatgtgcaagaatgcttggaaaccactatcctaaggaattacagactagaaaatatctggggccattatactacagggttatcagagattttcttagaaatagaaaaatacagagagaggagtcagggcttgggagcattgaaaattccaggctattaatttcattaaaagcgttgcctattataaattcggtgaacactgttaataaaacagagtagatgctatgtactttgaaagggcctaaagtttactaaacataggaatgtctagaacacataattcaaacatgtatagaagttaaattgttttaaatatgaaggatgaacatgtaataataagaaccttataaaagacctgcatcctaggggcgctgtatttagttactaatgaacattttaaaatatcttcattgcttatttctgaacatttacaaatttctaaaatttgtaagatgagagcagtgtgttatgtgccactatgtgggagaggagtaaacttagtttactccatgattaaaacaaaattccatatatacaccatggaatactatgcagccataaaaaatgaaagagttcatgtcctttgtagggacatggatgaaactggaaaccatcattctcagcaaactatcgcaaggacaaaaaaccaaaaaccacatgttctcactcataggtgggaactgaacaatgagaacacatggacacaggaaagagaacattacactctgggaactgttgtggggtggggggaggggggatggatagcattaggagatatacctaatgctaaatgacgagttaatgggtgcagcacaccaacatggcacatgtatacatatgtaacaaacctgcacattgtgcacatgtaacttaaaacttaaagtataataatgataaaataaaaaaataaataaatgaaatttccgtcctaaaaaaggatgaggttacaactgtcagaagataattttttcttaatgtgagtctaatatgaactctgaaaagtatctgtaggctgactggcatccttgaaaagctaaaaccaatctttcatattttctaggttattctctttttccaccagataatactagactcctactattttctttttttttttcttggaatagcaatatgaatctgagaaacattatttggcttgagataaattctgtcatgctctattgactcatatcctctggaaaaaggaaaacataagaacatcagtattgggttaattcacctgtaaataaaatgctgatggggtacagccatgttgggggaacatggcccaggaggaagctactattagaccactgctagctgcacctgattgggatctttttggctgaaacggaaataaataaaagagtggggagataatttttcttattttagtttagaaagggaaggggtctttatttcttggattttagtttgtcacaggcattgaataaaggatgaggcattctctataatacattttgtctcgtcttttaaatttaattagtttctatatatttatggacaattgtggtgaaagaggcaaaatggaggcaaaaattcagcataggcttcaaggttctgaagttagtgaaatctgtgctggcacatttcagtgtcccttgggagcaagtgttatgtggcacatcctaatgagtccattaaggttctgaaaggagcagtgttaggtaccgtctttggaggagcaaacttctgatatatttgttttctttctaaaatatggtgctgacatccctggttgaccagaggctcaaatagtaaggccgatggatgaaatacagaaaataacatcatttccacagaagaataatggtcaaagaattgactaatttaggctttcactaataggtgggatcataatgcctcattgtatttgaaacagacttcagcctcagcctccataacattcctccaataagaagcagaaagctcttcctaaaggtgaaaagttgcctggcttcaaaacctaaatttcacgtgcaagtaaagtaactcacaatggtctcaggcctaaactttattctccacctggttataacatgttccttgattggatgttagaacataaaaaagtgtgatttggttcccatttgactatttacttgtgtatatattttcttcttcagcagaaagaagggtgaatgaatttggacatcaaatcctaattccaaatttcaaaactatggtagacacttacttgaaaggcagatagatagacacatatgcataaataagaataacttaaaattttaaaatattcaaataaaaaacagtttggaaataaaaatcatttcagatcatagagtctcctcaatgtaataacaaggtatttgggatttactttaggaaagctttggagccataacagattcttaaccttggaagtgtaggaactaacatgactcgtgaatgtttgcatgaacaggcaaaagcatagagacagaaaaaacagaaatttatgataatagtctgggatggggacagaatggacctgaccccgaaggacaatgacagtccttggagatagattacaaagaatgaaatggatacagcatcataatattttaaaggtatcacgttctaccccttcggtttctggtgcacatgagattagtgcagcaatcttggagtagtctttctatcctagctttgaaatagacattcaaaaattgtgtagagaacgaagctcagagaagattatgaatcttctattgccattacagagagcacctgtttagtagctcttggccaatctgctacttctctgtgccaatgcaaaagctgttatatctatccaatacactcctatgttaagcaacagagcaaataactgctatagcatccatatggcaaattgtgcttttaaattgttcacgactttaggcatagtccttaaaagcaaatgacagtagttgcagatgttttcagcagtaagttttcgtttagatgttttttttttttaaagaaatagaagatggcccttaagtttaagaaatgaagtgatggcagaatagcaaagtacaatgcaaaatcttggcaacgatattattgttattcatattggggaaaaattgttcactaggcagacctagagcaagtaagaaaacaaacaaacaactcatatgttcataaaaatgactaaggaagttttcagggagtgttgtattaaagttttatctttttaaagacacagaatgcaactaaaagattaaatttcaaaataattccaactagagacttgttttattttagataaatgcacacacatgtcacaaggagagacgttattttattttttattcacaaagcatatttgatgacttaaaatccagattttaaattatctgttaggtgctttaaaaaggtttgtaaattatggcatagaagcagaatcctgtttgttcttcccctttctctttcccttcccttctcttcccttcccccaaatgctgcactaaagtcatttgtttgggcagtgcaaaataggcttaagtgctgggatggctgagggggtcgtagtaacctaaggcaggagagaaggacattgtggaaaagctccacatgcaggaaatgttggaggtccggtgagagaggaaaatgtacacccacaatagggaagcctgttgttgggtgttagaaccatagatgggcaaggtgtgtgtctccatggggccatcctggcttgcagagttggagtctgaacaggcatctacacaaggagatgaacctgaggaaggcttcagagtcccaccaggccaaggaaggtacttgtgtaaaagaagaagtagcagcaaacaagggagattcattacatattgattaaataagtaattatattgaggataatgggagcctggtttcttgctgttggaagaggaagttaaaatatggaaacttagaaactagactaaacatatggtattgacagtgtgaattcatggttttcaatagatacagaagtatagaagaaaatcgatgtgtaaatgtatgtgtgtgtgtatgtgtgtgtgtgtgtatgtgtgtgtgtgcatgcatatgtgtgtgtttatttatgcttatatgtgtgggtatatatagatatatcctggcaggcaccaacttaatcaggtaatcataacctgtaatggcaaaatctgacatggtccaccatcaaatagaatgcagtcaaaacacatcatcattcctgtaatatccctgctaaatgcactacctaatttgaatcatgaggaagaatcagacaaatgcaaagtgaagtatattcttctaaataactgaataagaatatttttaaatgtcaacatcatgacagtcacagaaagaataaagtgctggttcagactgaaaaagacaatgagaaatgacaaataaaatatgatgtgattctaaactgaatacttttataataaattatcagagagtggatgaaatttgaataaagatcagcaaattagaaggtagcaatctattcaactacttttcttgttataatggttagattgtgattatcaaggagaatgtttttatttgtagtaaatactcaagtattggggcatcaggtcaacaacttacattgaagtggttcagaaaaaaagcttttgcacttgtaacacttctgttagtttgagattattgtaaaatacaaaaaagagaaataattactacagaaataattaattaaaaacaaaaagcaaatacaaacaaaaaatacagggtttagaatctaaccccatcaacatttcaaatgaacatgtatagttttagaagagcttattattcaagagatacttcttgttaaagtgacctcgtactaagtaaaaatgcaaacagaaatgtaccattttcaaaaataattgtaaatgttattcaagaacaatagtgtcttggtggataggaatagtaaaaatgggtaaaggagacctttaaaatgctaacatttaccctaataaaaatgcatgtagaaaatgagtttgggtacacatgccacccttggcatggatgttgttgtagaatagagtactagaaagagtcaatttgtgatgaagggagaaaaggattagtgaaatatttaagggtaaaagacagaaaccacaaatacatcgtgagggcaaacaaaagttatatctacatacaaagagagtggccattggagataacataagaaaacaaaaatgcaataaatacttgggaggaagacagaattgggtgattactgaaggaatactttctgaagttgcacttatgagtcataagagggaccccaagattaggatcaaaagaaagaagtaaaatccagcagtggtgggtaaaatattctagtgaaataatgttttgttgtcttataaacatacttttacttgcaattcaattgttttatgttaaacatgcttctagtttcagatgacaccttgaagcttctatttcaagacagagaattgaacgtcattttctttctttctgaagacataaaaatgacattacataataaaattttagtgagaataaatgtatcataccaaaaataatggaaaaaaaataataattagtttaatgacataaaatatagagccagataaaaatggttgacaaatgaaacagaggtaagcctaaaataaaagcaagcagggactgcatggagaggggaaggaggtggagagtgagaaggggaccccagggatagggcctggcatctgtcttgagagctttctgcttcccctctgtatttctgttgagcaacggttgcctggtatttagccctatggaatttttgaggaaatggaaataacttctttgatgattagggcaaacacagtacctgaaaatacctcaaaccttaagcctgctctatttcaccatctgcaggacccaagaataatgcctagtcgaagctcaacactcacctaaagcaaagctctggccagggcaatgcagcctgtgtcagagttccctttcgaagtagagaaataacagaaaaatggccctcctatagcacccaagctaatcacccctcaattcttcctgaatcacagacattctatcacacataagaaaactagtggtttaaagagaatgaacaatataaataaacataatttatcctgcaggaagaagcaacaaatcattgggcagagaagaaaaacaaaaggggcagaatgcaataaaagacgcattaaattagcagtctacttagtgcaaaggaatctcgtaatgcctgtgttgtgaaaggcctagaaagcaatcaaacaaattagaacagacaatcaacagaaataaccaatttttttggagtgtttgcctcaaagaagtagaactgtgcatcgttagtgttgagggtgaaccgctgcttttcatcattgacacttgtagacatttttttagcagcttcagggacatgattgttactattgtcataaataaaactgacaagcaaataaacatacaaaatagcacctgcgtagcagcttgtaacacaacgtccacaacttcgcattcaaggaaaatggtttaagataaagaggattgtgaagagaccaaaacacaattacagagttaaaatctccctaaacattcacaaattggataaatggcaccatgtaactgaggacaaatctgaacaattctgtttataatgtagagggaaaggagaaaggagagaaggggatgagggcaatgtgttagacacagatgactggggaagatagcagattttttaaaaataaagaatattgttttacagaaatgacacaaaacagtgccagcataagcaaaaatcctcctactgaaaaatgtccagagataggcagaaaaaaatagcctatatataaaggagcagaaatcaaaatgagatttgacttctttatgatattaaatgtcagtaggcaatgaatcaacatctgcaaacttctgagctagaattctggagctcgataattgtataaagtttctttaatgtcaaatgcatacaaaacagattatcctggaatattattcaatgatgaaaagaaatgagctatcaagccacgaaaagacacagaggaacctgaaaagcatattgctacctgaaagaagccaatttgaaaaagtctacatactctatgattctaattatatgacatcctggaaaaggcaaaactctagagacagtgaaaagatcattgattgccagagactgggggtagatgaggggaagtgggagagagatatactcataccacaagcacaggagattttagggcagtgaaattattctgtatgatacagtaatgacaaacacacgttgttatgaatttgtcaaaacccataaaaaatgtacagcacaaaaatgaactctaatgtaaattatggatttcagttcataacgtactaatcttggttcatcaataataataaatataccacatgaatatgaagatgccaataacagggtacactgttggggaggagagggcagatatgcactttccaatcaattattctgtaaacctaaaactgctctttaaaacaagtctattaatttaaaaaagtcagaaaaaccagaactcagaaaatatataagcattactcctgtcttgaaaatgaaaacctattttattttattttattttgtttttcagcaaatggagacaaagctagaatatcctactgtttagtcttcaagttataatttatatgtgtgtgtatgtatgtatatatatatataaagaaactaccagtttcaaggattattaagtcttcccttaattcttaacctggccctccaactctgtaacatcgttaggcagtgcctcccagtgagcgccaaggcctgtggtctgcgcctggggatgtggtgctttctctcactgggccggttctgtttctgctcttttccctaaccagaaaggcttctaaagagaaaagatttccaattctgagaaagaaatggtggaatctacctattattttcattttcaaaataaaaataactatttcttttcttttctttttttttctttttttgcttttaccatgtctcatatatttttctcagccacatcatgggataaaacaataacaagctaaccagatctgatgtgaggttggtaaaagaaaaaaaacacaggggggatgagccaagatggccgaataggaacagctcctgtctacagctcccagcgtgaccgatgcagaagacgggtgatttctgcatttccacctgaggtaccgggttcatctcactggggagtgccagacagtgggcgcaggtcagtgggtgcacgcaccgtgcgcgagccgaagcagggcgaggcattgcctcacttgggaagtgcaaggggtcagggagttccctttccgagtcaaagaaaggggtgacgcacctggaaaatcgggtcactcccacccgaatactgcgcttttccgacaggcttaaaaaacggcgcaccacgaggttataccccgcacctggcttggagggtcctaccccacggagtctcgctgattgctagcacagcagtctgagatcaaactgcaaggcggcagtgaggctgggggaggggcgcccgccattgcccaggcttgcttaggtaaacaaagcagccgggaagctccaactgggtggagcccaccacagctcaaggaggcctgcctgcctctgtaggctccacctctgggggcagggcacagacaaacaaaaagacagcagtaacttctgcagacttaaatgtccctgtctgacagctttgaagagagcagtggttctcccagcacgcagctggagatctgagaacgggcagactgcttcctcaagtgggtccctgacccccaagcagcctaactgggaggcaccccccagcaggggcacactgacacctcacacggcagggtactccaacagacctgcagctgagggtcctgtctgttagaaggaaaactaacaaacagaaagaacatccacaccaaaaacccatctgtacatcaccatcatcaaagaccaaaagtagataaaaccacaaagatggggaaaaaacagaacagaaaaactcgaaactctaaaaagcagagtgactctcctcttccaaaggaacacagttcctaccagcaacggaacaaagctggacggagaatgactttgacgagctgagagaaggcggcttcagatgatcaaattactctgagctaagggaggacattcaaaccaaaggcaaagaagttgaaaactttgaaaaaaatttagaagaatgtataactagaataaccaatacagagaagtgcttaaaggagctgacggagctgaaaaccaaggctcgagaactacatgaagaatgcagaagcctcaggagccgatgcgatcaactggaagaaagggtatcagagatggaagatgaaatgaatgaaatgaagcaagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaagatatcatccaggagaacttccccaatctagcaaggcaggccaacgttcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagtggatctctcagcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagctgctgcaaaatcatgccaaaatgtaaagaccatcgagactaggaagaaactgcatcaactaaccagcaaaagaaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacatgcagagacacacataggctcaaaataaaaggatggaggaagatctaccaagcaaatggaaaacaaaaaaagtcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccacattcataaagcaagtcctgagtgacctacaaagagacgtagacacccacacaataatgatgggagactttaacaccccactgtcaacattagacggatcaacgagacagaaagtcaaaaaggatacccaggaattgaactcagctctgcaccaagtggacctaatagacatctatagaactctccaccccaaatcaacagaatatacatttttttcagcaccgtaccacacctattccaaaattgaccacatacttggaagtaaagctctcctcagcaaatgtaaaagaacagagattataacaaactatctctcagaccacagtgcaatcaaactagaactcaggattaagaatctcactcaaaaccgctcaactacatagaaactgaacaacctgctcctgaatgactactgggtacataacgaaatgaaggcagaaataaagatgttctttgaaaccaatgagaacaaagacacaacataccagaatctctgggatgcattcaaagcagtgtgtagagggaaatttatagcactaaatgcccacaagagaaagcaggaaagatccaaaattgacaccctaacatcactattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgagaaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacatgctctgcaattgtggcaataatcaatagcttaccaaccaaaaagagtccaggaccaaaaatggattcacagccgaattctaccagaggtataaggaggagctggtaccattccttctgaaactattccaatcaatagaaaaagagggaatccttcctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactctctataaattaggtattcatgggacgtatttcaaaataataagagctatctatgacaaacccacagccaatatcatactgaatggggaaaaactggaagcattccctttgaaaactggcacaagacagggatgccctctctcaccactcctattcaacatagtgttggaagttctggccagggaaattaggcaggagaaggaaataaagggtattcaattaggaaaagaggaagtcaaattgtccctgtttgcaggcgacatgattgtatatctagaaaaccccattgtctcagcccaaaatctccttaagctgataagcaacttcagcaaagtctcaggatacaatatcaatgtacaaaaatcacaagcattcttatacaccaacaacagacaaaaagagagccaaatcatgagtgaaatcccattcacaattgtttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcctgaaaatggccatactgcccaaggtaatttacagattcaatgccatccccatcaagctaccaatgactttcttcacagaattggaaaaaactactttaaagttcacatggaaccaaaaaagagcctgcatcaccaactcaatcctaagccaaaagaacaaagctggaagcatcacacgacctgacttccaactatactacaaggctacagtaaacaaaacagcatggtactggtaccaaaacagagatatagatcaatggaacagaacagagccctcagaaataacgccgcgtatctacaactatctgatctttgacaaacctgagaaaaacaaacaatggggaaaggattccctatttaataagtggtgctgggaaaactggctagccatatgtagaaagctgaaactggaacccttccttacaccttatacaaaaatcaattcaggatggattaaagacttacatgttagacctaaaaccataaaaaccctagaagaaaacctaggcattaccattcaggacataggcatgggcaaggacttcatgtctaaaacaccaaaagcaacggcaacaaaagccaaaattgacaaatgggacctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaagacacatgaaaaaatgctcatcatcactggccatcagagaaatgcaaatcaaaaccacaatgagataccatctcacaccagttagagtggcaatcattaaaaagtcaggaatcaacaggtgctggagaggatgtggaggaataggaacacttttacactgttggtggtactgtaaactagttcaaccattgtggaagtcagtgtggcgattcctcagggatctagaactagaaataccatttgatccagccatcccattactgggtatatacccaaaggactataaatcatgctgctataaagacacatgcacacgtatgtttattgcggcattattcacatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaccaaacaccgcatattctcactcataggtgggaattgaacaatgagatcacatggacacaggaaggggaatatcacactctggggactgttgtggggtgcggggaggggggagggatagcattgggagatatacctaatgctagatgacgagttagtgggtgcagcacaccagcatggcacatgtatacatatgtaactaacctgcacaatgtgcacatgtaccctaaaacttaaagtataattaaaaaaaaaatacaaaaaaaaaaccaaaaacacaaagaacccctaataacatcaaaacttagatgcaaattcactattcttaccaatgacctgtgcctaagtgaacataaaatcaaccatttctatacataacatttctcttccttaagaccaaatttttgaaataatgacttggacaaaattctaatttctattgcatgatcaactggttgagtgatattttcagctttactttctaattctttttagcagctctcagaacatttctaaacccatatatcattattaaatgccttttaaataatagtttttaaaatcattatatttaataggactaagatataatagaaatttgaagtagtttttatacttatgtcaaattatcctaaaggcacaggatcattagtggagaaatctgattctcaaaaatgtttcagataaattaatactattctggaggggaagagaacagattaatcagtgaaaaggaaagataatgttaatgagttaagcacctaattattttaacttatttcagtattgatttaaataatgttcgatggaagaggctgtcttatccatggtcaataccaatttaaattgctttaagagaattatttatttatacttttctgtggtacattttaataacattaaactacttagtcttcaagaggtgagatttttttaaagtgtactttttaaagagaaatgacaaaacaataaaaacaaacaccataattttggttaagtaaaaaaatctacttctaaatttttgtaaatgttagaagtagaaagcagcaaaatcaaagttgcatttttacaaagtcgtttgtattttttaatagttgttttcccactatggccttcaaaataaattttctttcaatataaagatacttgtgaaaacaatcacaaattttatactattactccagaaataaattcataattatgtatataatgctggaacatttcttatttttaaatatttgaaaggcaaaaatgttatattactgttatacactttgcttttggctaatgagattaaacatttccatttcgtttctgttaattgtctgataatgtccatactgaaattttatgtttgccttttacaaaactttgaagtccagagagggcaaacagataggtattttccaatgctttcatattttataagcacctttctatcagctgattacttatctaggtaagttatgtttctgtgtgtttaggaagaagtgaggatcaaatcatttaggttatagtaatatatttttacatatatcacaattcccattcttcttcttttttaagagatagagtcttactgtgttgcccaggctggagtgcagtggcacaaccatagctcactgtaacctcaaacaactgggctcaagtaatcctcctgcctcagcctcccaagaagccaggactaaaggtgtgtgccaccatgcctggctagtttttttttttttttttttttttggatagatgggtgtctcagagctggtctcaaactcctagcctcaatcaatcctcctgcctcagcctcccaaagtgctgggattagaggcatgagacccattcttcttttaaaattattttagctaattatgctcatttttaaaattttaatatatattactgatattcatgtctctaaacttgcttactattaattcattgtctttgacaattggataggaaagcatacataacaccaattttaaattagttcatttgatgagctaactagattccttccaaaaacattgatgtggggaaaggcacaaaatcaacaaggcaagggattgtatttttagtcatgtgaactaccacagagaaaaaatgagtgcaatattatcaggagaacaggttcttcattttctacatctatgtttgatgagcttatttttgcctgaggtgaggtgggcccctaggtacatgacgacacaagggctgatcattctcacctccttttgtgtaaatgtcttctgttaggtattggattcagtttgttagcacctaaatatcctcctgatagccgtaaggaagaaatagcatgtaaatactattttatttatatttcaatattgggtaatgaaatgatggtcaaaagatgatgatgttattttatccaatgaaatgacacggtgttgaatatacttaattagggagtagagttataagtatgtttgctgaagtcaataatgtttgacctttgcaaaagatgacaaagcaaaagtgttagctaaaaactaatccattaaattattactttttataattgatattatttttggctatcaaatgcagcctgaattttttttctaatgttcagagcacaagatattttgaaaaacaatgagagaaaatcttcctttttctttttcttcctttagtgacactggggtgtaagaatgaattttagtctcccccaaaatctaatcacctctgaactggcttggtgatcagcttgtttttaggaatacatttttacttagaaaagaatcagtatttgttttaagcaacaccaaatccttgggggtcctttcctgatcttacatataaatagtaataatcacatttttaaatagtttaatgtttctgttatcttttaaactattaaaaaaataaactaacactaaactttccaagagaatggcaaaagcactgaggccactcttgtgtggttggtaacttatctgcagttttattaaaataactgctgagactgtttatatgctttttaaatattcacagacatttaaaaatagaatgcattttcttctttaattttcagttaaaagaaagaaatacttctgaatcactgaatatggactcaccataatgaatctgctaattcccgattatgtgtcttgtggtttagttaaatgacaactgcatatttttgaagatcaactactaattagttctcagcggattcacaggaatactgctttccctcaatttggaaaagatcattataatactgaaatttctcattttcatttgtatattgtaccctgtaagctgtactatttttgtttctcattttcatttgtatattgtaccctgtaagctgtactatttttgtttctcattttcatttgtatattgtaccctgtaagctgtactatttttgtttctcattttcatttgtatattgtaccctgtaagctgtactatttttgtttctcattttcatttgtatattgtaccctgtaagctgtgctatttttgcacaacttgtactcagtgctttcctcctgaagttgaaaatatttatggttgaaagcttaaaaacaaatcaagacatgtgatccacaatttaaatattaaactcattttaaaattgaagccattcataattttccactcagacattatcagtgagttttacttcttttgttcctgctacccaatcttgatatttttttactccattctagttatttcacccactgctaagcatttctttttttcttccataaggacaaattcaaggaaaaatggtagttatagacaacacttttttaaactttagcaatgaaacagcttaactgaatcccatgaaaaaagtgtatgttctttaactttgtttattttctttattgggtaaagtaatattcaagaacatgttaaataagttgggatctggaagcagctttctaatattttaccattaaagtgaaattacaggatatattgtggttctggataagttacatatccttatataaacatgttacttacaactatattaaacagaagaataaaaagtggtactcttaaataattgacaattacactctttcctagaaatttgggtaaaacatttggtaggtgcaataatgtcttatacatttcaaaggctgtcagttagcaatccagactgtttcccaataggtaaattcaacaacggttagattccccacaatatagacagtagtaaagtggctgattaaaaagatgggaaagtttatcactagcaattaaagaagcttccattccagttagataactgatagaataattaaataaaggatacgtacatatatgtatattcctaaaatcaatggtcaagacaagaagtattataacagttagagaagtaaaaaaaaaaaaaaaaaaaaaagacatagctgggccaaagaaggcaaattatgataattgagaacatgggaatggatttctttttcaagacaccttggtgactaatgcaatatttggaagattgttgaaaataagcattagaatttctggtggaattaatttaaaactgtaccttgttgaagtatatttaaaacacacatataaagtagcaaacagaacaattacctttaaaattgggtctgattcttgcatcatatcctgatgtcctgcccattaatttatccagaaaatcagaaggtgacattggagcacttcgagatcttgcactgtctgtttcctttgtggcaaccaaactacaaataagaacaaaaatatagactttacaaaaagaagtatttctaataattgttacctacaaatataaaatagaaatgctgagctaaatatctttggcaacaaaacataaacctttagatatcatacagtgaagattataataagatagacatttatagatttatagtcaatacttgtaaggtttcatatctattcagtccaattgtcagaggtggcattcttttgtattagacctgaaaacaaaggccacttccaaaatattaagctttcaaatctgtgtttacaaaagccttatttctgatagcaatttttaaccaaatgtatccttattgctttaggtgtaagaaaacattaaaattcaactgtgaactacaatcttattgcttttattgagggaaaacatctcttttcaggttttgtgaattattcttagcagtaaaaaacttctgtctaataaattaaacaatgtttttttcttcaattagagtgcttcctgaattagcaacacacaaagttaaattcattctgcttttacctacatgtcattagtctacaatacctttcgttcagatctaaaatttgtgtgtcaagattgagaaattgccataaatgtaccatgtgcacctggatattatattagtagaacctgtgtccaggaaaggtagtgtgttcctatattcttttcattcaattttttcctttgtgtccagccacttatcctagaaacccatagtgtaggctgcttctcctgtccagctcttcacttacatagccttctccaacagaagctggggcctgcttgttaagatcaaatgattctttttatccacagagttttgctcaggaaagtgacactgactttctggaactgatgtgttcaagctgatgtcacttcctgaagatcatcaatcatcacatgctcccagctctgtcattcaactcaggacattgccaaatcaaaccatttgggtcaccacatgatcataacaagatcagttattaaattccttagatttctcctgccagaattttagtgagaagtacaactggggcttagagccatcatcattaagttgtttaccacagggatatatgcagtgattcatgggcacagttttaaaatctcatcaatcttggtgataatatgagaatgagatttctgtaagcacagaatcacaaataacactatctattagctgttgccctgttctagaggttctgtctggttctgggcactctgagtcacttgtttccccagtgactctcattctgtcattctcgctttcttccagaatggaagcgttttttctccctattctgttggctccatgtgacttcgtgatcctttatctctgattattattgctcaaccaaactgtcattgtgatcattgggaagtttattctaatacaaaaatcattataataataaatatatttttttaaaaaaacctatcttctcaatgactctagagctttattctaccatctggttttaagtaactttttcctctcctatcaagaagcatttgtttatattccatggttcaagaatagtgtggaaaagcatcgttggattttgtagctacatgctgctgcttttaaaccattctctttatttcccttgcaaaatctctcctttcaattatcagaaaataaacttctacctcctcctaccaacaaatataccaatttatcttgacctgaaccaataatactctgcctccttctcttttaaaaatactagacgatggccgggtgcggtggctcacgcctgtaatcccagcactttgggaggccgaagcgggtggatcacgaggtaaggagatcgagaccattctggctaacatggtgaaaccgggtctctactaaaaaatacaaaaaaaaaaaaaaaaaaaaagaaagaaattagccgggcgtagtggcgggctcctgtagtcccagctactgggaaggctgaggcaggagaatggcgtgaacctgggaggtggggcttgcagtgagccgagatcacgcgacggcactgcagcctggaccacacagcgagactccatctcaaaaaaaaaaaaaaaatactagatgactatgtatactgaaccacaatccttcacattgtgcacagaatgtgggaacgttatcctagattatcaagggcagttctatatgcaacaacatgtaaggatatatgtatgtataaagatacatgaaacagtatccttataaggatatttatccttataaaaaggaggcagaattatatttgatgacagacagaagagggaaggcaatgtgaccatggagacaggaattggggtgacgcggccacagcaaaggaatgctggcagccaccagaagctggaagagaaaaggaatggattcttccccagagtttctggaggtagcacggacctactcacaccttgattttgacccagtgaactgattccagacttctggcctgcagaactgttagagaatagatttctgttctttgtggtaatttgctacagttgccattggaaacgaataccaaccttctattgaatttttcatgtctgtcatgctgcttttcaaccccagaattactctttggttctttttttataatctctatctcattatttcctttttggtgggacactatcatactttctttttagctctttgtacatggtttcctttaatttttaaaatgtgcttaaaatagttgatttgaagtctttgtcttgtaattgcaatgtctttgcctccctaagcatgcttctattgattgcatttttcctgtgtttggtccatatattttcgtttctttgagaaacttgtaacttttattgaaaactggacattttaagtaatatactgtggcgactatggaaatcatattgtcttttctccccagagtttggtgttgttgctcttttttaaatggacttttttgaactaattctgtaaagtctactttctttataatatgtgacaattagaatatctacttggttagcttagaggtcagctactaattgaacatggattttattaatttctagaaccaataagtgactcagtatttgctgggggttctgtgtcatggggtcataccttcaacactatgtcaggcagttgattactctggactttactttcacttgtgtgaggcctaaaagtcagccagagttgagcactaagggtgttttcaggtctttcctgagcatgcacacaaccctgggtgtactactttgctagtgctgccatgacatagtatcaagaacaggtggctaatgcaacagaaattaactttcccacaattctaaaagtccaagatcaagttgtcagcagggttggtttcctccgaggccctcccttgttggcttgtagatgtccattttctgtttttttttaatgatcttttcttcacgtgtgtctgttctaacttcttcttataagcacacaaggcatattggattagggcatattgttttacatcaattacctcttggtaaggtaacagaccttacctccaaataaagtcatgtctggaggtactggcaggtaggacttcaacataggagtgttgggagaaaaaaattcagcccatacgtgtggccttccagataaccaggaatatatgcagtttttccaaacccatatggacatatcattccaatgctttccgtttaacatttttgttaagtatattgtgtgcccacactattactgattgccttaggcacctgtgaagttaaaaaaatgactctaaatgttttaaacaaacttcttcaggaaaaaggcttttggcggtgggtgaactccaagttaggtcacagaaaaatagatttgcaaatggggtcttccagaaaacctgcagacaagttaaataatgatcattcttaaagaataaggccttaaaggagttcagactccatgctgtcccctctggtggctgccaggttgtggacttttcctgtaatttggggctattggtttacgttgtcaccacggagctgaagagagggggtgggaagttgagcaaattataatgccacaaatcccactgtttttactaagagaaaaatgtttttcttcaatatacaacttcaggaatcactacaagcctctgattaattgtcagacttttgaaaaagttgattctcacaattatttttttgccagttttcttgttgctttcataaagaagagaatttatggaggtccttactctactatgtgtttcttactgtattatttttgctgatgtcactctctaataatgccttcctagacttctttttatatttgttttactatatctttgctttaaataaccatgtccctcacagctccattctggagctcttccattgctctctttgtgagtaattttatttactcccatggtatcaactgcataccatgataccattttgcaggcctttcaaaaaaatacctgttttcttaagtaatgtcaaaatttacattcatttatttatttatttatttatttatttatttatttatttatatttagagacagggtcttgctctgttgcctaggctggagtgcagcagcacaatcacagctccccgcaacgttgaacttctgggcttaagcgatcctcctgtgtcagccgcctaatggggtctcactatgttgtacaggctggtctccagctcctggactcaaacaatcctcctaccttggcctgccaaagcactggaattagaggcatgagccactgcacctggccacgatttgcttttaaaagaaaggatgcaaagtctgtttttaggattttcctataatatatgtccaaaaactgtagagtaaatattctaagtgactgttattcttgtggcaataataaaggaataattctatctatcatctatcttttcatatatattttcagatatggcaagtattagtcagcacaataaagaaaaaataaaagactaagattaattaagattaaatcttaattaattttagatttaagattttcactatctaccaacaactttgacaaaaaagtaattttatttatctaggcagaccaatgctaaattttaatgataataatccctttcattcatgcaaatcatatcttgcaaaagtctgtctttttctagttttcattaactcatttctaaaatatttttccaaatgttacaattgaacattaatcttaaaatagaataagaaaataaaaaaatcacatttttctcatctcatactaagcaatcacttatccattgaaacccacctattataatagtttgatatttgaaccaatatgagaaataaggtattaaaaattctccagtagtggatgtagagatgtcatctctgtgcactttttaaaaaaatattactccaaatacaagtagtggtagggactggcatgttaagtgccacgtgatgcttgcattttctgtagtatatgatcatgttgcttaagaactcctagaattctggacatttataggaaggcaacagcgttaaacaatcaaaatacaacacaattttatgcacacacgcacacacacacatacacaccacacactatgctcactataattgtattgtcccaaattcctggttgaatatttcaaaccctattaacaagcactctcagcacccaattatccctttcgaataactaaatttaaaaagcaagatagttattgtttaaatatgacaaactcattcttaatctttttgaaggttaaaaattgttattaatattttaagtcttatctcatttcttttgatgtattcaaaaaacaataattgagctactgcaataactgctttcctgaaatttgatctgatattggttctgtaaaaattctatttgaaatatactttcattgccaaaaatatttgcttccaagtatattacgtaaaaatcatgactaattcaccaggggtgggaatatataaaaatccatttaatagaggacaagagttttatgagtagtggctcattcatttatttatttaacagccgttattgacatgttccaaagagcctggcatcatgcctagaatagtctcaaagagaaaaaagttagaaataaataaataattatatatatttatattgtatatatatataacctcagtgcttaacctttttaaagatcaacatgttgttaaaatagcttctgctaatatataaattttccttgtttatgcaattaataattaaattaaactggaggaagaaaaacatactaccttttatcactaacatagaccaagacggaagatatatctttggtaaatacctttagaaagatgtgaagtatttcatctggtagcagaaaatctactaaaattatctgctttctctgaaaacagttatatattttatagtcaaatgtcccattatttttttctattctttaatactggaaattaaaaatatattttaccataaatgtgaattaaacacaaaattatggttcttttgacatggcacttaaaattaataaatgcacaaatataatttgataaatgtattgagagctatacatgaaatatacattggtctgggatggaggaggaatatgtaagaggtgataaactgtttttaaagtacaatacacaaacttttataagccttttataaatggagaaaagtttactactaataaaattaaagtgcatttatttattatgtaaaagtatcctttcttataccataatgtaatcaaatatatggtatatattgcaaaaatgatttttgagttcttatgtaatttgttcgatgcaaagcactgtgctacaaacagtaaagtatataaaacacaaatctgaatctttaaagtgttcacagttcagtcgattactctgtgtggtctccttatgaagtgagcaggagctgaaaaatgagaagataatgaagtaaatgatccgttggttcccttcttaatacggtgtgagcaaaatccttatgttttgtaacaggaatcaaaaccaaactctacagattgatgcctataaaatgagaaaattctgaaaagattaatatttaaattttctttatgacttgctatggtctcaatgtcatatggtctcaatgccatgaattttggactccccaaaagtcatatgttaaaattctaaaccctaagttgatggtaataggagtggggacctttgggaggagattcggtcataagggctccaaatgagattagtgcctttatgaaagaggccccagagattttccttgccccttccaccatgtgaggttacagtgaaaagagagtggtcaatgtaccaggaagcaggcccaaaaccagacaatttgctggtgctctgatcttagacttcccagcctcaagaaccaggagaaataaattgtgttgtgtataagccatccagtttatagtattttgtttttgcagcctgaaaggactcaagtactactgatgtttccttcaatgatacagactcattcaattgcttatgggcaattgattttacttttaaagattcacattttttacacaaaagaatttattgttggcaaatttacattgagttattggctaaaaagcatttttacatagtctatccctttctttctttcttttttttttttagacggagtctcgctctgtcaccaggctggagtgcagaggcgcgatcttggctgactgaaacctccgcctcctgggttcaagcgattctcctgcctcagccccccgagtagctgggactacaggcatatgccaccacgcccagctaatttttgtactttcagcagagacagggtttctccatgttggccaagatggtctggatctcttgatttcgtgatccacccttctcagcctcccaaattgctgggattacaagcataagccaccgcgcctggccccttcctcttctgaaaggggtggaggctttgcttacagaaagacttcctatcagctaaactcttactttaatatatttctcctaaaactttcttcttattacagtaatatctgagccttgtaccatgtgaacattagcagacagcccttagaaaactagtcatttaagggaactcacagtaataaatacatagtatgaggctccatataaccaatttggcagcctactctaaatttgaaatagcccacatcatttgtacacacatattcaaaaactttttttaagttttttaaaactcagggtaggaagaggcagtgaaaagaaacccaatattaatttagaatgaattttggataagaaactttaccatcaaagccatttctattttgtctaaacctcctagtttcaacagagctgacgtatttatagcaagttactaagattgttagcaaattagctatgatcggtactttggaaggaagcagctttgactttttcgaatagtcttttatttatgaatctcctcaaaatctgtggtaattagcttgcctcccacacttcactcttcttttctgtgctgcaccaagtatttcatttactattaacttttcttgggaactctgtgtgggctcatacacattcccatcaatgaattttttttaacttaggtattttatatattcttatttatataaagacatgctacttgaaagttcagaaactttaatttcataaatgttggcagaaaccaattcattcaagtattgaaacagaacatcaaaatctaacaataatatccaataagataagagagtaatagctgggtgcattggctcacacctgtaatcccagcaccgggcggccaaggtgggaggatgactgagtccaggagtttgagaccagcctgagcaacatagcaagacctcttctctacaaaaaaatcaaaaattagctgaagagatagcaaacgcctctagtcccagctactctgaggcaggagaatcacctgatccctggtggtcaaagctgcagagagccatgactgtgtcactgcactccatcttgggcaacagagtgagaccctatctcaaaaaaaaaaaaaatgataggggagtaaaatatattcactcacttttggaggatgaaaatagccaataaatacagatgcttttatgatgacttttaatataattgccaataagtatctctgctaaatacaccttaaaattttcagagaaaatacgaaagttgaaggtgagaaacataacgtgggtttgagacagaccttgagacatggggccacaatgttccatgtatctcttttcaaaagttatttgcacagagggaagaatgactcttggggaacaaatcagtgcccaggctcctgaagcagggaaggtttagggtatgatggagaaagagagtttactatgtattcactacctccgtgggccagtcctgtagagttatgggcccttgtgaaaaaaaatttagtatttgggcttttctaatttgtaagtaacataagcaattgatatttctagccacagtttgaaaaataagatacagaatgaaagatatgagccttttacccatctccctatgcttcaatgtagggagaactaaagagaaacttggtcatctgggaatatgtgatgtttcgagtatttcaaactaaatcaaagtggctaagaaaaagaatcattgcagtgaagacactaccagtgaagtaggccttaagttaatttttggacattaataattaaaaaaagaaggccaccatggaagaatatttaaaagacttttaaggctgggcgcggtggctcatgcctgtaatcccagcactttgggaggccaaggcgggcggatcacgaggtcagtagacggagaccatcctggctaacacggtgaaaccccgtctctactaaaaatacaaaaaattagctgggtgtggtggtgagcgcctgtagtcccagctactcgggaggctgaggcagaatgccgtgaacccgggaggcggagcttgcagtgagccgagatagcaccactgcactccagcctgggcgacagagggagactctgcctgaaaaaaggaaaaaaaaaaaaagatttttaaaacacctctggagacagagaaatagctaaaacttgatgggctactaggatcttgattcttgtcactgtcagcaatgtgccagtgaaatatgattattattttgaagtgatctaatttctacctgcagttgaataaggacttaggaattttaatttttcgcagataaatgatagctgcttcctgatatcttaggcacaggattaatatacatatcatttaattaccataataatgttattagtcataattacctatggattacagatgaagaaacaaaggtatatagaaaagttagtaatttttctaggccactcaaatattgaaagtagaagcctacactttaaaacaaaccaaagcttccgcttaaagcaactagaaaaggttctttaaaaagtgccatggcagtgctaaaaacaccagtgaaaaatgacatgattgagacctagataaaaagaaattcgaaggcaatccctatatttggagatgcatgtccctttggggtggcaataaattccgtaagtcgtaactgagaggctaacaacctgaacaccagttttgaaaactttatggatttagtaagacaaaaattgcattctaggattcaccaaaatggcgaactcacatgagttagagatctcaaagaattacaacttttaagaattcaactttagtaagaatgacccagaaatacagaaccttagaaagaagataagtattacttgaaatcctctcaatttccaaagctggaatgcaatactaaccccaggttgctagcaacttacctctctaaataaatgcaaacatattaaatacatcattttgggaggaagaatatatcactctaaacctcaaattttatctgattcatatgtacaacacctgggatgtaatataaataagcaggaaaaaaagtaaaagagaattaactttaagatcttcaactcaagacaaatgtgaaatagaaatagataaaccaaagattcagatgatgaatttgttacagtgattaagctttatatgtttaagtagataaaaaataaaaaaactgagaatttcaacatggaaatctattataattaataactaaatggcaattccataatttaagaatgaaataaaattaagaactcaattatcttaacagcagattaggcatagctaaaaagagaattacttgttcggaaagcaaaccagaagaaaatgtatagaaggcagtatggaaagttgataaaatgaaagatagagaatagacttgatacatcatagtaaacatgcaaaaataaatgcaaaaagaaaaattataagggcagttgatagtaaagtaatttaaaatttttcatagattttatatggactttaagaagattaattttaactactttctgataattaatttttgtaattaatagacataacttaatgtggtgcactggctaattaattcaggaaagtgaggttttgctgatttctacatcagacattctgtctccttttcagtttgtgtagcatactctcaaatggattttagcacttcctttcagtcacactgcatctcctgatttcatttattttccaataaacaacaccctctctacagggtcattcctataagcattcaaaccatgcttttatttgtattgttaaaaccaaaccccccccgccaaaaaaactttctttactctatcacttgtctcagccacctgcccctttctcttaaaagcaaaactttaattacacatacgcacaatgtctaattcctctctgtatatagacagtgcctagcttatgatgatttgacttactattttttgactttctgttgtggaatctgatgcttatgcctgccttatgatgattcaacttactattttttgactttctgatggtttgggctgccatttgtttgttgttgttgttgttaaaaaactgacaatggctggcttaaaataatacagattacatctgttttttctctcagtacagttttcagtacattacatgagatattcaacacttcattataaaatagactttgtattagatgattttgtccaactgtaggctaataatgtaagtgtactcagcatgtttaaggtagagtcggctaaactatgatgtgcagtagcttaggtatactgaatatattttcaactcaggatattttcaacttatgatgagtttatcaagatgtaacctcatcataagttgagcaacatctgtatttactcttgaatccacaccagcctctttcaccactccatcagtaaaatgctcttgtcaaggtcctaatatcctccacagagctaaatccaattaattcatattgagacttttttctctaatgacacgtcccttggtgatattatccagtctaatagtttcagacatagtatagattacattgagcaatttcagtttatatctcgagctatgaattcccctgcactacagactattgggtccaactgcctacttgtcatctccacttggatatctgacattacatctaaatcaaactcttgtcatttccacacaagtttgctctttctgcattcctttcaaacttggttaatagcagctctattcttccaattctcaagatgaaaatctttgctaattactgactccacttctaacttttacatatcatatccatcctgttggccttaccatctaattttatccataattcaaccacaccttaccatgttctctttgactggtctattccaacttactactagtgattgcctttgcctaaagtgctcatggtcctctattcatctcattaactcttactttcattatgatccagatttaagcataattcccccaggaagccttaagtattctctctgattttagaaaatactgctaaaatgtgtctcaagtctgtctttccttggtagcacttgttgcaattgtaactgtcaatttttacaggattggtatatgtctatctgcctcctttgtagggtctactatttaagcaaaaattgtcactgtttcatttgtttaaatagccctaaaagtaatccaaagtatctagataaatatttttgaaataaatatttcaaaaataaatatttttgaaatgaattaactgaatataatgagggagaagtcaagcctcagaatttgatcctccaaaccaaccagtagtcatgctttgagtacatgtttgacactagagaaggtctaacctttctcatttctcatccttgtgcccaagttaggagtgatgctgatgaataataaaaataatattgaaattggcccaattttcccatagagctgatgtttacatttttttgaataagcatagaaattgctcctcctggtcttaaaacttgagacttacatttgtctcatctacgttcctttctcagaaaacctgccatcagttctcccagatagtatcaaggaactgaaatgtaccagatcactacatccagataatgaacaacaaaatcctcatctatcatgattgtccaactgactacacgctttctgttgatcaactcctcttctttacccctccctaattcttgtttttttgtgcatagttacattccttccctattatatagacctccaattttagtcaactggagaggaggtgaaactaatctcctgtctcctggctaacatcacccaaataaagactttctttcctggcaatactcgttgtctcagtgattggctttctgtgaggtgagcaatgggatctaaactgaacccctggtgtttggtaatggtattatagaacaaagatttagaagtagataaaaatcaagatgtagaaatttaaaagagaaacttgagtcatcaaaatcatagtctgaaaattgtcatttaaagatgaaaccagagttgtgaattgaaatgctgtcagtatctttttaaccaggcttgatattgcagtagtgttacattcaggacttacataaattagtgcttattaggggtatctatattcagtgcttgccagttgccagtgataaattatatatcgtttgtacatgaacatagcatatttgagtgtgaagacttaatattgggttatggtggggttggggtggggaaggaggactccattcaatagtgaaatatatgacaaaaattagtgtaattatttgagatttcttaaatctaatctttatacaatttattggttttatctataagatttattttcatcatgcactcattcattttgactaagctttgaaaatgctaaacttgaaattcatggtaattgttataacttcctaaaaattgtctcttctcgtgggtaatagtttatttctttatagatttggcatcagcttatttcaactgaaagagctaaaagaccataatgcagctaattaactcactgatttgtagcttcttaatgacttatttattttaaaggaaactaattaagtgtttcagaatacactgaaaattacttaggaaagacttattagctcctactgtgtcatgctcaagataataaaatgtaaggtaccatgatacaatggatgaggctccagatggctagccaggaagcttgtattttgttcttttctgtcattaactagttgttttgccttgggcaagccagacattttaccaatacatatttttcacagataagtttagtaaaacaaatgatgtgacatacacatatgtttagaaaactgccaaaatcttatgctgaaatttggctttttcattgaataccatgactctttcggtcagggatatttttaattgaaatgaagagaaatccactcaaccttgtttatgtaaaagagcgctgaatggtgatagtagtatcttatgagactcaaatgtagaaaaaacagacaaacttcagcaaagactgagcaccataaaattaagaatctgattgattcatcccagttcatgaattcaactcctggttgaaattgctttagcaaaagaggttcaaaatcactttgcaaacttgtagttgtaggggccttgactgacagacttgtctactagttttccttaaataatttctcattcatgacatttggttttttatagcccaactgctgaatggatatttaaagtagtctggggtttatattgttttgtatttaacagtttggttttggttttggtatactaagcaagattttgaataattcaaaagaaatatatcagtttatataaaactcagtgaaaatttataggatgaaggacttctgaaatagtgctccagagtttcaggcaggaaaatgttgaacagacaggtaaaaagagaaagtttcctagaacctgtgatgggaaagagtacggaaaatacaagagactagaagaatgtcagcatggctggaagagagaaagagagcaccaacctaataacaaatgaggctggagagcactacaagtacctgatcatgtagtgccttacagatcatattatggacatgtatcttcatagccccattaagagacaattctagtggtcaggaagagagttgagggtagtcttggtaattttaatagcagtaggggtggagaagagtggaacaacctaagagacatataattaataaaatccacagaatttggtggtggtttggtactggatgtgaaggagaagaatgtcctcaagattgaagtagtgtcattcatctgggataacacccaaggtttgttgtcccatgtccacagaaaactaggacatggatacaccagaatgaggttaagagtggaaatttaataggcgaaagcaagagaatagctctctgcacagaacgcgcggtcctggagaaaatgtgttactgcttctacagtgaaattcagaaggttatataaatgagcttgatggggtggtgtctgctttacatagggcatgaaagattggtcagaccaggtgtgccatttgcatagggtgcgaagaagctggccaccccaccctaatctttattatgcagatggcttctctacttggctagtgccatgttgcctggttctttactgtacacgtagcgacaaagaaaagtgaagatggagccttcgtgttgaacatacctggcttccagatagccttttctattggcacagctgtcggcattcccctgtgcaagcttccagcttgcttatctatgtttgcagttcgatttttcaggctgctttttgttaaaaaagaaatgatttgggagctgctttttgctaaaagggaagccgtgctgaggactcctttaccctctctatttgcctaaataatttctttctagctcctgtattaggatgagtgtggtggctttaaaattttttctcaaatttttttgcactcctctcttcaaagagtgctgttcaatttccctcctcttgaaatttggctgggtaaagtgacttgattgtgcatgaattttgtggttaggtcataaaatgcattgtaacttccatcttgcactcttttggatcactgactctgggaagctaatcatcatgttgtgagaacactcaagaagctacaagggagaaaccaagggcttctaccagtaggcttcattgacttcctgcccatttcactgagccatcttggaatcagcttctctatttcagtcaagacttcctctgacttgactgagatcttgacataaacctcatgaaagattcagagctaggacacctacttaagcagctcctgaattcctgactcacagaaactttgaggcttacaggtatttattgttgttttaagccacttaaatatcagggtaataaaaagtattttttaccaagaagtttctgcataataataaaacaggttgatatagaactcagtaaattttcaataaaccataacatttattatttttatggatattatagaagttgggtcttcaagaggatagtttaaatgaggaaatgtttcagtgatgctatttgacaaaggcagtgattcttcaactcttcaaacttttgtgtaattccagagagcaataaaaacacccttgatttgatttagagtatcactgtctctttgggaagggatcatgtggagcctttgtccggatattacttcaatgtcctctcagagaaaagaggtcttccttgaaaagatcaggtgaaaggtatagcaaagacttttcctgaagcttataactcctgttcttgttccttgtaaacatttttgataaatcacttttttaaatctgggatgttcaatattgttaattagcatttaaaataattaagcttaaaattataaacttaaatctgcagctttacacacacatctcattatactaatcgctgcatgcgtaagactttcaaaaaaacaaggtgtaattccccaaaacaactaaaaagcaggttttgaaaatctaagaggaaaccaaacaacaaaatttcaacattcttatagaagcagaatgttctataagacattgcagaatatttgtgcagattgttaagataagacaaagcagaatatttgttcccccatattgtatttcatatacataaaagttagccctctgtatctgtgtcaagttctgcatctgtggattcaaaaaaccagacattgaaaatattcagaaaaagaggatggttgtgtctgtactgaatatgtaaaggctttatttccttgtcgttatttcctaaacaatagagtataacaactatttaaatggcatttaccttgtgttaggtattatcagtaatctagagatgatttaaggtatgtgagaagatatgggtaggttatgtggaaatacgactttattttatataagggatttgaacatcagtgaattttggtatcctcgggagtcctggaatcaatcccttgtggatacaaagggatgactgtatatgtatctgtatatatttctatagacacccatatacatacaaaacacatattcttatattcatttagttgtatatatgtggtaaaataaagttatggaagactgtatatgcaatagatgaaataccaataaagtctctgtaactaaggaatataccttctgttggaagaaacagaaaataaacaaaataaacatatacataatcaagacagttagagactgctctatgttctcagaagaaaatagccagtatgatgaaatagaaaagacagtctatcttgaataggatgcttgaatagacttagaaagtctttactgagctgagtgtgaagcagacaaaagaagatacagagaacaactacttcaaacttacggtgttgtagcaataatcaatctactggaaaataataacataaacttggtctcttataccatgaaaataacttacagataaattaaatctctaaatatatgtaaatttttaaataaaacattcaaaaatagttcaagagtaagcacatttctattttctttcccttgcagtgttcattaaaggactactaaatgactaaacacagattcactttcaaagacaacaggaaggagataacagcaaacgagaaattcctacaagttttacaagtttctgggagatgaaaaagaaataatctataaagagatttatatgtatctatccagaaaattttcagaaatgataaaaacaggtattgtcaaagttaaatgagcctatttgagatcaaaggaggttaagcttaaatagagaattgtctagacctatttttgtaaacctgccaaaaattatgaagagaagattctgaaagatttcctgaatgaatattttgaaagaaaaagtaaaacacaaaacagtgagaccacttttaaattttcatttatggagcctacaagataaaaagataaagcctttgaaaattctgggtgagcattattttcattcagtgttttcaatccagttttccagccaatctatgaatcagaagtaactaagcagccataatacatggaatcaaatactctacctgcataaatgctctcctggaaaaatctttgagaaaataccatagcaaaatgaggaaatagacaagaaatagaccaagaatcctaggagctgatccaacttagaaagtagtgatgtgatttcctcaaatgaaatccatgcagaagatcttagaaaacacagatacagttttgatcagaagaagagagaactctaggatggtcgctgtgctgtggagtgcagtgaagtatggaatgtattgcaaagaggacatcataggtttgagagtgggaggaagaaaataaatatttgaaaaagcacttaaagccagaagaaaacaagtatggaattaaggaaaaacaaaaggtgaaccaaaaataatataagggtattattcagatgtatggatatacagtcatgcaccacgtaacgacattttggccaatgtcagactgcatgcagaattgtgatcccagaggattataatgaagctgaaaaattcctattgcctagtgatgtcatacccatggtaatatcatagggcaatagattactcatgtgcttgttgtgatgctggtataaacaaacctacagcattgccagtcatataaaagtataccacatacaattatgtacagtacataatacttggataatgataataaatgttactggtttatatatttaccctactatacttttaatctttattttagactgcatgcgttctagttagatttttcaaagttagctgtaaaatatcctcaggcaggtccttcaggaggtattccagaagaaggcgttgctattgcaggagataacagttccacacatgttatccctgaagactttccatgggacaagatgtggaggtggaagatggtgatagtgataatcctgattctctgtaggcacaggctaatgtgtgtgcttgtgtcttagtttttaacaaaaaaaaaatttaaatgtgaaaaaaatttaaacctagacaaaagcttatagaataaagatataaagaatacattttataagctgtaaaatgtcctttaagctaagcattgttatcaaagagtcaaaaatttaaaaaaattgaaagtttataaagtaagagttaccgtaagaaagaaaatattttttaatttagtgtagcctaagggcacagtgtttaaaaattcgacactagtgtacagtaatgtcctaggccttcacattcactcaccactcactcactgactcacttaatactgcaagcgccattcatcgtaagtgctctatacaggcaaatcatttgcttttacctttagcaaacgtagttttactgtatcatttctatgtttagatatgtttagacatatgtatacaattgtgttacaattgcctacagtatttaatactgtacatgctgtacaggtttgcagcctgggagccataggctgtaccacatagccttggtgtgcagtaggctattccatctaggtttgtgtaagtacactctatgatgttcatacaataactgtatcacctaacaatgtatttctcaaaacttttccctgctgttaagcaacaaacggctgtagtcataatagtaagaaaaatgtgaacatttaaaaatgattgcttagctgggtgctgtgactcacacctgtaatctcagcactttgggaagccaaagcaggtggatcactgaaggtcaggagtttgagaccagcctggacaacatggcgaaaccccatctctactaaaaatacaaaaatgagccaggtatggtggcacatgcctctaatcccagctacttgggaggctgaggtaagataatcgtttgaacccaggaggcagaggttgcaatgaaccaagattgtgccgctgcactccagcctgggtgacagagtgacactgtgtctcaaaattaattaattaaaaaataaaataaaaatgattgcttttaggaagcataactcagtataagggaggtaggactaaagaatgctatgaacagcattagagtgctatcctcaccatttgattttttaatccatatgcaaattttactttaaaaaataattcaaagtaaaggattagagatatagaagaaattaagacttttatagaagagaattttataaataagacaaaataaaaagccttaaagaaaaggctgatttatttagtacccacacttactcattttcatcttcaaataggttttgaaaatgtacaatgtgtcgagcactgtctgaggactctggattctgcaataaataaaatggaacagaatctttggtctcatggagtttacattctagcagaatggaacattataaaccagaaatatgagaaattggtaaattacatgctattttggaagaaaggagcagttagagaagaacagagcaaaggacaatcagaagtgagaggaaaggaaacaaaagatgctggactagaaacctcctcaacagaatattcacttctctattctgtggcagaatggattagcggtggggagaggcaagaacaaattctcaaggcaactctctccccttcaaagtaaaggaaacacatggaatggataagtagtattaatcccctaattggaacatttttcttaaatatatatatattatatacatatgtatttatttgtggtcacatatatttgtagaaatatataaaatataatctggaaagaaacatattaaatgatttcagtcattatctccaagaagggaactaagacagtgttggcaaccaagggaaacttttcatttatccaaaatatttggatttttatattgaagacataattatgtattacctaagtaattgtaagtgaaattaaatccacataaagactttgaaatccattttaattaaatggctataatgattagagtcaaaattataaatgcaagtttgtggttatatatcaattaccacagtagcagcttcatacacaagctttaaaaaaatgccagttacattctaaatccctgtagcagcatttcagggaaatagtttgtcaatattactttcctttgtcaaatccgtgaaatagcagttgatttcttaaaataaatctcaagctataaaatgtttctcataggtattgttgctcctagcttccttctgggaagggatagtctttcttttctctctcattcttttcatatgcaaaaagacttcctccctaagcctgattctagacaattcatctttacagtttgtttttgaaactgttttattctagttgtgttcattcaccacacacataacacacacacacacacagagagatgcatgcactcacacagacacagacacacacacagacagcatgcacaaggtacttccccgcctgttttttttttttttttttaatgaaaaataaacagggaatttgctctgactctagcctagagtgtgctgttggataacaaacttaataaaaacgttcagctaccaataaaatcaaaatttggaaggtaaaattttcttggaatagcagatgttaccttttctttagtcagaaaaaggtcagggcacccccagagtcacaagagtaattattcaaaatccaggatgtggcctgatctctgttaatttgactgtgcatttttgccaaagggaattttatcaattcttttgcttaaatgtcatgtcctccacattgcctttcttggcttagctgagccagaaatgatccctcctccactaaattcttataggccataggttatatcacaaatgtggttctcattcactggttttcaatgttgatatgtaatacttacaagtcataattctctttactagcctggaaacttaaaggctaagggcagcaatcatgtcatatgacacatatggtgaattagaaaaacaaataacacaactatgttgctttgctgtaatttctatagtcctctagaactcagtttgataacgggtggatcatttgaaactcaattcaagaacattttcttccttatattctaaatatacctcgagcagtttaacttaccaaaaggtcactgagcatgatttcaggtacatttttctagtcataatttcaaaatgattacataaaatcaatgtgaaaaaagttgatcaagaattgagattatcttctaaatcttatttggtaaaatacttcctagaactttaaaataagcacaaagcatgtttaaaataaaaacactatatacattttattttaatctatgtgtattatcagaaaaatactacaaaaatactgggaaaaagttatttcaccaatcagaaataagcaatactgacagaaattaccattttacttgggatattttaagttatagatttacaaaggaaaagatacagcaatagtactaatgaaatgcatttttataaatcttcaaatcaataagattcaggacataaaagcatgatattttgaagcaccaatctctagagtctccagacttaaaaacagatgtacacagatattgcagtgaaatcattctaaatttatttttataaatagtattgaaccagcagagtagggactcattcagattatggtagatattcatgcttgtataactacagatgtttatgttaatatcccctttaaatggaaggcattctatcttaagtatattcaagacagattgggcctttttattcctgtagtgcaagaagccctacctctgcctggagagagaaaatggcatagaacaaaggagaaaattaaacaataaagcagaaaaaaagagtctataattaaaagtggtaaggacaggtaaatatagcactaggaatggtgtcattcaatttcactctactgaatattacgctatacctcaaggtttttatagaattatattctttttaaaaagtaagagagagcaaagtttagcaagatgccatcactgatgttaacattattcttaagactaatactcagtttatacttaaagctaatattctaggttacccactctctcacctttctctccttttctcacccttcctccgtctttttttcctacctttcttctatctatatgcctaaactattataggcaaaacattaacagttccccaggaaacaaaagggttcagacagcctctaaattatagaagttatttcctgtggcaataagagcacacgcgttcctttaatcaagcataacaaaacccctagagactgtgctttgtacaaaaaggctagctattttcaacatgtaaagaaaatggttcagaaatataagtgaaaaatataagccaacactgccaaccttcatgctcatatatagaagaattttttaaaagagtcaaatgtctgaatttgtttcagtctcatattttccaatgaaaagattaaatattgtcctataattctaattaaatgagtcatattttaccttttacagagtgatgagatgattattttttctctagaaaagtctaatacagtgctcctttggaaaaataaacagagaattttaattaggtgatgtgggtcctatctctgactttgccaccaaaattagtgcagccttaataaataaagatcattccttggcttcattcacttcctcttcagagcaatagaaatgtctgctgcaatgaggctggactgaatcctctatgaaaactacagcgtagccacaccacagtaccagaaataacacagacttggctctattctgtgttgcctcgtaaccagttgcatcagcctacactggtctgtttcattgttcatctttatcatacttgagacttcccacttcaaagatataattgtgcattcaactgatgaattatgctgaattatgaaattacaacctccaaatctatagcctaatatattctgcctctattctaacctctttctatttagttccaaagacttagcccttttctgatttaaaatctatccttcaactattgctattaaaacttttctttgtcatctttatttaatgactttgccctatctcttctgtatccctcttgtctctttctaagtatttccaaatccgttgatgtcttttctccagactataaacaagctcacatcttctgaaacagatgccttggcgggactcacaaaggggttagctcgtttactcagcccacagctctcaaaccctcacgggaaggggagcacacaggtgagagtctgcaggaatcaggacaaaggcttctgggcgctggcaggagtagaactctgtgtggctctgcagcagcatcaagggggggtatccatgaccccagagctccaaagagcatgtattacagtgtgctcttttagctttgctgtccatggctggcttaagtgtttaacagctcaatagggggtcagggtgacagccttttgcacttgccttcttagtacctgagttcttgatggcatccaggaagaatcaggttgcatgaatgaattgaagggtggtgaatgtagaggattatattgattagtggaaatggctctcagcaggatgcggagctggaaaggggatgaagtgggaaggcagtcttcccctggagtttggccatccctgagcgaaattttcttcaaagttccactgtccaagcagtccctctgaagtcaagctgcttctctctgatgtccagctgcttcttctcctctctctttttctgccactctgccactctgccagtggagcttggaaagcttgatgtattagttcattttcatgctgatcataaagacataactgagactgggcaatttacaaaagaaagagttttaataggcttacagttgcatgtggctgaggagtcctcacaatcatggcaaaggagcaagtcatgtcttacatagattgcagcagacaaagagagagagcttgtgcagggaaattccccttttaaaaccatcagatctgatgagatttattcactgtcacaagaacagcatgggaaagacctgcccccatgattcaattacctcccaccatgtccctcccacaacatgtgggaattcaagatgtgatttgggtggggacagagacaaaccatatgattccatccccaacctcatccaaatctcatgtcctcagatttcaaaaccaatcatgccttcccaagagtccccccaaagtcttaactcatttcagcattagctcagaagtccacagtctaaagtctcataagtgacaaggcatgtcccttctgcccaggagcctgtaaaatcaaaagcaagctagttacttcctagatgcaatggggttataggcactgggtaaatacagccattccaaatggaagaaattgagcaaaacaaaaaggctagaggccccatacaagtccaaatgcagcagggcaatcaaacctcaaagctccaagatgatctcctttgactccatgtctcacatccatgtcatgcttatgcaagaggtgggctcccatggccttgagcagctccacattgtggctttgtgggtatagccccactcctggctgttttcatgggctggcattgagtgtctctagcttttccaggtgctcagagcaagctgtcagtggatctgctattctgaggtctggaagatggtggccctcttctcatagctccactaggtgatgtctcagtagggactctgcgtgggggctcccacttcacatttcccttctgcactgccctagcagaagttccccatgagggctccgcacctgcagcaaacttctgcctcatcatccaggcatttccatacatcctctgaaatctgggtggaggttcccaaacatcagttcttgacttgcgtgcacccacatgctcaacaccacatggaagttgccaaggctggtggcttccaccctctgaaacaacagcccaagctgtaccttggcccattttagtaatggctggaattgttgggatgcagggcaccaagtccctaggctgcacacagaaaagggatcctgggctgaaccacaaaaacattgtttcctcctaaacctccagacctgtgatgggagggtctgccacaaagttctctgacttgccctggagacattttccccattatcttggtgactaacatttggcttcccattacttatgtaaatttctgcagccagcttgaatttctcctcagaaaatgggagtttcttttccgtggcatcatcaggctacaaattttctgaacttttatgttgtctcccttttaaaaatgagtgcacgtgggaattcaagatgagatttgggtagggacacagccaaaccatatcccttgataaaatgcacattctgattcagtgagtatgtggtggaagacagtgtttgtagttctaataagcttcctaaaggtccacacattgaatagctaggtccatgatgggggaggacttctcctcatctgcatgccccagtgggttataggtttgctgtgttttccatagctcagtcttcagtgtgtgagctggggactggcacagccggatcccaaaggtcagggatctctgtgagtcaccaggtttatttaccccaactggatgaaacgtccaagtgtgcttctcaacaataaaaaatattggaaagccctgccccagaattctagccatcaaatctcacctatttccagttctgtatatttattaaatggatatctcataggcatcacgttcactatacatatctagaacttaactcacgatacttgtccataggactgttccttttcttgtatattctatttttgtcctggcactataattctccaagttactaaaagaataaatatgattatcttacattattctctctttttctcacatccaatcaatggacaagtggttttttttttttcttggtcatttctaattgtgtttccttctctctgtttttgaaatgtgctatagcattgatcacatactatgctctctgaagccagttttgcccctcttcactgatcaacacattttcttcacagttatccatattatttctctctttttttaatttgtgttcccaaattcttggcatgctttatattttaatttttaattttaattcttgtgggtacatagcaggtatatatatttatggtgtgcatgagattttttgatacaggcatgtgatatgtaataatatcatgtaaaatggggtatccacccctcaactatttccatattacttctttagtgatatttctgagacgatctgaccatgctcctttcctacctgtcacagttctttttgcttcagtgaaggtctgagctccacaaggcagaatgcatctggagcctctggacatcctttagagatgcttccaagaagttcagcatgccacttctatttacaacttcttggccagaacttggccacagaggcacacaagcctgccaggaaaactgcaaaatctttaacatcttggaagtgtctttaaagagaagcctcttcgttctgatggctaaaaagaagccagaatgaatgaaagcagagcatctatcttcgatctcaaagaagcaatcccgcgttaagggtggcaaaacaagagagaaggattggcaacctccattccagccttgagctgttcacttgcatagtttttcttttcctttctttcttttactcttgaaagggagaaaaatctttcttaaaccaatgctattgtgcactttttgtcactcacaaatgaaactaatctgtactaaaacaacaataagaggctggtctgttcatcccttatttactttcttgccgttcaacagccctcacttctactatacaatgaattttagaaacaaagatagataatctggcattaaggttactaatatatatacttttttgagatggagtcttgctctgttgcccaggctggagtgcagtgtcactatctcggctcactgcaacatccacctcctggttcaagcaattctcctgcctcagcctccctagtagctgggattaaaggtgtgcaccacaacacccagctaatttttgtatttttagtagagatggggtttcgtcatgttggccagtctggtcttgaacgcctgacctctaatgatccacccacctcagcctcccaaagtgctgggattacaggtgtgagccagtgcgcctgaccaaggttaccaatatttaattaaatatgaaattatagctataatgctaagtatatattttctgctaaagagagattatcagattttgaccatgttagtttttaaaaattgtagttggctagaacagctctacactttacattttaaaagtagcatattaaatataatcactcagtctatagaaaagtcactcagttcttcaaagaaagaatcaagatctaatcctgagtcttatttctccaaatttattcttattttcacatggcatacaagtgaatgaggagaggcaatagaattcaaggacagttaatttagaaaatatttaaaataaatgagctatttcttatagaggcatatatcttggctttttactactatgtttttgaaatttaattctgatttttctctaggaatttgaatttttttcatatcaagcttttccagtgtaatatttgatgtgagattatatttatgataactatacatatacccacagggaatgatatgtactttgcccttttgaaatagagcaaaattttagattcacagttatcacttagggggaaatatttaggctacacataaaacctaattctccactatagtctcaggaggcaccagcaaaggtctgcagcagagtcaatgactttgatgattctcactctatttaagatttgcaggaagagataccctaaatttcagagatttaaggggaaaaatattttagaatcttttcaactgttttaaggtctttacaaagaaacaacataaagcagaaggaagatttctaatagttctatctttataatcctctgctgcttctattcttaccaataaataaaccaggaggcaagttaaggactcagaggtccatttatttgtgctagacagtaggatacagaaaaaaagaaaagtctcttggtatcttaatagactaaatgtaagtcacttcttataaaggaatgatttaataatgtggaaaatagttaatgcatattagattgttttgttattaataagaaagtaatttacaaaggcagattgtctctaagttctttgggttaggatttcattacacacttccatctttatcacttatcagaaatgtaatcacttgtttataaaatcaagaaaacttgtacgtctcttttttattggatgtttgtcttgtttaacctactaataattaagtttccctttaaacttctgataagtagaacaaactgattttaaatgatggaaattaacaaaaacatgcctatgttgacaccaactggacaagtgaatatagagtagcttattagaatatgttcttccctaacagtcaagtgctgacaatgaaaaattttgtaacagagaaaattattatttgaataaacatttgctgatattttataactctcttgaagagtcatacagattttccccagcagctagtcctaacacaacaatacagcgtggatttatttgaaaagaaaacttgagggcccatgtggaaatatctccatgaagtttgccatattctctattccacatggaaactgtggcctgtgccaacagtgcttttcctgaccattcaaattccatcctcttttctgcccaaattctatcacctgctcaagattcacttaatatttcctccttctttataaagaatttatactcctttccattccagaaaaaaatgttttttctcaatatttatcattattactatttcgggtagttattcataattacattttcagttattttcagcaaagaatcatcactcatctaccttttatagagactcacaggattaatacataaatgtatgtaaacaaagagacaaatgttctgtggtaccaatggttctacatctatctagagaattggaaacttattagagattctgatcccagaactctgataggtgcaatagcagaaattcaagtatgataccttgagaatatgcatcatttatttgattaatatttagcattgtcatttagttatgctttctcttttcagtgcaaatatcttttttaaactagatgattacatcatacattgatttaaagatacacctcatatatgaaatagcaattttctacaactattatggtatgaagcgttattttagtgaaaaatatttaaaagagaaaccatcacacatgaaagctgattactgctgaaaagagtagagttgggaattgtttccaaataagaacaagtaaggcataactgagtaagaaaatgaacatttttagatatttttttctagacatttttccctgaaaaggagagataaggggcaagtggaaaatatattaccacagacacataaaattaggaataaagaaaaataagctgcaccaaattcctcgtcaaatgttcccctgaatgttagaagcgcagaatgataacatagtagttttggttatgcctggagttatttatctgaaattgttaatgtgctttagaaaagaagaaatagtgcttcatgacagaaattagtgagctctttcagcatgctagacactcttttaagcccagcagagagaactgggaatgtattttggtccctgccctcaaaaacttcacagtttgagctagacagagaactcagacagtggcaacagcgctgggatatgtggcactggcacacagaggaagcatcctcacctagactttagggagaccagaggcttcttagagaatgtgaaatgagttaaacaggaattagccaggcaaagagatgggattcacatttttttcccagtcatttgatgcaggacatttgggtagtcatttcactgagtctcaaataacttatcttcttcaggcttccacctaaagtattagatgaccaatccgacacactccctccaccacccacagaaaaggcaaacattatttgctagtgatttcctcacaccctactgctatagtaattacatctattttattttcattagtagtattttacttgttgccacagttagctgacaatcattttttttttaaatttcatagtaacattactgtcagatttttgtacatatttcctaacttctgaaaaggagaacatccagagctaatatcaggaccaactgttgaaatcttgctttataactaaaagttaactttaagaaggaatgtaaactttttacatgtatttgacattaaaaacaaagtcaacagagtctaaacctagtcaacagtgtatagaaaaacaaatgacatagaaatgaaaatatttccaatattatttttaaagttatttgaataaaattatgatatgacgttagtaagagcagcagtgtcatggagaaagtccagtggcttcttggaactatatgcatttatggaaaaatatactgctaaagttctctaatgcttttaaggctaacttattttacagagtgttttaattgtttattgtaaaaagctgcaaagccctagtaaaattcaaaataaataaatacttttttatggttttatttctatgtcatgacccaaaattgtaaattatatgaccctagtcaaagtagcatcataaaagcatagcaaccattataacaaggagtggtatcatcccaaggtgggtgggcagaagttttttctcagggggataaaaagcctttttatttttatttttaaaataaatatatagagagagtacataagaaaatacatgatgtatctgtggtattacaatttcttggaagtcagttacaaaaaatgtctacaaaaggtgctttaagaggcaataatgaaaaaagttgagaaatatacattacattacacaatacaaatgcattacacaatacaaattcggtttttcatggggcaaagaaccaaacccttctcttttccactagatgctgccaatttgtatctgttttacagcctcttcttgaagtagttaatatcttctaaggagattgtttgatcctataaactttatgatctcttgaacacaatacttcctttttctccacttgataacacaactaaatagaattcaaatctaaaatcttagaaagatgtgacagacaggcagatgtcatctcagtgcttatatattatttgttgagcatgcatgacattgaattaaacattatggaggtaaaacaaagaccagaaatgattctatccccatgggagttaaaatttagatacacagagacaacttgcatgaaaatctaaaacacaaattggaaatggatatcacaggttctcctctccacagtgatacagtgttaaaagttggggttttgcttccccagtacttaacacactgctttggatgtagccattgctccatacattattatagaagttatagagatattcaggtagaatgccatgggctctctgaaactagagaatccaaacttcatgcatggagcacctccatggacattatcatttaaaatcatggctcaaatataggcccaatttttatgaacaggaaggtcatcataagtggagaaaatccccaaagaacacagaaacaaacatttatggaagcacatataggaaaaaatagttcattttgtctaggagaaaacagaggacattttattttttactaattaaaaacaataaatattttccttctgagtaaacaagtccttatcactaggaattttaaagattaagggatgaccacctgttgaagatgttcagagattctaaaatttaggtaggatactggatggaccagttacctccattgtaagcccaatcattctatgttggcaatggttgtataatattatcagaaatatatcagggtttggccataattcctgattggttatggcaaatgtttgtatgtactcatggagaattcttcatcgcttacatcggaaatgcttccattcagtaagctttttccagagacctttaaattgtatgctattcctaattgtaccattgaggtgattgcttctgtgcatcacgttgcctacgaggtactagtaatacttcctcctaaaagcatctctagtaaggagattctgaaaaaatttcagaaatacattatgatggagctgcattgttttaccactgtttcctcttctgataacatctcaggatttaaaactccatttattgaaaatgtgtgttgttgccatgcagttgttagaatagcttcatttactgttactgaacagctcattccatatatacactgtttgttgctaaacagttggttctgtctttgaatttctgcctgcactccagaaccagttctctggagttacttgtctcttttggccatttccccaagcaaaataaagccacaggctgtaccatccacctaataaaaaaacaaaaaactaaaactcaaaaaaaaaatgtatttccacatatacatgtacatacatatgaatttgaggcgggtggaccgcgaggtcaggagatagagaccatcctggctaacatagtgaaaacctctctctaccaaaaatacaaaaaatttagctgggcgtggtggcatgttcctgtagtcccagctactcaggaggctgaggcagaagaattgcttgaacctgggaggcagaagttgcagtgagccgagattgcaccactgcactccagcctgggcaacagagcgagactctgtctcaaaaaaagaaaaaaaaagaatttattttctataagtactattaatgcaagtatataaataatcctgtggaaaagggtaggagacaagtttggtgggcaaattaaggaggctttgctagatatgtttcatgatataaggaaaagtagatgatctaccttctccaaaataattccctgaaaatgtcctgagaaaacttgagtaaagtatgtcatctgtaaatatggactagtttattagattagctgaaattagagaaatgctaatgttaaggtcctcttgataagtgatagaaagatattaatatatgctattaataataactggtccttgagataaatagcataaaactgtgataaatctgcaacttcatcacttggttctaataagcctcatctctacagctgagctcagagatctctgagtacttttccatgttctgttccaagtgttctatcctcatcgttgacaaatgtattttctattctttctttgcaccacagtatactcacctttataaccttttgtaaatctgttgtctggcaattaaatctatgcaaatacctgaattcctagctgaggccaggaaacctagctcttctgcaagcatcttaacctcaaaataccccgaaccaaattcaatgtcctcttttcctccaactatccaaatcctctactatatttcagtatttcttttaagaaactatattttgaagaaaaattctcacatggtttccaacttctaaaacaatcagattaaacttttattctagtagtgtgtcattgtttctttacatagctcttaaataattgctatcaccaatcctatgactaatagtaattttgaggtaaacactacctctgaagaagaaccgatagggatattttgagtcaagttataaaactattcctgtaatgatgactactcagttataattaaattacttctttctaaattttagccatattccatcgtgaagcaatgctgtgactcctccatattcttgtagttttattaatgtaactagctcaatagttgttgttagtagaatataattttaaatcatgaactgtaaattcttcaactgaatttgacagtcaccttttcccaatcacatactatatatctgtatcattcgttttgcatagaatattctctttatatatcattttgccccttgaacaaatatcttacaaggcccaccacaagtaccaaggtttcttgatagttgcgcttccttatattccctaaaatattgctatctgtacttttttcttttgatgtttgacccttttccgtttattctagactctaagttgctaaatggaaaaggtgacatttgttcaatcatccaaagctaaattgtgcttagcacaatttgtgcacagaatttcgtgaataaatcttgttaaattgcttaatcttacatagtaaacacataattgctgattgacttgcctcagtacacagttgtgtgtttaagggaagaaaaactatatagaagaggaaatatttttcaagatgttctttcaattggcagggcaaattgcttgaggcattgactggactatgattcttctatacctgggacaatttattgctattttcagggaaaaagggaaggataatgttatatatagcaaagatttttttaaaactatacagaatcttgctacacctccatgtagtaaatcataataatagtaaaattgtattcctagaaatatagttttcttcaatatcttacatagaaaaatagagacaacattaaaaaggattcctctcatcctccaaaacataccaaaagcaaaaccagtaagctctgtgctaagatattttactaaggctttgaagtaaaccaagaaaatattacattttttattattatgacatctgaaattcacacattcaagttttgacacgatgtgccctaatttattcaagtagcaatactgtgttgatatcaacttgtaaagatgaaaaattaaatgatatggcaagaaagtaatcaacttaaatgaaatattttctgttgcttccctgcttttggaagttgttctgcaagctcttcataatcatcacttatctgcatttcaaagaaagctgaacactgatgttttgttctttattttattaatatgataactaaaatccaaaagccatagaaaaattattacataaaatagcaatatccaaaacaagtatgaaagttttaaaaacttttttgtaaatattttgtaaatttttttctgctgcttttgccttaataatgcttatttactaaagtatagatgatactttagtgcttttatgtttttgaaagcactaaagtttcatctgtaggtttgtaaaaatatactagaaatactaaaaatttgtatagtacgataacattacactgatcaaattgtgtactagtaagcaacagaaactcttatacattactgatataagtgtaaaaacataaaactacataggaatactggcagtatctactaaagttaaacacacccatgcctgtgctatgcttagcaattccccttctagagaaagtcttggacctcaacatcatgatcccaaaatgaatacatgtattcaccacaaaagatgttcaatgatattcataacagtagtaacaaaccctaagaaatacccaaatacccatcaacaggacaatagataagttaattttgatgtattcatataatggcatatgatacaacaatgagaatgaataagctattgctacatgcaacaagatggataaatcatataaacataatgcttataaaaataaagcagactcagagtaattatataaagttctaaaatggaaaagatatacttattatataagtcaggagagtgattacctttggccaaggtagtgccttggaaaggattatggtggaggaagagggtggggtgagtgcttctgtgacagtcacacttctacttgctgaactgtagtctcttcacttgggtgtgttccctttgtaaaactttatctagagggaaatgtattatttgtgcacttttctttgtgtatgttgtatctcaataaaaattttaaaaaaatcttcaaagcctatgacataaaaagtctgtactagtgaattatttacttataaatatctgtggtttctggttgttgttgttgcctccaaattgccctggtaagctgttttgaaatttaaaaatatgttaagaattaatgccaatactttcttttgttttcatcttttttcttgtttcctttgtgctcaatacatcagggctagaattagagaataaagaatcatttccaggaagacatttattttacaaaatatttccagtagagggagcttcctttttttttttttttctataggaaatcctcttttgggggtcatcactaaaagtgaaaatgcttaattttttacatataattaaagttcttcatagagtgataacctactctcatctaagactagtcatggatagagaaaaatttatttgatttatgaatggagaaagaaaaacttgatgaagaatataagttatgaagtaaacttttgtatgttgtatgtcttttcaaagaagtacatttttgggcttctcataaaatttatttctaattaaaattatttaacattaaaaaagataaattcttataatcacaattatccatttgaaatactttttcataacttttaacaaaattggacaaaagtcagagaatctagtgatgaagattatttatctcagaacatgttttaacaaatatcatagtgattgccattatacaaatttaacctcattgaccaaaacattttagtttctgactttagcttcctaaatctaagtatctatcaactaagctaatctgatttctttgaaaaaaatgtattttaccatctaagccattaagaaatatagagaaataatcaatttatattttaacattaagtttgtactcctttacataataatttcagaaatataaaagctccatatacttggctttaattattacaaatcaaatttctgacaataataaagtcacaaaaattactagatcatatcaagatgatttttattgaaaatactttggttaaaaatagttcaacttcttattttgggaaaaaatcaataatttcagaaataataaccatcacagtttctattatatataggcaaatgaaaataatataactttctataaggtagtttgagatacactattggtttttataaggtagcccaaagatgaaaaatcgacatagcaataaagaatatttaaatacttcaagtagaaatcagtatgcatataacttagttactctagttattggacttcaatcctcctttgaaaaccttgcaagccataaaaatggaaatcctatggtaattaattgtaacagtaaaattaaatttatattggtgggtcaaaattctatatgagcagtaccttatttttacacattcattaagaacggggtaaaattatctgatcctttgtctagctctcttatactctttaaattatttttttaagcctaccaaatatgacaggatcatgataagaaaatgacatgtcatagaacaatttcatagtttaatggctttgttataatattactttactcaagaagattattcctgacatagaacatatctaataatctatttatgattttgccttcatgtattacctgagctaggtcattagaaaatagtacttgcaaggcccttattttgattcatttaacttaacctctgaatatagcaacaacatttggagtttctctcatcagtaaatgactatggtctgtatttctgcattaaaaaaagtaatgtctcgtttctaaatactaaatgttttgtaactttcaaaaaaagagtaacacccaaattatataattcacttagaaaacgggaactttaaaagcaatttgagaaggaaaacgtaggcttttaaaataatttttttttctcagctgcaaataacgcaagatgccagttactaaaatgcactaatcaatgaaaaagcaaatgagtaggtctcagtagatagactgctaaataatttagacagaaaacaatacgattaaattgattgtttcaacaagtcaatatagaattgcaaatttcccggtctcatcaataacaagtggttgcaacgtaatgcacaggcttaatgagttctccgactgttaaatccaagcgaactcacctgagtaacagtgctgcttcccagaagtaaaatcccgaaactaatgtccgaaagtgtctcacgtgggccatgatacggagagatattcacgatcctgaaaatagtcttatccaaggcatggggaaccagaaagacagaatgaaaatgtacaatctaaccccgcatggtgttggtgtagactgatgcttgggaagcttcagcaccttagacagctccccgcagtatgcggaccccttctcagcattgagcagaagtggagagtcacagtgttataaatgtgcaggtgatttttacagtgaaattacaaaaatgagtgagatgaaatgtctgaagtgcctaggtgctgggcaacagttctctaaagctccagcagcaaaggaagaatgttcgttcttccctgactgagacccaggattggaggaagaagagcagcaacagccggaaagaggacgcctctccacctgctccaagcgccgcccgccggaatccagctctccaccttgggttaaaacccgagacccggagcgcggcaaagggaagcgggggtggggccggacaacccggtcctgtcgac

SEQ ID NO: 350 - DNA, 187268 bp, Homo sapiens; identical to SEQ ID NO: 349

SEQ ID NO: 351 - DNA, 59823 bp, Homo sapiens
gtgacatcacatccactaaccaaatggggtggtgtgagtatctcctataaaataaaagctctcctgatggcctgttcctgcacatttcctgaggacgccctcgatcacaagcaggttatagctatttaaaccttgccttacctgtactctttacacaaattgaaggtcaaagaagtagtcatacttctgggcatagattaaactgattttgtaatactgtttaggctgaacctatcagtttcagactaaaccctccaaatatctgcccaaacttgccccataccctctaaaaccaaggcctaacaaagcactaaaatcaatagatgaaaacctaattgagaaatgaatcatgaaactttgtactattccttgtagtacttctctaaatttaaaaaaaagaaaaagaaaaaaaaacacagggcagtgatataaatttgttcagaatctcaggagtataaattgaataatgatctcccacttctctgtagtaacaaattcaaatattattttgtctttggtgcataatgaaattgcatattttacagctgtaaatctgttttctgttcctttagaatctgtttaattcagagtcatatgtttgctttcttctgagaaattcgataacgtacactggtaattatgacttagggcttattgagatattgtcttaatttttaaaagtctttaaccagggcctcaaggaacttacatttccctatattctaccatactttgtggcattctaaagtttagctgagctctaggactgactccatccatctaattacttgttttatctctaatagtctataaactttctgatggggactaaaattttttctcaaagtaaagtgtatcatctgaagcataatatatcccaaggaggtaaatttctcttttctgaaagatcataaccattcagaatttttctagttagtaaccaggagattttagagatgattctttgggtctcattcactatagccaacaatgggtttccaaatgtattcattttctgtggctagatattaaattagcacagagttaggcgcaaaaagcaacacacatttatcacaccacagtttctgtggatgaggagtttgggtaaggcttaactaggtcctttgttcagggtctcacaagccgaaatcaaggcattagccacgttgcagttctcttctggagctcaaagttctcttccaagctcattaatgttggtagaatttagttacttgtggttgtagcatcaaggtcctctccttttagaggctccccctctttactggcagctttcaatacagctgtttctctttaaggctagctagagattcttttgcttttatggctttcacctgattaagtcagtgcccatccagaataatgtcccttttgagtcaaagtcaactaattagagatctcagttacagcggcaaaaccctttcaccttttctgtgttacataatccaatcactcaagtgacatttatcatattcaaagatcctacttatattcaagggagagggttatacaagaacatgcacatctgggcattttaggagtcattttcttattctgtctgccacgttgactttcagaaattgacacaatactgtatcacttaaccaaatctttgttaatcaaatctcttatctgagaatttatgcatatataggcatttcatgctttaaaaattagcccttcaacaacctctcattatgagcctgcgtcatcatgaatcatgttacctattcatacataaaagatctgaacaagtcaaatatctcttccatctcaacaaaccagtatcatgcaactatttttctactaacccaatgtcaaaatcctactttcctaagctgaaagcagaagttgaaacttgatggaggcttctactaacagttttactttctaccttaaacttaatggttccctattttgccagtctttgctgcccattaaaagtatgcaatatttcctaagaaagtaggcttactttctaaaattgaattactttcttctttccatgtttctgttcatcactgtaatactttaaatactattaatcttcttccattagaagagggaagctcatggccccctaaccactgcttcctgaatatctagtaaatttattaaaacacgctaataaattaattaaagcatgcccagaaatccagatttaatcttgatttgtttgtaggtcatatcctaagaatgaaaccagaaaatatcaggcagaaaacactggaacaaattttaactcaccattttgacccctttccagaaatgaaaatattcttagataacataattgtttccattcccatagcttgctggatgaataaaggaaagaaggtttatatacactaataatagaaatgttttgggatggttcatgatttcgaaaagcttcagagaaaataaagatgcttaatgtaagtatctttgcagtaagataatgtaattatcttacattatccataatttagaatggttagcagattaaaagtattttaataactctaatggttcctaagaagttgactattatcaaggtggatatcagttcaaaaagggacatcatcaaagcaaaagaaaatgtcgattgatcattacaccaatgggtagttctcaccaagatctctaacccacaacactcagagactacatctttgaagaagttcaaagagaatattatactatgccagtctttggttctacagtaagaaaactagaataataagcacaatggaattgtcaccagaaagtataaacaagatgagtataaacaaaatttataaacaagatgtaaacaaacacgtttttaaaaacctgtatttatgaaaacagtcaatcaactcaaatgttacatacaatttttcaacaagagaaataaaagctataatatgaaaatcacctctggcccacttagagtggcttctggtggccccaagtgaagtcttcttaaaaaggcatgtgacattacgcacacatgtaggacaaactggcctctgtactcaaccaacatcagtgagaaaatgaatttcatttcctgttgctggactactctttatgcatggtgccaaagaattataatattatctgacaaacccatatgggcattttggccaaaaccagatcattgaatggtccccaacaaccaatttccagatggacgcacaaaagcctactgcctattatccaaaaagtgaacaggaatatgttaccatgttaaactgatatccaccttaaggatagtggctaacaatgtcaactcacatatattttgatccatcagtttcccgtctcagtaaaagattaatatgctttctttgtatgttttacataaattgaatcatttttaaaagctttactaaatatgtaatatatggaaggtgtattattaactgctacaggaaatacctgtgggaataagttgtgtgtgtgtgcacatgtatacacacatacatgtgtggttaaatttcaaaatttcttccaagctataggtaaattttcaaatgacttttattttcgtatgtagttcaaaatgtggaatgataagataaagaaatgatactttaggaagccagacttatcaggtattataacaattaatttaaagttcaaactcaattgaaatcactctattgagtctccaactactaaattagttaatgattctttttaacctttgggatcttggtttgatggaagtgaatataagtatcaaaattccttaaatatttccaatatgaagacaagtttaaatcatatataaaattcaaataaaggtctgtcaccaggaacattaataagcataatgtaactgtcactataaagtcttaataaacaagttgtaaacaaaatacaatttttaaaaactgtgttgatgacaatagcttatcaacttgaatgttacatacactctttcaacaagagaaaaaagctgagcaaactgaaatcaatgaattttattggacccattagagaactgaagtcatagagcaaatcatcatcctgaaatctggagacaggcaaatacagagggtcataactggagtctgcttatttggagcagaagtttccaaagccataaactggtagtaacatttataaggtaattcttctgaactgctgaagctttttgatgaggctgagtttcaatcagcacgagcataagaaactcagaggtaccatttatggaggcttccatactttggtgggtttttacttctaggaaccccaccaacttatcattgtgaagaggtaagagagagaccctcacggctgtgacagtgggtagagaaagttaccatttgaaatatttgaaaccatttttattttatttttataaaataaatatttttatcctaaaaaatatttattctgttagttattttatccccccactatcacattcttgtgataatcacatcttttaaatctgtaagcaatgttatcttttaatataatctttgaaatataatcttcgaaatctcacaaaaatttatattttataattcaccgtgaatagcaaagccaaaagaataacccactatttcctatactcaaacatgttacacatcaacccaaaagaaaaaagacacgaaaccaaaaccaaggaaacacatatgcttagttaggagttaaagttactcaagctctccaaataaaacatacaaattattagcattaattaattattattatttttttgagatgcagtctcactctgttgcctaggctggagtgcagtggtgcgatctcggctcactgcaacctccacttcccgagttcaggtgattctcctggctcagcctccccttgtaactgggattacaggtctgcgccaccacacctggctaatttttgtatttttagtatagacgggatttcaccatgttggccaggctgatctccaactcctgacatcctgatccacccacctcggactcccaaagtgctgggattacagtcatgagccaccgtgcttggcctaatttaatacaattataacttaaatggccactttgtcattgacaatgattgcttgagcacagggtgagtgccccataagctgttaggagctgtttcttcagatcaatgtctcctctctgcactgccagctcctacctgtgcatcatcccctatatactgtgcattatatgtatatatatatatatatatatatatatatatatatacacacacacatatatatctttaaaaaatattttccaccacacatacttcctttcattaatcagataacagggaagaacaacaacaaaatctgaacaagccgatcactttctctttgggatatgatttttttccttgtgcatgaagtattcagcaacaacataagaaagggaaaagaagaaccatttcttgtgtatactccctaaacacacaagcctagtccactgggtgggatataactgtatttatatgcctacctccaggcatggtcacttgatgtttcactactactggttgctgtgtctaagttctcacactctgcttgacaagtgcttctttaaggggataacaggctagaactgcagctctgcaagaagtcattcttcccaaggccacttcttctcagcttctctgtcttcatgaattctttgagctcaatcttctgtgagaagaaggcagttgtcttcattttcaggatagaagacactgttaagagaatgaacagagtagtcacagactgagggaaatatgcaaaaatacaaaagaaattactttattgtaaatcatacctaacactcaacaataatagtacagacaactcaattaaaaaatgagcaaaagatctgacagacatgtcatcaaagaacatgtacagatagcaaataagcataggaaaattttatcaaaacatttgtctttaggaaattgcaaattaagacaaaatgctgctacatacttgttaaagaggttaaaatttaaaaaattggacaataccaatatgtggtaaggatgcagtgcaacaggaactctcattcactgctagttttggaagacagcttgggagtttcttacaaagttagagatagtcttacctcaacatccagaaattatactcttgaatattaatgcaactgacttgaaaacttatgtctacacaaaaacctgcatgtcaatgtatatagcagctttattcataatcatcagaaagtgtaagtcacaagatagccttcagtatgctaatgaataaacaaactacgacatatcaatacaatggatactgtttagtgataaaaagaaatgaaccattaagcaatgaaaagacatggatgaacctgaagtgcataatagtaggtgaaaaaagccagtctgaaaaggctacatggtatatcatttcagttatatgagattttagaaaggcagtaaaaagaccattaaaagactattgtatgttaggagtctggagaagcataattctccacttcttccatgtgggctatgcaagttgacaccctttcaaaggctacagtgtggacaatggaaaaagtaactttacattagagaaatggacaaatctacctaagcccgatgatgaaggccaacattaactgtgacaaggaatgtcgatagcagttgccttgatatgataaaaggcactttccctttgtggccttccaaatatgtataaattattctaaccatcaaacactaattgagggacattcaacaaaataccttcccagtactcctcaagattgtcaaagtcattaaaaacaaggaaagggcaaaactgcaatagccaaagaagctgaaaaagacatgactaattgtgatgtggtgtcctggatgggaccttggaatcacaaacagacattagcaaaaaattaaggaaatctgacaaaaggcatggatttaataacgaggtgttaatattggttctttcattgtgaaacatgtattatataatgtaagatgtttctaataggagaaagtgggtatggagatacatgaaactctgtgctatctttgcattttttttttctgtaaattaaaacggttttaaaaaacaaagtttatattaaaaatatttaaaatgtcatgaccatctgcctcttgtcatatagccatgcctccatggctaagacatataggagtaattaaatggttcttttattaaagaaaggaagaaaggaaatatcttacaatgtgatagaggaagtcactttaaactatgcagttttccctttcagaaccgtccaattcaaatgttctctgacagaatttgtttacattattaattctgagagtcttgataactcttatacttgagccaaaattaaaatgccaggagaagtatccatttcaaagggaaaaggaagtggctacccacgtagtttcgtaaagacttgtgctcctgagaaacaaagaagtgaaccagacagaagataaaatgctagatgaaaattgatgataataattgcttgagaaggcttagaaaaatagaaaatcacagtgggcactttctgttttccttgcttgctgaaagacaaatagaaacaaagtatcaggtacagatgcttctgatatgggatcacacaataacaacactgcttcagacacactctaatgaaagtcagctttctttcaaatcattttaaaaaaaattgtatcctttatttcctattttgtgtaaaaaaaggagtatggatctttatacagatagagtgaagtggagatttgcaaaaccactgaagtattttaaagattgtaaaataatcataataacaattatgtattgaataagaatggtagtcactgccctaaatatttaacctggtttatcgtatttaacttcccaaaccactgtatgaggtagacattactattatcattcccattttacaaaagaaaaaaccgtatcgataacgcttcaaattgatgctcagaccacttccctgccttccggtcataagcacacaagtttacttagcctaaagaaacttctcctagttgtcaatatgattaaattatataaatattatttaattatctcaagttctgaaaataagatatatttaactatgaagatttaataaggcaaaagtataaggacagatgagttatgttttccattaaaatactagtttttaaactcagagtattgacactctaaaacaatgttaaaaacaagctgaccggggaggattgcttgaggctaggagttcgagaccagcttgggcagcataatgagactccatcttaataaatacattaaaaaccattagggagtgtcgtggtgcaagcctataatccctgctactcaggaggctgagccatgatcacaccactgctctccagcctaggtgacagagcaagaccatgtccaaaaaaaaaaaaaaaaatgaaacataacaacaaaacataacactgtttccccagtttcaatttctattatataaaaatcctcatttgcagttttacaatgctatctatatggctaccaccttttcattaaatagttctattgtctttatgaactctctctgacttgcatttggcatatattgagaactcttaaaattcagtaaaatatacaaaaaacaatacaaactaggcaaaatatttcagcagacattccaccgaagaatatacataaatgtcaaatatacttatcaaagatactcagtatcattagtcattagtgaaatgcaaattaaactcaactagataccacaacaaatctcttagagtggctaagaaatactcaaaataccaagtgctagcaagaatgcagacaaactggaacattcaaacacaggtgttaggaaatagtacagcccatttgaactatttgacagttcattatacactcgctatcaaaccagccactctacttttaggtgtttgcccaactaaaaacttatgtttacgcaaaaacctgcatatcaatatttatagtagcttacacctgttggtgcaatagtaattgtgtttttttttaaacagcattactttcaatggtaaaaactgcaattacttttgcaccaaactaatataaaacaatttggggagaactggcacctttactatgttgaatgttctaatctatctgtatttgattttaaaaaatttcccttattaacattttgtagttttcaccacgtcaattctgtacatgttttgttatattactatctaagtagtaaattttctttggaatgattgcaaatggtagttgagttttaatttcaatttctaaatattccttgtttgcatacaaattgtgattaagttttgtctgttgatcttgtaacctgcagccttggtgaactcacttattggttctaggagtattttataatatatttatagggctagtctacacaccacctgttatggcgaggtccctcttgctggttggtgcacagctacctgggtattcctggatgtgggagtggggtttcaggataagcctggtgggagagtgcttctactggcccctctatgtttactgggtcctgattgattcctcttgctggtggaatcttgcttggtattattggagggacatgcatttgatccaagggagacttaatcctttctgagccaccttcttttgctagattatgggctgggaaacacttggcctgtgtggccttcttctgtttggtgggggaatataagacaaactgccattataatttggctttcctccagtcctaggattccaaatcagtttgtcttcctcttccctgcttaaaacgttttccctaagggtatacaaaaaccttcattttctggattttacctgtaagggataattggaaggacagctgagttcaggcaagctgatttattatcagtcctgccgggctacctcctgataaaagcagaggaggcagccctgctttcagaccattgcatggctttacaaggcgaggaacagggtcagggtgggggagctgagatgggtgtgcaggtgtcttgaccgcatcctggagatgttttttgccagctttgttatgcaaggtgaacagacatgtcaaccgcatcctgtaactgactggttagttactggaggggtcagtgaaggggggtttgtctttagccctgggggagctgtgcggatgtcacaaacgactgcattgtaagacccatgggaagggagggggaacagtctggttggggtgaccctaacattacctatctctacaaattccctgtcatgtgcttaaaaaaaaaaaagacaccagccagagttgacaggcaaagacaattgcagagggaggcaagactattgcaataggggagagagactaaatttaactcccctgaaacaaaagatgggacagtttttaatgacaaagtactagagaactttgcagggaggttggtaaacatgattcggccatctgtgtttgctaatacgtgcttatctaagttaagctcctacatttctatagagactggatgaaggcactccatctttcttggtgtatacttttcaaaaggatgactctcaggacctggagaaagacattcctagtctgtaaaacttgcaagagaagatttacatctctaagctgcagcgaaagaatttacaattttaacttttctaaagtaactgctctaagaaaagagagatcaagggcctagagtcaggaagaaacttgtctgaagttgagtcaggttcaggggaacttctaaggctgccttggtcagtgccagatgacttaaaatttccggaatgccatctgctaatttgcactttcttgtttttgcacatgttggtttctctgtaaaatatcctctcctctttgttttcctgacagtttccttattttgtttcaataatctgttcaatctttacctcttctgtgaggtacactcctggttactccatatcagttgataaggcacattttgtaccacctttttgaagcataatgttgactttctttagaaagcatattctgatgctttcaaaaagacccagccacctctttttgatcactttgtaaaacataaaatgtctttttgttacaggacttttcattagttcagctcaagatgaggtccttatcacacagctacgaaaatttaggctagcggacgatttgaggagtgaaaaaaatggaaaaggggggaaacacagactctccacaaaggcagagtccctgctggtgcgcttcccgcctcgcagtttgaatcccaggttccacacaggaagaggaggggctaagctcctccctgctgcaaaacccacaggaacttcctgagtttccaccccagtgcccaaggccagctggagtttttatggggagtccttcccacttgtctgcctcatttttgtataggatttacataatttcattgtttatacatctctccttcactctatctctcacatctctctctcttttttttttttttcagttgagacagactctcactctgttgcccaggctggagtgcagtggcgcgatctcagctcactgcaatctctgtctcctgggttcaagcgattcttctgtctcaccctcccaaggaactgcaattacaggcgcatgctacgacacctggctaatttttgtttgttagtttgtttttgggacagagcctcagtctgtcgcccaggctggagtgcagtggcctgatctctgctcactgcaacctctgcctcccgggttcactccattctcctgcctcagcctcccgagtagctgggactacaggcgcctgccaccatgcccggctcattttttgtatttttagtagagacggggtttcaccatgttagccaggatggtctcgatctcctgacctcaagtaatctgcccacttcggcctcccaaagtgctgggattataggcgtgagccaccgctcccagcctctctcatatatatctatatatgaaactctatccccactcatgatgtaaagcttgaagctaagtaagcactcaaaaatactttaaattgaataattaaagcaattttcacattgtgttaaaattttaataatatgtctcttcattcttgtctctgagtaacttgagttcattcatcttgtgaaaaaggccctagcaccttgtctggcagctgcttactgattatttaatgaacaaatggatgagtaataataatttataaagcaaaattatttttccagaaaagtaacaattttgtatcaaaacttggaatgtcatattaaagtccttaaaaattaaatttacttaagaattaaaagcctcagattttatgtttaaaaggtaactatgtcttttttccttcaactattaattttgtttttcacaaatggccaactcttttttttaaatgactccttttctcctagaatcagaaattgtactttgaaaatatactctagatttaacaattcaaatagcccactaacactgacaattttgatgtaaaagaatgattttcttctgggaaattttatatttatgcatttaaatttctcttgattgtttttccatgtacttcagaaagctgtgaatttttttttcagccttccacttttgtgtgtagttatcaagttttagctcatcaaactgctgaatttaagctttatctgtctaattaatattcttcagcagttcacagtcttcatttctcatttcaggttagagtacaaaacattctccctgcagtctcacgaactgtgaacaaaaactgaagtgaaaactcatagtgcataactcgtcaatactcctgtgatcgtataaccatcagcaagaaaacaaatttgattgagcccccatccagtcctctttgcgtggaatcagacctcttttgcagtggaaaggagcaggtaaaacaaataagcagaggcacaaaatcatcaccaaaccagactcactgaaatgccaacactggcatgtgcgcagacattttctattctggacttacttctaaacagcaatgccaacaagcatgagaggtgaaaaaatgtggataaatacatgtttggtttattgaactaggtcttatcatatccaaattaaaaacaaaaggcacatctcaatttcaaaataaggttctgaattttaattctcagattcattgaatttctttttgattcaaaattcaaactcttctatcgaatatatcctttagataaattgtctcccaaactcagcagcagattctccctttttcttgtagccacatgaatctatatattttcccgaccagagtctccatatatattgttgatagaaacataactttctattaacaaaaattgtttatgcatatctactaatttcttacattgtatttccaccaaccaaacataaccaagatcacacatatattcaatcttacactgagaataccttaaaagctaatattttaaactttgtaattaattctgtttgtctctattttcatttaaaaaaaatctctctcgttagtacctaccataatttatacccagtctctctctctctgtcacacacacacacacacacaagcacacatacacacagtgagagggagagtgggagagactgttttgaatgttttggttaattaactataatgtatttttctcatttgtattttatttaaattttcatatttactttcattgaaatgaaatatttttccacatttatttttattgaaatgacaatacatgaggccaggcaaggtggctaacacctgtaataccagcactttgggagggcaaggcaggtagatcacttgaggtcaggatttcgagaccagcctgattaacatggtgaaaaccagctctactaaaaatacaaaattagctaggtgtggtggcacatacccgtaatcccagctactcgagaggctgaggcaggagaatcacttgaacctgggaggtggaggttgcagtgagccaagatcatgccattgcattccagcctgggtgacaagaatgaaactctgtctcaaaaaagaagaaaaaaaaaggaatgacaatatatgaagttttcctgaatggggagaaagtataatcagagagtaaagatgtaacaattcttagtttataacttcaaatattaggatctagtggtaagctacctcagtctatttgggctgctataaccaagtctgtatcctcacatggtagcaaggaaggcctcacaagctccctcaggcctcttttacaaagacattaatcccattcatagggccacagcccataggacccaatcactcccaaaggccacacctcttaatattatcacattggggtttaagtttcaacatatgaattttgggggacacatacattcagaccatagcataagccaagtaaggattttgagtgatcttttaggaagtgggactattttttcccatccttcttttcccctttgtccaaactaaatgaaaattttgcagtgaaaaaaggggaaagtctgaggaggaaaccaaagggctagacactaatgagatctgggaaagcagttctttcgtctcaaaattagccacagtatggaacgatgaaaagaaaggatgtcaggaatcaaagaatagataagacttattgtgtgttcatacctgatcatctaggaaacctaaaaatctccccaaatctcctagggccaggaacatggatttggaacgtcctcacagataggtcccatgtgatttggtcagataagaggagcaatctcacatttccttaactggcagagagtggaagttaaggaacagaaagcaaacggctctgaggatgttttgtaattgtgattagaagaatctagagaataaattagattggaccataaagttagtgagcagaatggggtctgggataacaaaaagctctctgcctgaaagtgtggagaataggatcccagcagaggacagagcacatccacagggcaggggctttgctccttcctcactatatatagtggtcatacaacctcttagaaaagaaaattctagagagaagtgaaagagaaacttctcgagctccctaagtgtaaatttgaagtgacaaagaatactgaaataattgagtttaacttgaattgtttatgactatctaacatgaggtggaaaaggagcttttgtgatatgttaaatcatagaaaagtcaagaagttacatgcctaccaagctctatttaaaaaaaaaacttttaggttcaggggtacacgagcatgtttgctatataggtaaacatatgtcacaggagtttgttgtacagaatatttcttcgcccaggtattaagcctagtacccaatagttatttctcctaatcctcttcctcctcctttcctccatcctcaaggagaccccaatgtctattgttccctctttgtgtccatatgttctcatccttaagctccaacttataattgagaacatgcagtatttggttttctgtttctgtgttagtttgctaaggatgatggcctccagctccatccatgttcctgcaaaagacattatctctttcttttttatgcctgcacagtattccatggtgcacatgtacctcattttcttcatccagtttaccattgatggcatttaggttaattctgtgtctctactattgtgaatagcgctgcaatgaacataggtgttcttgtgtctttataggagaatgatttatattcctctggggtatacccagtaatatgattgctaggttgaacggtgcttctgtttttagctctttgaggagttgccacactgctttccacaatagttgaactaatttacattcccaccaacagtgttcccttttctctgcaacatcaccagcatctgttattttttgactttttaataatagccattctgactggtgtgagatggtatctcattgtgtttttgatttgcatttctctaatgatcagtcatattgagctttttttcatatgacaagtctatttttaagtatcattagtgaactaattatgaagtttattaccttatatttctctttgatataccagcattattatgatataatgcatatatcataaagtttgtagtttctcatttgctgataatttcagtatcagaaatctcaaagagttttaattttaatctctattttctccatatttaccattttctttctttgtatttttatttctattttttaatgtataatcttattgttcaaaacacttgggtttttctagtgtcaattgcaatcataatcttaactgatacaaattttaacgctgatattgcagtttaattttctataaccaaaactcttctttttcaattcatcttattattttttcactatgagccacatgtctgttgtgatatttaaaagtaacatatcagagcttcatccccagagattctgactcagatctggggtttcccatcttccgcaggagatgctgatgcacggatggaattgaaaaccgctgttgtagttaacttttcagggtctgtcagtcttttgtctagtgagtctgttcatctgaaatgggaccttcaatttggcccacagctaacttttctgatattataattagatgcaaaaagataggttaaaagagatataaacaattctctagtcccttagaaagctgtgaactaaagcaaaattaatacttttagttcatattatattacctgaatggatagaaagaaaaatggatacacagatgatagatagatacataatcaatagagataaagacatagtacatattattgtaactgtgttcatatattataggcatcaaagctatgaagagcgtgagctgccagtgttataaattttttaccgaaataccctagttttacaattgaggagcccttgtttggaaaaccagttaacttccttagataagatctctctgttgtcagttctcaaataaaataaagttatataacaatagaagggtctacatataatacaggatatgtcattagaaatgcattgaattcttatcaaatttcaaggtaccttcccatgtggaattcagaatttattgttagattaaaatatgtaaataagaaaaacaacataaactcaataagcccatgtatacacaggacacttttgggacactatgaggtttgggaccacagggaaccattctcagagatcttcatcaagttaaaatgttctattttaaagtaaacctactaccccattcatagtgaacgtctagtaagatttttttgcttgtttattttgttttttgttttgcctttttctgctttctgatacagttgaggcttaggtatttaggaagcaatataaaaattatccatatttacgaaataggcaagttaatctggttgacttaatctatttagaagttttgattcaatagattcccagtgctgcagtcctaccatttactctttccttcaaatacttaacacagtatttcacttcattattcattcagcaattattgaaaaggctgtgtgtctctgtaaatagaaagatgtagacttctgagtcagcaatttggggtttgctcctggattacatgaattacttatttatgtgaaggcttagtttcttcatttgaaaaatgggcacttctccaacaagtttgcttacgagaattatgtttgcactggtagaaacataaaaagtatgcctcagatattaactaaatagagtgaccatataatttactgtccaatctggatacttttgagaacaaaaggaggtcaatattaataagtacactgggacaacagttacaaatcacaacagcccagggcaaaattgggattcaggtcaatctaataaataatggcattgtagaccttcaataacagcaattcagtctctttcattgtattcctctgagagtagatagtttaaatccagcaatcaacttgcattgcggaaattctgtctctataatatcaatgtaatttcgacttgaattcccaaataaaagcaaaaagtgaaagaagtttttgagcagttttctttaccatgtagaacaaagaaaagtgcctaattaagattttgaaaggtcaaaagttattattattaatttatcttaatttttactgaacgaaaataaatttgttacttatttgacattttttggaacaacattttacgaagtttactactttagcagaatataccatttcctaaattgacttcctttatgttctattaccactgtaaacttgccccctcactcctcccctgccctggcaactcattataactttaaaaagttattttattttattgataaaacattgcagttaaaaactacctatgtatttgttctaagttgctcccacttgtatttgaatggcaaggataaaataaagcctcctaaacggtactatttttttcattgttattccacattacaactaaaatttaccttctattgaagcataaagttcatgtcatgtcaccaaaaagacatgggcatgatatccttatatatttttttcaattaagctcatatcactaagtgctatcctaggaggaaaaaatgatttggagagtgatctcgttcagtttaaaagagcatttttatgccaatatagaacaatgagaatttatcatctgtgataatattttaaatataatgagttcctcttattccagagaatgtgactttcctgaacaacaggagcaagaatcaatgccagattctcttctctaaaaataatcaatttgttactacaggtaaattaatttcacttttttcacttcttagtacaagggggttttaatttctatcacaataaaacacacattttaaatagatgccgtgctatacacattgacacttacttgttgcattatgtagagaaccagtaaaatctttactcacaatttgccaataatttccatagagctttctttctcaatgaaagaggtcactaattccttcacttcacatcctaaagctagaatgaattgtgtcaagctgttagccgtctaggccaccaaaaagagttacgcaaatgatgatgtattcatttataaacactcctagctattttctcagctatcatcaattttccattctatttttaaaaatcatattactttgatatatttctaaagattcttactgttgaatcctaagttattttactctttttcagttgtcaaagttcaaaaacatctgacttttatattgtgaaaaataaccttttataaacctaaacatctgtagtcagaccaggccatctctcccatttcatcaggtgatttctcaaccagaatttctataccaaaaactacagtattctttaaggttctcaaacagatcatatttcctttcctctgaatgtcttcatacatgctgctacctcatttctttacgtaccctattcgcctggctagttcctaagcatttcaaatttcagagtatttttttgttttctcagaaagcattttctgagcctcggattgaagcagttgctattccttatccaaatcacattttatactttttcatataagaaggatctcagaatagcaattaattagtgcctgccacaccacttgaataaggtattaaaacattatgacaaattgcaatgttaaaagccaggagtgaaagaagcaagtgatacaggttagggcaagtttttcagaaattaatgatatttcattgtttgtagtccaacaaaagtgtgttggcagctgcatggtctcgtgacaataatagatattagagatgatgaaagattttcatgactgcagctgaagaatatggggaaatattccgactagctatatctgaaaagacattggggacaatagattatttgaagggtctctaaatacaaatgaacatttcagcatgtggatatggccacaaggaaaattctaagtggagataacaaataagaaggaagatttaaatattaaaaaaccaagaaatcttggggcggggcaagaagtctactaggtagcatgaattatgtggaagatataaaactacagaatttggggaagttaactaaggatggaacagagagaaatggaatgggaatgtgaaaattctgttcctaagtccagtaatgctaccctaaaccaaaatattagagaagtagatgagcaattgagaagacttgagagtgaagggatgcatggtggatttcttaaggttttatttgtaatatcatttttatgaaggaggaggaaaaacttctgtatatacaaaagtgctctatgtttctctccttttttaaatattcagactttgctcaggtttcataaaataatgttttcataaaatgtacagcaaaacaaagataaacttatactactcagatgaccttgttttaagagatgcttgtgccaaatatgaattacaagatgatcatgagatcatctgaatatcttgactggggctcaggataagaaaacaggggattgttggtgtaatgttttattagggctgccattacaatctccacaaattggtggcttaaaacaacagaatttcattctcccaaaatgttggagttgaagagtccaaaatccaggtgtcggcagggaaaagctccctctgaagagactctggggcagaattcttccttgaatctttgagtttttggtggctcaaggaattccttggcttgtggcagcattactgcagtctttgtctccatcattatatgggtctccacgtggccttctctattatgtgaccatgtcttctcaccttctcctttctgataaaggcacttgtcactagatttagggcacacaataatccaggaagatctcatatcaaggtccttaacttacttatctgcaaagagtctttctgcaaagagtctttcttccaaataagagtacattcacaggttcctggggttaggacatgggacatatctttttgggagccaccatccaatccaccacagatagtagcacttcttttttgatcatagtactcataaagatatactttcttttccatttccttttctaagagcccacatcaaaacactgtctaattcatgaagtactgatgtcggctaagaagagactttaattacctcctccagaaatcatctagaataaggaatagtcaaagttttattattctggttcgaatattctgaaaataggacagaaaaatgaatcatcaaacaactggatattttcccctttaatatttcaagtatagatttcactccaagccagcatttgcaaataaatgccatttttatttttaaacaatttagaaaatattttatcacatacctttgagtgtaaataataaatgggttttggcaattgttcattagaattgagagatgtaaaataatttataatatttcattttgagttacgttcatcaattgttcacatttcctaaaatcaggacctcatggaaaaaataaaatttacctacaaaagcttaaaaggcagatcagatttcacaaggatggattatccaaataaaagacacaatacacctttagatggaaagaaacaaacaagcctgaggctaccaagtttatagttaactggtggaaaaatagccattttctcacatgattatcagaaacacaagactgatcacaagtcagtgttgcaaattttatgaatacaaactttcctttttctccctctcttccttctaccctccctcccttcctctctccttccttcctttcctccctacctccctacctttctccatcctttctttcttccttccccccttctttcccttttattgaggagtcagaaacatatataaagggtagattttatatagttaggggtatatttcaaggcacactgtttttgctattgtttttaatatctcagggtaaagtggttagttttcttccagggctgtgggaagtgaagtaagtgcatgatcacacctcatggtggcaaaacaagatactagttttgctttctcagtacctcctctggtcaaagatttgttcacatcagcttatttagctacttttagacttggtatcattaacatgaaggtttgcttatttagagttatttatgtagatataacatgagatattaatagacaaaaccgcaatgttaacatgatgacaggcatatgatattaaaacttgagggttaacatatgcctatagggtccataaagtccctaatgttataattaaaactacttgtgtgagtcagaattatttttacagcctttatctgcttttttatacagatcagaaaaaagagccacacaaagtatttttctcagatttctttgaagcctctctgactttttttcatactaggatcttctattttgccaacattccttgcctatttaaaagtgatattaattatttagtgacattaattatgtattctagaagcacttaatagacatcacttcacatgtgaagtggggtcttcttgcttaaaacagggcttataagacctatttaagtaatatttgactttatatgtgacattttcagcatggtcatgattatacattccatttatccaagtaaagccaaataaaaaaagacaaatctattgacctatgaaaatgattatgcattcataactagtaaagggaatcagtcaagccttttagcatggtgcataaccattgttttaagtggtgtcatactcaagaacaataaatgtatgccattagttagaaaatcatcattaagtttttatgattaagtttctatgttttaatctgtagaacaaacttttatatggttattatttataaattcagggggtcaattgagataaaattctatttaccatgaatttgatttccatttgtacaaataagcctgttaaattaaggattatagatggtataaaaaagaagaaatttcaaattatttaatttcattctggtccacctaataattcttgttatcttggtcttggggtaaaggtagcagtgtttttaaaaacggacctgcttctggattaaatgaatcatggaaatcctgatgcaatcacctgatgtgtctgataaatgtcaggttattgtggtgatgttgtctaatacagtgaagcctgtctccatgggttggttccctatatcaaatttaaaaatgctgtattaatttgtttttacactgctataaagaagtatgtgagactggctaatttataaagaaacaggtttaattgactcacagcttcacatagctggggaggcctcaagaaacttacaatgatggtggaaggggaagcaaggcatgtctcacatggcagcagggagcagggacagtgccacacttttaaccatcagatctcctgagaactcactcactgtcatgggaacagcatgggagaagttcacccccatgatcaaatcaccaccaggtccctctcctgacaaatgaggattgcaatttgagatgagattggggggacacagagccaaaccatatcactctacccctggcccctcacaaatctcatgtccttcttacattttaaaaccaattataccttcccaatagtccctcaaagtcttaactcattccagcgtaactcaaaagtccaagttcaaatactcacctgtgataaaaaaaagtcccttttgcatatgagcctgcaaagtaaaaaagttagttactttcaagatacaaagggggtagaggaattgggtatatttttccattccaaaagggaaaaattggccaaaacaaagaggctacaggccccacgcaattccaaaacccataagggcagtcattaaatcttaaacctttgaaatgatctcctttgacttcatgtctcacatcaagggcatgctgatgtgaggggtgggatcccatggccttgggaagctccacccttgtggctctgtagggtacagtccccatgacggctttcatgagctggcattgagtgctgcagcttttccaagcgcatggtgaaagctgttgggggatctaccattctggggtctggaggatggtggccctcttcttactgcttcactaggcattgctccagtgggaactctttgtgggggctccaaccccacatttcccctctgcattgccttaatagaggttctccatgcaggcttcactcctgcagcagacttctgcctggacatcgggacatttccatacatcatttgaaatctacgtagaggctcccaaagttcaactcttgtcttctgcacacccacaggcccaataccatgtggaatctgccaaggcttagggcttgtcccctctgaagcaatggtcagagctgtatcttgaccccttttagccacagctggagctggagtggctgggatgcagagcaccatctcctgaggcttcacagagcagttgggccctgagtctggcccacaaaaccatttttccctcctaggcttccaggactgtgatgggaggggctgctgtgaggatctctgaaatgccctggagacattttccccattgccttggctattaacattcagcttctctttgcttatgcaaatttctgcagtgagtggcttgaatttctccccagaaaatgggtttttcttttctaccaaatggtcaggctgcaaattttccaaacttttacactctgcttcccttttaaaaataagttccaatttcagaccatctctttgtgagtgcatgactttacactttcagaaaaagccaggtcacatcttgagtactttgctgcttagaaatttcttctgtcagatactttaaatcatctctctcaagttcaaagttccacagatctctaggccaggagaaaaatgttgccagtcgctttgctaaagtatagcaagagtgacctttgctccagttcccaatcaattcctcacctccacctgaaaccacctcagctgagacttcattgtccataccactattagcatgttgatcaaacgcattcagcaagtattttggaagttccaaactttcccacatcttcctgtctttttctaagccctccaaactcttctaacctctccccattagtcagttccaaagtcactttcacattttcaagtatctttatatcagcacctcacttccagtagcaattctctgtattggtccattttcacactgctataaagaactacctgagactgagtaatttatttttaaaaagaagcttaattgatttatagttccacatagctttggaggcttcaggaaaatgacaactatggtggaaggcaaaggggaagcaagtaacatcttatatagcagcaggaaagagagagagcaagggaggatcatcgctttccatcaaccatcaggtctctgagaatccactatcatgagaacagtatgggggaaatccacccccatgatccaaccacctcccaccaggtccctcccctgacacatggggattacaattcaagatgaggtttgggtggggacacaagagtcaaaccatattaaggaccttctttcgtcctgaattggtttgttattcttttgatatttcttccagaagagtcaacttctgatctttgacttgtagcatgagccttaccacaaatgtacaggaaaaaaaaaaaaggaagtcgttcagtgattataaaacctaatagttttattataataatacacactcattttatgagaaattattcaatggttacattaaaagtaagcatgtcaatttattgtccataattgcccccatctttgtacaagaacacgaaggtgcttttacttatactgaaaggtataccactgaaacactgttatatagtaatgttttattgtctataaataattataaatacaattataaattatatgttgttaaatataaaattataattaacagttataaataatgtggaatcaaaaagtaatagcaaaactttgaaagattttgaaatataaaataccacatagaaatcatgagatacagctaaagttgaacttagaatgaaatgtgtataatggcctacattagaaaaaaaagaaatcacccatctcaagaagtaaacacattcatttcaagaaataaaaactaagaacaaaaatccgagtaggaagaaaggaaagatagtttaaaaaaattaaattgtttttgtaaactaataaaatcagcactctgccatctcactccccaagctgttgatgtcctttcatttctttccatgcatgggtggaatattatatttttctctttgttttattttcatttcatattcaaaacatggttaggaaatgtcagcattctagtctccttatttgtatttttttttaattaaacttttctttagcttcagggatccacatgtaagtttgttgcataggcaaactgtgtgttatgggggtttgatgtactgattattttgtcacccaggtagtacgcatagtaccttataggtagtttttcaatccttatccttctcccaccttccaccctcaagtaagccctcatgtctgttgttctatcctttgtgtccatgtgtactcgatgtttagctcccacttataagtgacaacatgcagtatttggttttctgtttctgtgttagtttgctaaggataatagcctccagctctgcctatgtgttctcaaaggtcataatctcattctttttaatggctgcatagtattccatggtgtatatgtaccacattttctttatctagtctgtcattgatgggtacttgagttgattctttgctattgtgaacagtgctgtgatgaatatacatgtacatgtgtttttatggtggaacaatttatattcctatgagtatatacccaataggattgctggattaagtggtagttttgcaaaactgctttccacaatgccagaattaatttacaatcccattagacctgtataagcattcccttttcttcacaaccttgccagcatctgttattattattattttactttttaataatacccatactgaacatagtatctcattgtggttttgatttgcatttatctaattagtattgttgaactgtttcatatgcttgtttatccacatgtatgttttcttttgaaagggtgtctgcttatgtcatttgaacacttttaaatgggttgtttgtttttacttgctaatctgcttaatttccatatagattctggatattagacctttgtcagatgcatagtttgcaaatattttctccccttctgtaggttgtcttaaaaatttactttgttgatagtttcttgtgctgtgcagaagtcttttgtttacataggtcccaattgtcaatttttgttgcaattgcttttggcatcttcatcatgaagtctttgtccattcttatgtctagaattgtgttttctaggttatcttccagggtttttacagttttaggttttacatttaagtaattagtttatctcgagttgatttttgtatatggtgtaaggaaggggaccagtttcaatattatgcatgtgactagccagaattccagcaccatttattgaatagggagtcatttacccattgcttgtttttgccagctttgttgaagatcagatggttctacatgtgtggctttatttctgagtgctctgttccatttctttaatctatgtgtctgtttttgcaccagtaccatgccattttggttactgtagtcttgtagtatatttggaagtcaggtaatatgatgcctcagctttgttctttttgcttagaattgccttgactatttgagccttttttgattccatatgaatttttcaaaactttttttctaattatgtaaagaatgtcattggtagtttgattggaatagcactgaatctgaacattgctttgggtagtatgaccattttaagaatatcgattctttctctccatgagcacagaaagtttttccatctgtttgtgtcatttttgacttctttcagcagtgttatgtaattctcatggacaaaatcttttacctccctcattagctgtattactaggtattttatactttatacttttttggctattatgaatgggattatgttcttgatttggctctcagctaggacattgttgttgtatagaaatgctatagatttttgtactctgttttgtatcctgaaactttgcttaagtactgtattagatctaggagctttggggcagagactatgaggctttgtagttatagaattatattgtctgtaaagtgagataatttcacttcctttttcctatttagatgccctttatttctttcacttgcctgattgctctagctaggacttccagtaccttgttgaatgaaattggtgagagagggtatccttgtctttttctcattttcaagggggatgcttccaggtttttcccattcactgtgatattggctatgggattttaaagatggcttttagtattttattgaggatttttgcatctatgttcatcaaggatattggcctgaagttttctttttttgtggtatatcttccaggttttggtatcaggaagatgctggcctcatagaatgagttagggtggagtctctcctcaagtttttggaatagtttcattagaaatggtaccagctcttcattacacatctggtagaatttgtctgtaattctttctggtcctgagctttttctggttggtaggctttttattactgattcaattttggaactcattattggtctgttcagggattccatttcttcctggttcagtcttgtgacattgaatgttttcagcagtttatccatttcttctaggttttctagcttgtgttcatagagatgtttttaatagtctctgagggtttttttgtatttctatggggccaatggtaatttccttttcatcatttctcattgggcttatttggatctctctctctctctcttttattagtctatctagcagtctattaatcatatttattttttcaaaaagccaactcctgctggatttgttgatctttttatggtttcatgaatgtgtcagtttcactcagttcagctctgatttttattatttcttgtcttctgctagctttggggttggtttgctattattttcctagttcctctagataacatgttggttgtcaatttgagatctaacttttaggtgtgggcatctagcactaaaaacttttcccttaacactgctttagctgtgtccagagattctggtatgttgtatcatagttttcattagtttcaagtaatttcttaagttctgccttaatttcattgtttacccaaaagccattcagaaacaggttgtttaaatccctcgtaattgtatggttttgagcaatcttcttactattgatttctatttttattgtgttgtgataggagagtatagttggtatgatttagttgtttaattttctgagaattattttatggctgattgtatggtcaatattagagtgtgtgccatgtgcagataagaataatgtacactgtgttgtacttgggtagagagttctctagatgtctgttaggtccatttggtcatgtgccaagatcatgtcctgaataactttgttagttttctgcctctatggtctgtctaatactgtcaattggaggtgaagtttcccactgttattgtgtagttgtctaagtctcttcatatttttgtctgacagagctaatttggagaactagtctttgaactctgggattctttcctcagtttatctatcttgctattaatacatatgaccatattatgacattctttaagtgagtgttccaggtgtatcagatcagtttagttatatcttaagatggacatttcatcttttacctcctgtatagtttgtttgtattccttagattccttgtcttgggcttgcactttcctaaatcttgatgatccatctaccttctgaattctgtatctgtcatttcagccatttcagcttggttaagaaccattgctgggaaactactgcaatcatctgaaggtaagaagacaatctggctttttgagttgacagagttctcatgctggttctttcttatctgtctgggctgatgatcctcccatctttgaagttgctggcctttggatggggtattttgcttttatcttctttgttgctcttgggagtctgattgtggcagaaggtgggttcagtccactgacttcacttccggaggattttaggagtccaaagctcagctcggcactcctgggatgagtgctctaactctgatcagctggtactgagccccccagcttgttttttggccccttgaggttatgaacctggtgcactggaagggctgaggttttcctggtacactagccacaacactccaatttccaggggctgccaaccaaagtgctttgttgggacagaggcagtgggatctgtgcttgctcacatgtgccagcagctgcagcagcatggtggggtgcatgcatgttggctgggcaagggcatctagagggggtagggttgtcagcctctctgctagcacttgtgctgatagtggcagtggtgatgggggcactggcagagctgaggttgttggcacctgtgcacaagtttgtaccagcagtggtgatggcactgtgggggtgagtttcctggcatctgtgtatgagttcacatcggcggtggcaaagcagcatcacaaggaaggggtggctgggtgagcttgtgctggcaaagtggtaagggggccgtgagtgagtgcatgctggaaaagctgcacggggagtcttcagcgaggggaaactgggtgggctggtgtgcattggtaaggattagtctgctggagctttccaacagtcaggcatggtcttctggcaaaggagctataacgtgagcccccaggaactgccctggttgggtaaccgaggctgcactgcaagtggatgtggtcaggctggggccccaggagatgccagtagatggaggggcactcagtcatgccctcatcccatgggcgtgactgctctgctctgtccaggtcctacagtcaccctgaggctaaagtctcctagagttcctagaggagcatggcaagctttgagggatgagcatcactggccatgctccgctgaagccattcccatgccaaatcttctgaactacacaggctagagccctgccgtgtcatttctctaagcagatctttctgccagctcaagtgtctgtgggggtcaggaggtcttcttctgctaggattccagaggtccatgataagtgtaggtcactcctcacctgtgtgaattaccccttcgccaggagtcactgggggccaggaatgagtcctggtgcttatctaccctgtgcagggttctcagctttctccccattcagcccagcatttgtgtcttccctgtgtccactctcaattccttccctctgaagatctacttgtaggatgccagtctgccccgtatcacagtctcttggtgggagatgttcctcctggctgcagctagtcagccatcctgaatcccgtcctatttctgtttctgaaccaccattattcttgcacctcctgtaaaaatgcatccatccgcatttaaaataattgaattaaagctattaatcctttccccctcactttcctgtccttttccctcaatttctcatctttattatagtcctttatatcactccccatatttgttaaaatccttgtctatggattattaacatttcctacatataaaccccaaatttttcttgagagtttaaaaaaacacagaataactgtggatgacttaaccaataacctatcttggatctattcaacttcaaaatttaaaaacttcagtatctcattctgtgaccatagcctttaataagtaacaaataagcaaacaaataaaataagtaaaagtattgattttaccaggattctcttttcaaacctcttcttttctttacatatccctccattgatttccccactccatgcccatgatttaaatatcatttatatgttcatgtctctcaatcccattctttataggtaagcaccagaatagaatgtttcacaacttagtggaagtctccagtatgataaacccataggacttccaactaaagcattcaacactaatcttttcatctccctggcaaggttcccttcagacctggaatcctatatattgttagtggcataactaacaacctggtctcccagtataagcctaggaacttttgaattctctgacttctctactggacataagtaaattcatttttaccctatattgactatcctttctcttttccattctcctaactattgctatatgtaacttctaatgtgaatttctgaaaaaacttccacacacattgcttacaagtaatgatttaaagtgtataacttaaaagactataaacatagatttcataagctataaaaagtccttctagaattataaatcatacacacatgcatgtgtatatatacatacttgatgtggtttatctctgttcccacccaaatctgatgctgaattgcaatcttcagtgttgaaggaagggcctggtgggaagtgagtaattacatcatgggggcagacgtcccccttctgttcatgtgatagagttctcacgagatctgattgttggaaagtgtgtggcactttccccttctctctttctctctttgtctctctctcctgctcccccatggtaaaacatgcttgcttcccctttgccttccaccatgattgtaagtaagtttcctgaggcctcccagccatgcttcctctatagcctgaagaactgtgagttgattaaactacttttcttcataatttacacagtctcaggtagttctttatagtagtgtgaaaatggagtaatacaatactccacacacaaacatatgtacctgtggtggtaaatgctttatagatttctttagagttttgaaaaatacctgatacccaaaatgtttctatccactggccaatgtctccactcaagtcattttgtatgaacacgtgggctgacctgactcccatctatttcatagacagtatctcctaccattccttgcttcaaaacatatgccagttctaaatagcgttgattattattctttaaaggtacttattattacttcacacttctttccatttgagcattttgttatctctcccttagaaataaacttctctgattatttaactaggaaattcctatgtatctttcaaaacaaagaataaatatgttctttcttaggaagccttttgtataatggtttatttgtttgaaatgatgtttcacaacttgaggtgagttgtacattattcctatttaggtatgaaattgtatttgcagttatgtttcaaatctatcttcaatagtatgtgttaatgtcatttactttatatatcaagaatgcaggataatgcctggcacacagtaagctttgaatgagcagagaaaatggatgattagctgaggggttctgaaacagacagtatcatattgttgagtggccctgcgctctcaaccatcagcagtggtttcagtggtgttcatgccttttgagtagccttttccctgcttatagaatcccagaagtctgacagtctttcttcatttcatcccatatttgccccctttatttcaaggggattggggagatgttggttaaaggatgcaaaatttcagatagataagagcaattagttcaagaaatctattgtgcatcacggtgactataattaataacaatatattgtatacttgaaaattcccaagagagtagattttaagtgtttttaccacacaaatatgataagtatgtgaggtaatgcatatgctaattagcttgatttagccattccatgatatatacatgtatcaaaacatcatattgtataacaaaaatatatgcattttaatgtattaattaaaaagaaaacaaccttattgactttttttttggaatgtcaagggaatcaacatttgacatgagggctctccgcggattcttcctggataactttatctctattcctagctgctgcgatgatggctgttatgatccacaagtcacacatgtctctcccctcatgaaggtcaaaatttagtattacagtgcaataaccacacacacacacacacacacacacacacaccttaattacagcagtttaaaatgggtgactgagatcttcccaaaagtaaagggaatatcagtgcatactaacacatgagaatatgtttgaaacagcactgttagtcaggaccagaagatttcagatatccagttaatatattttttaaagaacacctttagaattatattacaaccagatcttccacaggaatagtctaaatgggcgatggaaactaacttcactcagagattcagaaaatttgagagagaaaaaaagtgggagatgagatgaaaatgatgagaatatgtaaactgagtatccgtacatgtgtttctggtattctgtcgttcacctctagtgtgaatgggaaataaaagcttcagattagaactaaggagcagtgtgcaaagactgtctgcagatggagtcaggacaactaccctgggcatagtacccgggggcaaaatattaatataatcttaatataatctgagtgacaagccaaacattttctggttctgttaaacatatgattcaaaaacttcacttgaatgctattttagagagggaaaactagtttcagtgctaaatttgtaacagtaattgaaaataactgaacaattttatcattaagaatgctaggctgggcgcgatggctcacgcctgtaatcctagcactttgggaggccaaggcaggtggatcacaaggtcaggagatcgagaccatcctggctaacacgatgaaaccccgtctctattaaaaatacaaaaaattagccgggcgtggtggccggtgcctgtagtcccagctacttgggaggctgaggcaggagaatggcatgaacccaggaggcggagcttgcagtgagctgagattgagccactgcactctagcctgggcaacagagcaagactctgtctaaaaacaaaaaaaaagaatgctaattatgttaattgatatcttagtgaatagatgtttactcttacttatttttcaataaattattctttactaaagtatactattttctttaatactcactgggttcattgaacaaaagggcctggaataaaataagcaaaaatagcagatatttgttcaattttcacatcctacagatttcaaaagattttctaacaacacacagcatgaaactcacataatatgaagacacaaaactggcccagatatacagcattcaaaggagaatactttagacctatcccctactacattattgttttggaagattacttagaatatattttaaaacccacaatacaaacatttattttaataaagtttatctgcaggaaaaattggtacattatgacccatgcttttttttattattatttttttctgagatggggtcttgctctgttgcccaggctggagtgccatgatgccatctcggctgactgcaacctccactcccaagttcaagctattctcctccctcagcctcctgagtagctgggactataggcatgcaccaccatgcccagctaattttattgtatttttagtagagatggggtttcaccacggttttcaggccagacttgaacttctgacctccaatgatcctcctgcctcggcctcccaaagtgttgggattacaggtgtgagccgccatgcctggcccccatctttattatatcatgtcatttcagctgtcatttccattctgccattatataactttccctcattttcaaaatccaccttaaaataaaaatcctcacaatggatttcaaaatatgcccccaatttacccttaaatgcattatttgaaatacctctgtattgatcttaagatgatcattgcttcttcatttcatattagatcttgccattccctaaattcttataatcagtccctttgcctctcatttcctgtattgtctcaaatcccatatctttgtcatttatattttgaagatgccaaataatttttatcttcaaaccagacacatgtttgaatccaataattttatgtttaacactgtggtctctctccactgaagttttccaggtatactttattctcgttaaggctaaaattcgttcttatttttttctcaatatttctccaatctttcaatagtctattccagcaaatgaccaccgaatctgtttaattatccataagccagaaacatgggcttatacatatttacaattccttttgccttcatattgaaacggttattgaaattgtaaggattcatgttccctttattttatcaagcttgttctgcctttcatttaacacctgagtcactgcattagccttttttacacacatctctgttccaggcttagtatccccaatctcaggcagtcagaagggtaagtaattaagattggatctgtagtggctgtaaaaactgagatgatcatccatctcaggtaggttacatatttatatttatgaatgaatgaatgggcttggattaaatgtaatcattttgctcctatgtctgtttatttttaaatgctctatttctagtatattctgaaattttcctcttatttgaaaacttttaaagtaaaaataagtcatttttataatcacttaatatatgacagtagagatgcattttctatttcattcatgtatgttttagatttatatcataaagattttaaatgaaaaaataaacagcagcaaataaaactaataaaatgtatgttagtaatagtattaaatgcattttttttcaaaatgtaatatcagagatatcttaaataacagagctaggttgtcttgcttatctggcaagcaactgctgttataaacatgaatccaagaacaaggtatgaaatcgtatgacatatttttgagctgaatgtatcaaatatctggctcattgaatcatgaattgtctgatcaggaaaggagaagaaaacaacccctactcctgacctagaataattcatatcctgtggtattaggaagatttaaaaaagaagaagaagacatgaattaacaaaaacaaaaaccactagactcttttaatatttgaatataagagggtactctgacacacagttattatatagctggaaagaggattttgagagatcaatattgtagctttcatcagcttattattgctatcaacaaacaattgttctgctttatcgagatgtttaagcattcttaaattattaggggcaataaagacaagcaaacataaagctaaacagaaaaataaatactcaaaatttcagctgtataagatctcaaaatttgttatgcattgtaaactgtcctatttgtaattacacttaagatcccagatcaattttattctgcatgtactttttgaaaaaagatcaaatatgtatattaagtacaaagttgcaaaagctaaaggttaaacttagttcattataagcctttactaaccctttattttctacctttccatatacaatttccttggaaattaccaaaaggaggaagctttgacttcaggaattgtttattctaccataatctttattggtttccttgcttcaattttcaaatctgcaattgaaattagatatgattgcctagctgaacttcagtaagatgcattttgattatgataccctctacttagaaacattatgttctttcctattgtgctcaggacagactatatgttttagacgaggtcttaagacacataataatctagcctcatgctatatggccagttatctctaaaatagctttaccattctcttcattatccctttggtacttgaagtcatatctcttactgagacgctttcttccatctcctcctcatcgatatttggtatctcattccttaaaatgtgttccgtctgtcaacttaagcacatacctttcccattccatgaaattctttgcagctacagtgattgttccttcctcaacatctatacaaattccattcaataatcaatttaatttctttaatgtatatatacttgtgtttcagtttaattttttagtaaatattcattcaaaatttctagagataattttattcattgcagctgtggcatataagccctaactatgaaaaatgtccatatctatatcttcaaattcctgttttaaaaaaaggtgtgtgtgtgtgtgtgtctgtgtgtgtgtgtttgtgagagagagagaaaaaaaagagagagaataatgaataagagctatagaatcactccctttataccatggctttgtgctcagtatagtcagtgctttgcatataatcattgtggtggtaatattagtagtttggcaacagaaaacacttgttttttctggccattgtactaagcatgcttcatgtgttaactctgaattctcctaccgtctctgtaaacacagatggaaaccctgctgcatacaggtcctaggtaattagcctaggatatcaggctgtagattacatacttatcacactatgcactctccataaatagatgattttattaattacttagttaagcttctataagcaaattttccaggaaataaaccatatgattcctaaaagtcatgttccatacatgtaacatgatgctttgtaaatcagcatagtcaaatatgaaagactgatccacttttcagtgttggctgaagttatttttacctttctttgcgtgcatccaaacatgcaaataatacttaagccattttcttttataaatcaataacaatgaaacacacaggcaacaattgcttcatatatgacagctaaattagcacctgattaattgcatttatgcgataggaaaaccatggaccctctcaacatctggacaaacagttcaatgaaagaactttcctcagttcagttctgtgtattcttttgtgttatgaataccttcaaaatataggttaatcaacatttattgagtactcactctgtaatgagcttaatgctaaggattatattattgcaaatgatattgttttatttcactgcctcctgttactcttatctgggtaccttagattttatctcttcacccactgacctgtacccagttggataaaatatcccccaaattttaatggccaaattgattcctccttctgctttaagatatggtgttcctctgccctaaaacttaccatttcagggacaaactgtttataacttagttgttgcaccagtttctgtgtatctaggagtaagaaataaagaaatcctagtaagttcctactctgggtctgctctctgctttatctaaactaaaactcagagaaaagaaaatacctacactgaagattcaagcagccaattaatatttttaatagatagagggctgtttgggtacccacaacacttattttcttacactccttatgagttatttttggaatttttcagtctgtgtattataattaatatgaatctatctttctaaaaatataattagatcagaatgaatttaaattgacctgaatttaaattgacaaggtttaaaatgtgcgatatttgtttctgtataatattttgaaaaggcatttggtgatgatgcctggatctgattttatgagcttttgatcttacaagattcactgctcatggatcacagctttgccagtattctgagtatttggagattttctagtcatctttctgttatagtttaattgtattgtagtctgagaaaatattttgtatgatttagattcttttaaatttgttaagctagatccaggatgtgatctaccttagtaaatattctatataagcttaaatatgtgttttgctgtttttaaatagagtgttctataaacgtcaatttgataaaatggatcaatactgctcttcatttcaaccatatccttgttgattttttgcctgctccatgtcaattactgatgggggggtggggaattatccaactataatagcaaatttgtgtctttctcttttcagttctatcaggttttccctcaaatattttgatactgtgttgttaggtacataccagttaaggttgtgttcttcttggagaattgaccttttttatcattatgtagttacccttcttatccctgacaatttcccctttcctgatgtcttcttgtctgaaatatactttggctttctcttgattagtgatagtatactatcttcctccatccttttaatttgtcataatcttcacatttaaaatgaatttcttgcagacagcatatagctggggcttgtaatttatctaggctaataattattgctattttaccgatgtcattagacatatttaaagtgattactcatatatttatgttaaaatgcaatatatttgtaacttttctttcattacgtttgttctttgttactagtctctacctcttgttctactttttttgttttaattattttatattattccattttatttggcacagtagttacacttcatttttacatatctgtaggtgaactaggttttataatatgcattgttaaataaagttagttcagcttcaaataacactatattttatttgtagcataggtaccttgtaacacagtgttccacattctcccttctgtcgcttctgatgttgctgtcatcattattttacttacttatattcttgaattacctaaatgtattattagtattgctttagataactaactgttagatcagttaaatacaagacaaataaaatatttcactttattccttttctgatgcccttttaaaaatgtagattcaagattctgacttatatcatttttcttcttccggaaaaactttttttaacatttcctgtatgacagttctgctgtcaatgtcattagttttggtttgagaatattacttctcctttatttttgaagaatgatttttgtggatgtagaattctaggttggcagggattttttttctccctcaatacattagagatttgataatcttcttgttttcattattttaggggcgaagtcagctataattctaaacttaattcttctgtaagtaaggtgccccttaccagcttccttcaagacctttttttttgtttgttttactgcaattgaaataaaatattcctactgtggtttgtgtgtatgagaaagactgtgtgtgtgtgtgtgtgtgtgtgtgtttgtgtgtttgtgtgtgtctgaatgaaatatttaccctgcttggtgttttctgagtttcttggtttgtggattagtggctgttattaattttgtaaagttcatggccattttagttctcatttactttttttctctagtgttttcttataaatttttaatatttctccacagttcctgaatattttgtttttaaaatcttttttcttctctttgtacttcaattggtaaatttctatcttcaagattgccgctagcttcgtttattattttcttaatagtgttgagtctactgataagttcattaaacacattcatttctgttactttaagaaagttttctgcattttattttttactttttcttaatgtagccatgtcaatgtgtcctgaagtagttggtgtaagattcagtttatacatttcttatgagattttatagaattcagtgtgaaaactacctggggctgcgttttctttgtaacaatgatttttacaatgaatccaataaaagactactcacattttctgtttattcttttgtgagtttgatgatgtgtttttaaaaataaacttatcatttcacctaagtattcataaaggtgttatgaagttgtttataatattttcttattaacattcaagtgtctatgtgatttatagtgataatctttctatccttgatattgataattttttgctcacttagtgttttctcgaataatatacctaggctactatcaattttcctggtgttggaaataataaactttggtctgttaatttttttcatcactttttagtatgaaatatttactaattttctttgtgattcttcctatcattatggattatttagaagttgtttaatctccaaattttaagtatcatatcttattattacttatgacaaatttaattattatcaaagtatattcactgtataatttcagttttttaaaaagtatttagatttgtttgattttttatgtggactttgtgtatgtatcatctgcagggagttttctgtattttttaggtatattgttctacaattctcaattaaatcattctggatgagaagggacctaagaatatttacatctttagtagttttttctctaattgctctatcaaatgctttgtgagacatgctaaaatttccacgcttgctgttttggacgcctctttgattctatcactatctttctcgtgcattttgaagctctgttattaagtgtaaacatatttgttaaacaaggtttacaggagggcattgttttgcactaacttcctgaactaggtctcatcaaaccaggccaaaccaaaatggtgtaacttatactatgtgcaaggaagtaggtagatccccaaatagaccagttttccctgaagacaggagattcatagcaaccaatcaaaaagagcccagtctacctgagtcagtgtgataagaactgtctcctttgcttcaaccttacaagaaaagtgacctgtagtaactttacgttaactgatctgctttctaaaattgttctgccttcttgctcctcccttacaaaaaccaaccattctggcatggcctgtggaatattcattctattttataaaatgaggtgtttcctgattccagaattaaaaataaaaaataattatatctttatgttaaatttgttgtaatattgtcttttgacacatttatgatggttattttttataaacttctcattatattgctagaaaatatccctttttacatacagtaatacattttactctgaagctcatcttatttgatattatgatatatttatctataatagatattattcattatatagttgatatattattgataatattaaatatgagagttctcttatatttcacctttagacagtgaaactttatgctgcaggtttagttaatgactcattataaggaagtaagaagtaagtctaaaattataatgacccacatagttacaatgactatcttgtgattctaatgcttttagtaatcatttcgtgctcattagtacaaatgagaaagattccataccaagctaaaaatttaaaaactaagttttagtttaaaagaaatatttaaaaatcatttctcgttattactacattagatacattccaaatttaaaacaaacatacctaagaaaaaaagatctaaaccatttcataataagaaataaaacaagaattagaaaaacattttttatcactggctttcagataagttatatgctaacagcaattctttcttgttttaattatcatgatgaatttgggattactgtattaccatacagcctatccagtcagagcacacactttgcttaaaccttaccaactccataaagatttcactggcttcttcatctttccttcagacactttctgtctttaagaattatggtgaccttctccaattaagaattatatagtgttctgtattttttctttctattaattattatattttaagtggtgccatttttatagaaacattcatagcaagtagtatgtatgttgtaatagaaagacaaggaaagaaaataaaaataataatttgatatgtaaacttttaaagtaaatactgattaacttcatatgtaaaatttgcataaacttttaaagtaaatactgattattaacttcatatgtaaagtttgcatctgaaattatcaattcatgttttctatagctatcatgttaaaaagatttacagttagaggcctggtgcagtggctcatgcctgtaatcccagtactttgggaggccggggcgggcagatcatgaggtcaggaaatcaagaccatcctggctaacacggtgaaaccccgtctctactaaaaatacaaaaaaattagctgggcgtggtggggggcgcctgtagtcccagctactcgggaggctgaggcaggagaatggcgtgaacccgggaagcagagcttgcagtgagccgagatcgcgccactgcactccagcctgggcgacagagcgagactccgtcacaaaaaaaaaaaaaaaaagatttacagagtaggagtactttcaagacattgtgcatcagagtgactgtaactgatgacaatatattgtattcttggaaaatgctagagtggattttaagtgttttcaccacaaaaatgataactgtgttaggttatacatttgttaaatagctagatttaaccatcccacaacgtatatgtacttcaaaacatcatgctgtacacagtaaatacatacagttttatatgtcaatgaaaaaaataaatttgaaagaaaaaaaaactttgaattacttgattcaacatttgtttgtattaattaatcatgatttcctagtatagtgaagagcaatttagtgttgataattgagtcaagcacgaattatcaataaaataacatgaaaaattattagaatgctctaccaatgcaaaaatgaagctgttaccacccaaatccactgaaaaactttagcatctcagaaaataagacaattagtgttttgtgcttcctgatgaaattcagtatgaagtacatgggacaatctatgaggtagtctcattaaaatacttggcctgaatctaatcaaaattctaagattaacttccatgtacatgggaaaacacataataaggaaaaaaaatataaatgcaactaaaaaatagacagacacattaggatatggtacattcaaatggatggctaacagggtgagggggacaaatctggactgtaagaaagttaagagacacatcaaatataaatgcaataggtggtctttatggatcctgattcacataaacacacggtgtaatttttatgatatcagacaaatttgattattgattatgtgtaaatttatataaaggaaacacttgataatttttcttgaaaaatactggctttaccattaagtaagactgtgtcctctgttcagagattcagtggtaaaatgacatgtggaatttgctttaaaggccttagcaaaaaaaagaatgaagggatgcatataaaccacatatagcaaaatcctgataagttgggaaataaagagattcactgtactttcctcactactttaaatatatattttaagttttattaaaattttgtatagtataatattttcactgacagaaacagaatgaaaaacttgaaggacaaatagtaaaggtttttttattttttttctgagatggaatcttgctctgtcacccaggctggagtgcagtggcacgatctcggctcactgcaacctctgcctcctgggttcaagcgattctcctgcctcagccttcgagtagctgggattacaggtgcccaccactgtgcccagctaagttttgcatttttagtagagacggggtttccaggctggtctcgaactcctgacctcgtgatctgcctgcctcaacctcccaaagtgctgggattacaggcatgagccactgtgcctggcctagcaaatgttaatttaaacatagtttgatcttatttatacttcctcttaagctatcttttgtgactcaattaatgggtcatttgttgattaaatacagtattatctaggataataaaattttttttctataaattatgtatggtttgaaggcccaacccccagtacttgagaatgtgactgcatttggagatagcttctataaagaggtgattaagattaactgaagtaattagggtgggctcgaatccaatttgaccagtgtccttataagaagagaaaattagtacacacaagaggcatcaaagattgtatgtacagaaaaaaaaaccatgtaaggccccagtcagaagacagccatctacaagccaagtgggaaggtttcaagagaaaccaaacctgccaacactttgatctcagacttctagataccataacagaaaataaattgtttaggccactcagtctgtgatactatacttttgttttggcagccctactaaactaatacagcattgcagagaatgcagaagtgtaaagataagaaaccccaaaataattaagaaaatatgaaacatgaaggaaattagtacagattcttaggagaccataatctatctattttactaaaaatattttactatgtaactaatattttttggactagatcttacattctcaaggacaaattttaaatgcattaatacagtattgcaccttgttaaaactgagttaatggaatgcagtggccggataaattaagaaatttaattaaaaattaaatataaacttgagtaaaactcttaacatagaaagttgaatttaaccacaagattatgggtaccttattttttaaaagatgatttatgaaatctttcttgtgtttgcaaaattctttatgtatatgttcataagtgtttggccaggtgagtaggcaaaaaaaataaaaaataaaaaacacagaaaatcaatgaacaggagatggtggtttatggaagtcaaagagaactggattctagagccagctccagcaattattagttactgactcacactaccaaaatctttagttatcatttcacagagaaaaagaggactatttatatattagtctttttagtgttgctataacagaatacttgaggctggataatttataaagaaaagaggtttatttggcttatgattttaggtcttgtgagggactccctcatgctgcttcctccgtggcagaaagcagaagggtgcaaaaagatcagagggtaagggaggaagcaagagagagagaaaccaaggaagccagaccctttttgaacaaccagctctcatgagaaataacccattctcttaacagtgagaactcactcccccaaataaatgcattaatgtattcataagaggtctacccccatgatctgaacatcacataccaggcctcacttccaatactactacatcagggatcaaattttaacatgagttttcatggggagaaaccacatcaagctctatctatcatctatctatctatctatctatctatctatctatctatcatctatcatctatttacttacctatgtacttatatatgattataagaaacatgaggttaattataagaaattggctcatgtgattatggagccttgaaatacgaagatagaggcagcagcagatttgatgtctgatgagagccctcttttgctcttaaaaaaatggtttgcctaccactgccttctttctgtgtctgtatttcagaggaggagagacgtggtgtcctcatcctcttataaaggcatgaatctcatcatgggggccttgctctcatgatctcatttaaacctaattaacatccacaggctccacttccaaataacattatgctgaagattagggcttcaacatgtgaattagtgggtacacaatttggtccacagcattgggccctggtacaacaaattcatgtctttctcaaaagcaaaatacagtcatcccttgatatccaaggaggattggtcccaggacctctcgcagataccaaaacccagatgttcaagtttctaaaatggtgtaatatttgcatataacttgtgcatgtcctttcatatactttaaatcatctctagattacttataatacctaacacaatgtaagtgctgtgtaaatatttgctatactctattgtttagggggtaaatgacaagaaaactgaatctgcacatgttcagtacagatgcaattttttttcaaatgtgtttgattcacagttggttgaatctatggatgtggaacccacagatacagaaggctgactatatattcattccattttaacagccgcatgagccttaattcatttcagcatcaactctgaagtctaaaattcaaagcttcttctaagcatttttaaaatcagatatgggtgagactccaagcaaaaatccatgctgaaactaaatatccctccagctatgaaactgtgaaactagataaggtatgcaatttcaaaatacagatatgggacaggagtaggatagacatcctattccaaaggtaaaaatctgaagaaagaaatggataatttatctcaaggtagtccaaaacctagcaaggcaaatatcattaaatattaacatgttaatcctgtctggtttgatgctctgcctttcagaaccactggggcagcacttctgcctccatggctctgctggtcatgggccgtacccccaaggatttgtggggcctggtagctggcctgggttagtcaagatcatgtccctcactctttgagaccaaagaggcatccccaatgatctctgaattgcctttgggataattcttccattctcttgaagaatagcatatatttgtagcagaatggcaaaataattcagtcctaaaaatagaaatccaagagctttccttcatttcatcccatcactttccctttcagttcaaactggtagtgtgcctgctcatataatcctgtgtgtacgttttcctgcatatatcgcccatctaagcactttgtgtacatacttgtatagaaaatttaattgtgctagctttcatttgtatgagtttgctagtgcctcccttattaaaacttattgcagcttcacctctttctaagataattcaatagaaagccatggaacttctaacatttttgagtttgttttaaatcagaagcccacctctgaagttttgaaatagtgaatcaaaggggcttcaaactgttaatttatttttcttattttattctctcaacattctaattaaatgtatatgtaaacttgttcatctcaatcattgaggtaacaagatttttcttttattatctcttcattttattattattattactataaaagcagtagtggtggttacctgaattagctttggtacttggagtttctaagaaatgtgtctgaatacttcatttatatcctgtctaccctcttttgctattttccaaaatttgttaagttgctcacaaagtggctctcatatattgcttcatttaattcacatcctttaaaaatctgtaatatttcaaaatgtgctaatttccttcaaaagcttttgacccaccttaatggatttgatgatgaaaggggaaacactgcacatagcaagaaatggtatgaaaggaaaagcactggatatttcctgagtttggtaataactagtgcaatttatttgcaatccctatgtattaaaacagtttggctcatccaagaaggtactgcagttctctagaattaagtcctgtcatgaaaccgcttggactcatttaatgcttattgattttcataaacaaacactgaattgttgggtggttaagacaaaaacaatcgcacaaactgatatgctttctccagtatagatatggtttctccaatacagacacccactacttggaatgtcttcgtttcatggccttttcttctgatttaatactcacaaattatttcttcccagaataattttgctatcaaatacctaaaatcttaacagaaactgaattattttgttcattatactcgctttattatttatttgtcaattcctctataaaaccatgatttttccttcgtgtttctttctaagtacattgcaggtgtcagtacacttgcctttaaatacttcgtcatgaacaccatgagctagatctgaattttgtttagctttttcttttgagttaaaatatacatacaatgaattacactagacaaagtgtgcattcactgtcatttgacaattgcacacacctttataatccaaagacctatcaagcaggaggacttaagcaagtgcatcagtggccctctggaacagctctagcttactgtgtttcagactacatcggggaaggattaaggctctagcactgcagcaggaagttaaatgtctgcagtcacactgcccatgccaactgtggatcagatcttctggccgtggggtccaatgcattgcaaaggactggatcttgtgtacagtgtctctctccactttttgtacgtaagcactttagacttgaccttagtgtgcatgttttttgttttcagcaatcttgaatcatgtgctggtttcttctctgggtggcaattatctgcttttaactttggccacattcatgtcatgttctattctgcagcacattctgactatccagtgaatagggaaataagtagcataaataatcaactttgtacttctttataaagattattgtggatattcctaggtactttgaacattcatataaactttaaaatcagtttgccactttccgcccacacacacacacacacacacacacacacacacacagcttaatgtaatttagatcgtgtttgtcttatatctgtaagtcaattaggaaaacaaaattgccactatcatagattgtcttcaagtattagtaccttgaattttatgaaattcatttcctacatttaaactcacataaatcctctctacatcattgttgctattcgtgtttttgcataaggggattggttctagaaaaaaaaagaaagatgagaggatcttcaccctagaaaattcaacgttcacaaagactttccatcacatagtcagatctgtcattagaaaacttagtctcttattttccagtattggaaaaattaacatcatcttcttcttcatttttcttttatttatttattaaaattttttttattattatactttaagttctagggtacatgtgcacattgttgaagacagtgtggcaattcatcctcttcatttttcttcatcaccatcatcattgtcttctttataccattatatattttaaataaaattacagaaccaaaaacaaagtaaaaattaaaaaaaacttctacataggatgtcagaatcctaactactaaaatgaattaaaattgaacctattttcaatgtcttcacttaaaaaatatctttttttctgattataaattgaatttatatgtatttgaaaaaaatttttagaggaaggccttagaaagaaaatacaagtaacaattaaactcacaattccagggaaaaccaatgttaatatttgtgtgtacttcacagtaaactatataaaataaatgaataaaaatataggaatatttatagtaatgtacatacataaaagaatgctataccaacataattttttaaagttaaaattaggttagttatttttatcatgcttttacatttcaaaataaacaccaagtattttgatgtgtcagttaatatcctttgaaaatataatttatactaattacttttccatataaaaatgaaatatcattaatttatttacccaaagttgagaatctttacatatttttactattataaataatgctatgatatttttcccataaatatttgattaaattacttaatattactctggaataatttcttaaaaggaaactctggatcttgaccatattgccacattttctctgcagtgtggggcttgatttatcattctatattctgtattagaaggcacctgtctccacatcctcactgactgttaagtgacaccatgtttatattacaacaccttgataggtacaagaaaaaaaaatatggaccctacattcctggaagaaaaattcacagaaagagaatatacacagattaaaagacaataggattagttattaagaagatgaatacaataaagaggatgaagtgggtggaataattgtctcccagaaatgttcctgtcctaatccctgaaaccgacaaagattccaatttacatggtaaagtgaattaaggttgcagatggaatcaaggttgtgaatcagatgaccctaaaatagggagatttccctgtattataccgtgagtccaatgcaattccaaaggttcttataagcgaaggagggaaacagaagaggcagagtcaaaatgaagtgatatgagaatgatttgacctgctacctcaaaccacccttgaaaattgaaggaataagtctatgagccattaatgtgggtggcttctagaagctggaaaggaatgagaaacaggtttttcccttttaacctccaaaaagaaactcagtcctgctgacactttcgttttggccaatgaaactcattttagcctccagaactacagaactataaggtaatacatttgtgttgctttaagacactgagattgtggtaattttttacagcagccataggaaactaatagaaaagctaaaagaaaaataaacatgctatggtagtattaaaatctatattgttgccaaaacattccatgaaaatccctttcatagtgttatcttacgatccattttatttctgtggcatctgtagtaatgttgcctctttcatttctgatattgagtcttctttttttctttatctagctaacatttatgaattttgtttgtctttattttaaaaactgcttaatagtctattttaagctgataagttcaatagcacacagaaactctagaataatctctgcagtcacacacaggagctctaacaccctaccccacactttattttattgttgctgcaatttacatccattcatattgtgtctcttttaacatattttatttctttttttaatacttttgtcttttgacttttatactagaattaaaagtcattattactgtagtaatcatttcactatgtatatgtatatgaaaacatcatgttgcataccttaaatatgtacaataacatatttgtaatgaataaaaaataatagtcatttatacaccactattgcagtaatgcaatatctgtatctgtccctatacttacctttattgtcaagtttcatactttcttatgctatggtgttgctgtttagtatcccatcatttcaacttgaagaactccttttagcattttttctaagacaggtaatatactattggtgatgatctctctcagattttgtttattttaagtagtttttaatctctcctccactattaaaggccaggtatagtgttcttggttggcagtttcttttcttttagaactttgaatgtatcatcccactccctctggcctgcaaggtttctgctgaaaattcagatagtttcatggacattttcttttatatgacaagttacttttctctttatctcaaaatacactttgtttttgactttttacaatgtgattacaatgtgtctcaatgttgatttgtttgagttcatcttatttgggaacttttgggcttcatggatctgaatgtctattgccttcctcagatttgggaagtgttcagccattatttctttaaataggctttctggccccttctctcttctcctctgatacttccttaatgcttatattggtgtccttgaagaggtcctatcagtttcttaagttttctccactcatttttgttctttttactctactgactgaatcatttccaatgatatgttttcaagttcactgattgtttcttctgcttcgcctagtccattgctgaagctctctattaaataatttaattcagttattgcgttcctcagcttcaagatttctgttttggtactttaaaaatattttctatggctttgttgaaattctaacttttttcctgcatttttctcttgacctccataaacatctttatatcatattttgcattctaaatgaagtaaatcatataatgatgtttcattagggttggtttctgaagatttatctcttctttctttgtttggaacatctttgcctgtttctacgttttccttagttatctgtgttgatatttgcacattagacacagaaggtcatctctcagtctttacagactagccttgtataggaggaaacctccaccaaccagcaaagccagagattctagtccttctaataactctctctctccatgaaaagaagcaggtgtgatttttgtctactcctctgtgctgacctggggtgggaaactattgtatcaaccagtccaaactaccatttctattaatcttttatcccaggtgtctagactgtaccagacccatcagagatccaagagtggcaagtctcttaccagttctttgtgtagtcctggagaggttgggtgctgggctcatgatcaattcttttcttctctagaagaaagctgacacttgggatattttttctgcttgctctgtgctgagcaggagggagtatctatggtgtccaccagcactagcttccatctattttcttccctggtggctagactgtgataggcctctcagagctctaagactggtcagtaagatgccagttctttggagagccctggagaaatttgggtgttggatgcaccagtcaagtcttccacacccttcccaatcccaggagaaagctgagagctggaattttttgtctgctctctatgtactgagaagtagggaagatctatgctgtctaccagctcaagccccatctccattctcccacaggtgtctagactgtgccagacccattcgagctctaaaactagttagatagatgctagatcttcaggcagccattgaaaagttggagtgtcagatacacagatcagcactcttcctccacagcaggaagctgaaagctgagatttcttatctgcttactgtatgccaagaagttgggttatgggggggcagggtctgtggcatccaccagatgaaaccaccatctccatcctctgcagaaagctagattgtggtagaccagtcagagctccaactgacagacgtaattcgtgtataaagcccctttaaaaattttggagtactggacacaaatcaatctcttccaatgactgggtgaagctgggaactaggggttctctttctgattgtatggcagtacactggggacagggactccactgagaggatgttctgaatctccctaccaactttggtaactctgatttttcattttcccaggatgtggtagtcattcaattagcttcagaatttcttacaaagataatttgttcaaattgttgttgaaatatgttctggggagtaggacggtgcagaacttcccactctgccgttttgctgatgtcactctgtaggagatgcttgatcctatttaaactttctattttagaagatagttgcctttctatgtttagagtatttatattctggtgtgcttttgtgggctgagttccaaaaatgtttaattttgatagctctttcaatattattatactttactttgcttttttaattctgaaggggtttcagctcaatcattgctggtgccatctggggcagaaggccctttctaggccattcaagtcattgggccactttgacgcctgaagatggaaggaacaaaaacaacgaggctttggtcttcctatgtcatttgatagagggctaggaaatatcaagtttgatggataatacttctgtggctcattcaggctgcatttcactggccttattctacagcagggttgtatcagctaggtaggccttcactgatgcctctgaaggcagatcagttagctagttacctggttatcgaatgacggttaggttagtcatccagtgctgtgatgttgccaatatgggtggaatggacagcccaccagtgcactgaatgtggactgtgtttggtgggcctgccaagtctgaaatggccactgtgggtgaatcaacacacacatgtgtcctgactccctgactctaaagaaggggctggagcaactccccatgtctttgccgagcttttccattcttagtcatttggccagaaagtgaaagcttttctttagctattattgttattatttttgtctatgcctgttggaggtttggggttaaagatctgtctagcacccagtttgggatatacatgaaagataagaagaaactcagataactgaccttcctcaagtccaaaggtcactagtcagaatttttctttttattaaccatccttctattctctatgtccatgagttttcagagtctttttgttgttgtccattgacttgtttcagagtattaaattgtatttagaacgaaggataaggaaaaactgaaactacaaaactttgttccagagcatgcatttatcatagatgttgaataatgttcttctttaaaaacataataaagtgtaaacatattttgagtaatacttatttcactccaagaacaatcagcttcaagtcaaccattatttattacataaagaattaaaccaggcattatatgagacactaatatttgtgaaagatgcaaatgatgctcttgaggatcttcctgctgacaaggctagtgagaagaggaagttagcgaagaaacagaaaattaaataaatattgtgccatagaaaggtatatgataagaaccaaaaatttaaaataacataagaatggtttttaaaaatgtctcttagataatgttttcaactaatttatcatctgaaatggaatagaaaatctattaatgcttatgacaatttaacacgtgtaaattgaaactgtctcagaaattgaagatataagttcagcttacccttaaaaaattttgtttcaattattgtggaaatatttgcaaataattacatatttaaagaactgtatagtgaatcaatttcccaccgtttatattcaataactatctgtgtatggccaagttttattttctgtacactccctattcccttttccctatcaatatttcagagcaaattctaggcaattttttgagtcattccttgatgaaagcactaatcacttttatctcatgtttttttctctttctcctcttccccactggattctcttataagaagaatttctgtacactcatccacatgctgctttttgttttacttatagtgctgcagctctgatggttcaactctgccaaaagatggatctttaatgattagcactacacactgaccaactcagaagaaggagccacaccacctgtgactccagccctgacttctgctctggaccagtgtttccataacagggacttcaaaatcactgtgatttgaagcctttttgaacatgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggcccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctgtgacaccctcccagagtcaacctcgggtgatgccttctcagagtcaacctcctgtgatgccttcccagagtcatcctcagttgacgccttcccagagtcaacctcctgtgacaccctcccagaggcaacctcagttgatgccttcccagagtcaacctcctgtgacgccctcctagagccaacctcagttgatgccttcccagagtcaacctcctgtgacgccctcccagagccaacctcgggtgacaccctcccagagtcaacctcatgtgacaccttaccggagtaaaagtggtaaacaaaagcaatcagtaccaattccaaaaactgtatccagaaaaggtacattaaaaaaataattcctagta

SEQ ID NO: 352 - DNA, 59823 bp, Homo sapiens; identical to SEQ ID NO: 351

SEQ ID NO: 353 - DNA, 59823 bp, Homo sapiens; identical to SEQ ID NO: 351

SEQ ID NO: 354 - DNA, 59823 bp, Homo sapiens; identical to SEQ ID NO: 351

SEQ ID NO: 355 - DNA, 27945 bp, Homo sapiens
attgcgcggcgcgaccaggttcaggggcgggccgcgcggagcctcatttccccaaacgcaggcgctcggtggcggtagccgcggttgttggccgaccgagtgccggtcataagccccccccggtggggggcagctggtgtgcggatcgcggcgggagagaggcgcggtaggaacgggtccccggagccgtgaaccgcgggtacaggtgtcctgtctgcgctctctgccaagccggcttgcttcctgatctgttgctagggccgctggaccccgttgctaaggacccttgagatcgtgagcgcttggagtgtacccctcctttcctggggtagagggtcagtcgagagtagccttcgttaaccttaattgaaactggtaaactcctccctcggcccctttaaaaaatctctgttttttctttattttttttctgtgtcttcctcttttgctgactttgatagcatcctggctctggactggtctttaagtatctagaagtgagtgtaggaggggtggctgggaaggtggaaaatagattctaagacccctaagcagattgtgcgaccctaatactggccctttgaatttactttctggtaaaaaagggactgggataagtgactattgggctctgggtcttttagaatttgacagagctttacaaatggaacatggtttctttagtggggctcttacttacacgtttggaactttctagacctggattagaaagcagggctctgctgactgagaattgttttagttcagtggtcttaaagctgagtacgggagaaagtacatacagggaaagaaataggctatatcagctgcccaaacaatgatagaaagtacactttcctaccattgacacagataccggcagtcccttgtagatagatgacctgtagcaaccaaggaagctttaaggggaatgtgtgggcttcatagggtggtttgtttgctttctgatattgtgacatagtttaggtgttcgaagttaagtggatttatggattctaatatctataattagaatgtttatcttgttttgtaaaagaatgagcggtgaccttgataatatttgtaacacaaaatagttcttacaggttcgcttctccccatcactgcccctttacaccatcctctacatgttatttaatgaaaaaccacttgaaagggttaccaaggataagatttttaaagcttgctttcacaaacaactcatgctccaggcttgtcagtggcatgcttccaggtggatattattttaaaaaattgactacatttcccgtcgtcccttggtgtccgtggagaattggctccaggactccctccctccccccagtctctttcagatacccaaatccacccatgccaaagtcctccagtctgctctccgtatccgtggttgggtcaaatctatagatgtggaacccgcatatacggagagccaactgtaatttgtcgttaaggtaaaggataaaaattttaagtgaaaaagcaattgttttggaaggaaattctctaatacaggattttgaaaggggatgtagacgtgtttgcattactgtatgtttaatgctgaaaattatatattgtacataaaagttgtcctgtatactcataaactgtagaagctcgattttctaccatgtttaaaactttttcaaatgagttttggtgactttttgaactcattcaaaatataatgcaacacctccccattagtttgttacaggaacaactttttgacgtgaaggaagatagaaatttagccataaaattccatccaaaacttccactgaattggtaggtagtattgaaaaatgtgcatcataatttgatatggctgcctgtgcccttgttatgtttgtgggtacgcgtctttgctgtgcatcgcttttatctgttgcagctgttaacaattgatgatcaagagaaattggacctcagctggtcttcaaattgatgtagcccaagatgttaagccagattttttaaaaatgacaaaacatgtggtttcactattagtaatagtaatactgaagaacactttgtaccattgtaaagaaaattataataatagctaagactcatgtggcccttactgcatgcctcccattatggaaatgttgttttacatatattcttactagtcttcatcaacacttaaagtagttcctgtaattatgcccaattatagagttgaggaaactgatgcattttttttttcaatagaaacttgtgttgttccccctccaggagcttctcaaaacagaagtcaggcacaatattaaatacttgttgaatgatcacagaagtacaatagtaggttaacatatttaaagcttctctcagcttattttagactattatctgacaactttaatgagattttaattaccgtagtattagaaaatggccctgggaatggaggtgaagtgtgatactgggaagtaagtcatctgctggtagtgggatgagataaatgagatcaatgtactaaatcaaggaaattgaaattattcagtgtgcagaagcaagcttacatttaggttatctttacatggtatcagactttaagctggtacatcatgtttgagatatctggctaaattttataacatggagctttgtcctccttttgaggatttctaacttgttaagtggattaaaagcatttcatgtgaggaatcattttaaaaagtatcagtgtttatcctgaagaagaaaaaatgaaggagttaagagttaatgccatcaaatatttgaaaaagtgtcatttggaggtggaagaggactttacctgtgttgtcctaagggaagatcttacactatacttgagaggcagtcattattaaaggcattaaaatgagacgtgtgctaatagaataactagattgtcgtggaagtgagggaacagagtaatcaagtagaaataaggacacaggatagaaatcaatgccatagaaatacacatttgagaaaccaagatgaggaaaggcttcatggaagttgggaatgaagcttggcctaaaaataccagtaggcacttgggtatatgagtgtgtgtgtgtgtgtgtgtgtgtgtgtgtgtgtttgtgtgtgtgtatttcttgctagagatacaattgtagaaattgattggattagctggaaaccttggggtatgaactagagtcctccattagcagaaaaaaagcaactgtgtaagggaaaagtgaaccagtattccctgggtgagtaacttgagagataatttcatttgcacctccagaaaaccttgacaggcttttatttccctctttaaacaggtcaggaagtcgaggtttagggaggttaaataatctgcctaaattcataaatttcataattggtagaactgagatgcagacccatatttgagcccaaagctctttctttctcatcacgtgtagcattgagtgtaggaaatgaaggaaaaggagacaatggtgattctaagtttttcagtctgaggaccagaaaactggtggtaccctgggttaacaaggggttcataataacttcagtgtgacaacctcagttttagttacattcagtttaaggagcttgtgatacattgggtaggagagttcattatgtcactggaaaagtagagcttgatgtgcacatgttaacatttggagctttggaaatacagaggccagagaagatggagaagatgacagggaatgtaccaaccactcctttcagaaatctagtctgtgttttctaatgtggtcagagaattggaagtgagtttctaacagtttattttgacaatttgaatggaaaaaaagttgacttttgtacatcatttcttggagatgattattttgctgttattgatactattgaagttgacataatttcatgttttctcattagtcttttccagtattttgctccatatcaacttttttgtgtgtcttttactgtattgtatactctgttctggttttgtctttttattgataacaaatgcccctccaaacaaattttgaaatcaacttttttttttttaaactgcaggagtgaaagggaagcaatgcagaaatcagagggctctggaggtacacagttgaaaaacagagcaacaggtacagagcttttgtttttaagtgaagaggtcaagtttgttcatggcactttctgtgctacagatggatgcagggtgaactttattgcttgtacctggtttctattgatgttctgtttttttccaggtaactatgatcaaaggacatcatcaagcacacagttaaaacacaggaatgcagttcagggaagcaaatcctcattgtcaaccagttctccagagtctgcaagaaaacttcatcctagaccaagtgataaactgaaccctaaaacaattaatccggtaggtccaaaactattcctaactcagtagattttttaaaggcatttcgcacagtattgaacaatgctggatgctgtgttgagttttgtccctttgctagttttgagctaataatgagagaagggcatgtggttattatgatgaagaactgagataatcagtcacatgtgggagtgagtatggaggtaaggagacatagaagttaacctgtttgggatatcgcattgtagtgcatagaaaattgcactttagctttagattttatttgcagtgttgttttacttccccatatcaatgaataaactgtattcagttgccacagaatgcttttcgtgcttctatagttgcataaaggtctctgacctttcctgtgttctgtaaattagttccaccagaaatcctagttgtagtactaacctcctttgccctctcctaacaatttaatgagatttaataaacatgggatttatgcagtaaaaatattcagaagtgaacacacctgtgcaacaacaccaggtgttatttgccccatgcccaactttggtagggtgagatgttagtgatttcagccttcgaaggggattgtgagggtggctgaagctcctgactgactgtggtggtaggtaggggtatggcagttacttaaggaagcaaaggtatagtgagctctccaagacagaaggagtgtccgactggataaaagcaaagtgacaaatagtttgagcggctatgttcctttgcttttttctgtaatctacagtgtcaaggaaattgaatacctgaagaaggccctaataatcttgttgctctcacttcctttgcttatgtttagttgagggagtttacggtgacgcttcaattttcttcctctctttaaagaagtactttttgaattaataatatttagtgaccttagtcctaagttttagtaaaaatcgaggaaagttttgggaaatagttaaataatttgacccgagaaaagcatgtgtaaaagctaccaatataaaacaaatgagttggaagtcagaataatgttcacctttggggcgaaaggtgggcagggatttgggagaggcagtggaggcatctagtgtgctggaaactttcagatttttcaactctgttgataaacaggtgtgttcattttttgtgaattcactattgtgatttatgcacattaatattttaaatatttgagttaaaaaattttttgaaacgctaattcagtgtagtatagtatataacattaatacagagttgaaatatggtctgaaattgttaaaaattgaatgggataacatttttcactttagacttggtaaaatttggttaaaatcgataaaagtaatctattcataaaaaattctgattttgtggaacatggaagatgaaaccatgattatctctagaataaaattgaaaggcaaagaaaggaattgtttagcatttcaatcagaaatttagtctttgtgggtatattgaaattttagggattattttcatgacctgtaagggccaaaaagaaagatcatttgcttgtagatggtagaagtcaaatatgttgatagtatagtactaatttgtcttaattttttctccaatatgtgtagcactttttcaaacaactttcttatcggatatgcttgttacttgaaaataatttttaaaacttgtgtttcttttatagcagaaattataactagatgagtgaaacattcctcttgtgaattgttacacataacatggattgaattttggaaatgaatctttttttttttttgagacggaatctcgctccgtcgccaggctggagtgcagtggcacaatcttggttcactgcaaactccgcctcctgcattcaagccattctcctgcctcagcctcccgagtagctgggactacaggcacccgccaccatcctggctagttttttgtatttttagtagagatggggtttcaccgtgttagccaggatggtctcgatctcctgaccttgtgatccacccgcctcagcctcccaaagtgctgggattacaggcttgagccactgcgcctggccagatatgaatcttttattgtaatttaatttgaacgaattttctcctatgtgcttttactcaaaactcatgcttttccagaggaaaaaagagctgattctaaactttttaagcacattttaaaactaccactgtgtgtgacttaaaaaaaattatctagttatatctttaaaacaggtcaatttatattttgtaatttagacaactatttttcatttgattatatattaaaagtaccatgtgataaaatatttactttttgttcctaaatcctctgtaagtctcttatcaattatattgaaattatttatgctgtaattgtttaactgttgtgattgaccatcccttaaatcatctttaagagtaggtataaaatcaagctattcatatatagcaaaactgaaaggttatgaagttatatatctaagaaaatacatccaggcatatatttgtgagaatcttccccatcttcaattctctccctcctgcccagcgcaatcctttgttttttatagaagcctaaagccagtttggagaaatgtgactacctacgccatctgtatttggctgaagcacaaagtaggagatgtgcaggtggcaaaaaacaaatatactttttctgtacttaacaccccttctccatagagtcctcaccttgaaaggtcacagtggggaagaaggtagaaagaactatcattccatatgtggtttcagccgcgttcaagcatcctgaatcgttaggggaaaaagagatgtaccaagtgtggtcgtggtattctagtagagagaggattgacagtttttctcaactgtgttgctgagtagaaacggtgcgcttcgataccagcttggcggtttgaaaagcaaaatggctgtgtgcttctgacctcagaagtataggtgatagtaatattttcattttttattttagtttggtgaacagtcacgagtgccttctgcatttgcagctatttactctaaaggaggtattccttgcaggtaaaatcaatatgatttataactgaccaaattattcaaaatcattgagtaaaatgaatacaatatttagtttaaatgtattgtaagttttatttactagtgaggttgaaataaagatgactttattcacactttcttttggactggtatagattcctggatgttgttgaagaaaaccattctagttccaaaatacagttattgggatctatggataaaccatcagtttaagaactttacttgaaccctttttctaaaataatcaatttaagcatttgcaggcttgggcaagttgcaaattaaaaaatcctatcttgttggtaaaatgaaagttgtcaatttaatgaaattgtttatatttcataataaatacatatggctgtttttgcttcattttggatataattcttgccacctttctagacagatgtcagaactttaaaaaaaaaatactacagataatgtatcattttacaatttatttctataaagcatttatttcttcagagttcatccagttttagcctgttgtagatgatagaaaattttattttgattatggaaataatcacaacatttatttatttttgttccaaaattcaagaaatctagtttttaatggtattttcggatttggagtgaaaaataagctcaagaaatactcttcagtttattgttatttcatatttacattctgaattgaaaccctatttaaagtttcttaattctctactccccacccctccaaaacttattgttgcaaaaatgtaaaaacaatattagagagacgtcttactcttatgaaaataagcccaaaggagtcaagaagtcaagaacattacaaaggagttcaaagaagcatttaggttgatggattaagttcactgtcatgattgtgatgatagttccttgagtgtattcgtacataaaaacataccaaattgtatactgtaaatacatgcagtttattgcgtgttagttattcctcagtaaaggctgtaatcccagcactttgggaggccaaggcgggtggatcacctgaggtcaggagttcgagaccagcctgaccaacatggaggaaccccatctctacttaaaaaaaaaaaaaaaaatacaaaattagccgggtgtggtggtgcatgcctgtaatcccagctactggggaggcttaggcaggagaattgcttgaacctgggaggcggaggttgcggtgagccaagatcgcgccattacacttgagcctgggcaacaagagtgaaacttcgtctcaaaaaaaagcagttaaaagaagcagaaatcctaattcaggggccaccactttgtaaccctaaatgggccattttaccttcctggcctcagttttcttctctttaacagagatgaaacttggtttagccttcaggttattagtgttagggttacatgatctatatctgaaaaacaatgttccttgtgaaacatttttaataattactatgttttgtttgcattttttcatttctgtagattacctattgtgtcatatcactgaaagatatcacctggcatatctgtgttaagattcacagacagcaacatgcttaagcaccaaaactgtaaccttaacacatgtgggtcacttttgctgtaagactaggaatgtgtaggattattgacattactttgtaaaatgtccttgtactatcttataaagttatggtattcctacatgttacaaaataaatctgatatggttatactgtatgttagattatccctgcttaatatagaattatatttttcttgttgcattcactaacttttatattttagattggtacatggttcagtaaaacacagattacagtgggaatgtcctcctgaaagtctttcatttgatccacttcttattactttagctgaggtaaatatgccatctcttgaatatttatcagaaaataaacattaaaaattgcattaaatgctactttgtagcttgtcagtaaatttcattctatgcctttgaaaaacgaagcacacaataggcattgaaacaccacacacccttaggaatgaattatgattcttatatagttatttgaaattgattaatgagctttataaacatggaattagtctgcatagggatttgtagataactagatgaaatatttgtacttacttcaaaaaaaatatgtggactcataatgaggagagattttttggtactagtgaaataaggaaaacatcagggattaaactgaaaactgtcagatagtggtaagtggttctatgtacaaccaatcgtgttgacatgatgtgtttcttagggaattgatactacctacctaaatgttcttttggagaatactccagctctttgcttgtacatttccagtacaatatcatggaggtggttttatagactattttaaaaaaaacttttgatagcttcctttatataatttaacatttgtgtcaggaaaaatgttggtggagtcttagcttcaagtgaatcattgctatcttctatgaattttattcttagagttagaagtagagaaatgaattaaccagttgtcttgtatttaaacttttaattactttttaaaagttaaggatcgttttgttgtcattagtaagaaacaaatgattagagtttgggtgatattagtaataaagcacctgagttctttcactgatagttttatttagattagttactactgtgtaacttactctataaacatggcagtgcctttttaggttaatatcatttgcttttcctataaaaccagtggggaggaccaagtgggagcagaactgaaaaatgtaattttgccaattgagattccttaattaaaatgaaacatcaaaatctctggttcctcatttaattctccaaatatgtttactctcttaagagtaaactaaccagttactagcaaaaactataagtttttgtttttcttaatttattgccgagtattacaagcagtgtatttttataggtagcctattttgaaattcagttttgaggttggcattaaaggttaggctgggtgctgtggctcatgcttgtaatcccagcactttaggaggccaaggtaggaggatcacttgagcccaggagtttgagaccagcctgacctacatagggagaccctgtctctacaaaaaagaaaaaaaagaagatcacattagccaggcacagtagagtgagatgctatctcaaacacacacacacacaaaattagttatgtttccttattttttaaaccttaagccttttaaaccaggtagcaaaccatgtttttttttttagactagtcaaaactggtgatagctttgaaagtgtagtgaagctaatcatattgtacagggagtgctttaatttgggatatccttaaagggactctaacttctgcttaaagtcagccttttatatacctgttgtccaaatgtcaatgcttttctttctgtattgagtagatttttatctttctcctggcctcatttactaacagataagtagtgacagaagaaccactgctgaaatccacttcagcttttaatctgagagtttttatcttgaaaatgaacaggatacaggacactgctatttgatccaaaatgacgcccatgtgcttggcaggatggttttcaaaagcatgacagcttcaaggaaaggaaatgtttgattactatttggaagcagatatttaggtctgaaggacaaattatttgaaaattggtttttctaagcatgattttgcagctgattatatttcttcatagataattagtcaaactaaaggagtttactgttgattttgttttgctttatcatttcgaaaaaagtcagatggcccttttgactcactatgattggttaaatcataaaagagtactagctaattgtttctaatgcatttagggtgaaaggcatagtgagatatgatctacagttttttaaaatattttcatactgcatttcagtattacaaatgacatttaaaatcttaacatgcctttaaaatgcatatagtatgatacttgctttctaaatacgttaatataaaatacttaaatatgaaggaaatttattttaggaacttattaagtcataaaatcactaaatgtaggggatcttatagccatgcattcataaaggagtggttataaacatagactaatttgctctgctttcagaaagtgagtgtacataacaaaatctttttattatcctagcgagtttcccttctttttgtctatagtttcatttacctttccttttcctccttccatttcctgctttttccttccttcctattttattttctctttcttcttatattttttcttgcctcccctgttttccatttcttttcttttcctttttcttattttttttttcttctcccttccttcccttctgtgagtagagattactcctgtctcatgtacagttggcccttcccatccatgggttccacatctagggttttaactagctgcagatcgaaactattaaaaaaaaatacaatgcaaaaataaaaaatacaaataatacaatataaaaattattgatgaagcatttccattgtaataggcattataagtaatctagagattatttaaagtatatgggagtatgtgcacatactatgctcttttatatgaagaactttagtatccacgggttttggtatccattggagggggggccctggaaccagtttcccttgggataccaagggaccctttgtcccacagtttctcaatgtaattgaaattgtaactactgaaattataatcatgattaggaaaacaataatgaaatttttgatttttgtttaagcaagtaaagactcaatttttctgttattagcataatgaaatgggtagtaaatcatgtttcctcttggtctttgtcagggtctgagagagactaagcatccatacacttttgtgtcaaaggagggttttagagaattacttttggtcaaaggtgctcctgaaaaagctattcctttgctacctagactgattcctgtgctaaaggcagctctggtatgtcatttatttcattgtactttatatttgaaaacatgatagaaaagaaagctgtaatatatttagaatattgtatgcctttttccctccatattatatgcaaagtagtcctttatctgtgattctgacacatttacagaattaggcaactgttactcagggccagataactacatacttgaagacatctttagaggatgtactaaaggtaaaaagggacattttaagtaattagaggaagtaatgaacctcaaatcagcctttctgtatgctacatatattttagttaatgcttcagtcagatggaaaatttgttttttgcttctagatgtcctgtgttgaaggttatttttaaaattctaggttttgttgactatcttctgattgtagatgtttaatcttatccttttctctacttgcttgcccttttttctaacctatcttttctttccttttctcctctcttccctgatgtccatacatcccccaactaaccaaccttacaggtccattcggatgatgaagtgtttgaaagaggattgaatgctctagttcagctaagtgtcgttgttggtccttctctaaacgaccatctgaagcatctgcttacaagcgtaagtactgcaaagattagataatgattgactgtatgtatcatgcaccatccatatctcttcatgatttaacaatttcaaatcttcaactcaaaaccttaaaaatctccctctacacactgctttgaatgtgtcccagagattctggtatgttgtgtctttgttctcgttggtttcaaagaacatctttatttctgccttcatttcattatgtacccagtagtcattcaggaacaggttgttcagtttccatgtagctgagcggttttgagtgagtttcttaatcctgagttctagtttgattgcactgtggtctgagagacaagtttgttatgatttctgttcttttacatttgctgaggagagctttacttccaactatgtggtcaattttgggataggtgtggtgtggtgctgaaaaaaatgtatattctgttgatttggggtggagagttctgtagatgtctattaggtctgcttggtgcagaggtgagttcaattcctgggtatccttgttaactttctgtctcgttgatctgtctaatgttgacagtggggtgttaaagtctcccattattattgtgtgggagtcgaaatctctttgtaggtcactcaggacttgctttatgaatctgggtgctcctgtattgggtgcatatatatttaggatagttagctcttcttgttgaattgatccctctaccattatgtaatggccttctttgtctcttttgatctttgttggtttaaagtctgttttatccaagactagaactgcaacccctgcctttttttgttttccatttgcttggtagatcttcctccatccttttattttgagcctatgtgtgtctcttcatgtgagatggatttcctgaatacagcacactgatgggtcttgactctttatccaatatgccagtctgtgtcttttaattggagcattttagtccatttacatttaaagttaatattatgatgtgtgaatttgatcccgtcattatgatattagctggttattttgctcgttagttgatgcagtttcttcctagcctcagtggtctttacaatttggcatgattttgcagtggctggtacaggttgttcctttccatgtttagtgcttccttcaggagctcttttagggcaggcctggtggaaatgcaaatcaaaaccacaatgagataccatctcagaccaattagaatggcagtcattaaaaagtcaggaaacaacaggtgttggagaggatgtggagaaataggaacacttttacactgttggtggaactgtaaagtagttcaaccattgtggaagtcagtgtggcgattcctcagggatctagaactagaaataccatttgacccagccatcccattactgggtatatacccaaaggactataaatcatgctgctataaagacacatgcacacgtatgtttatcgtggcactactcaaaatagcaaagacttggaaccaacccaaatgtccaacaatggtagactggattaagaaaatgtggtacatacacaccatggaatactatgtagccataaaaaatgatgagttcattcctttgtagggacatggatgaaactggaaatcatcattctcagtaaactgtcacaaggacaaaaaaccaaacaccgcatgttctcactcataggtgggaattgaacaatgagaacacatggacacaggaagggtaacatcactctctggggactgttgtggggtgggagtagtggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaataaaaaaaaccttaaaaatctcatcatccttagcaaaaaatatacagatcgttcataaaacattttactaatggacagtattactattttttttaaatggaaagcacctacatgagcagagttcagggttataataaaaagtaaaccacccgggcgtagtggctcacacctgtaatcctaacactttggaggctgaggtgggtggattgcctgagctcaggagtttgagaccagcctgggcaacatggtgaaaccccatctctactaaaatacaaaatactagccaagtgtggtggcatacacctgtagtcccagcttcaggaggctgagacaggagaattgcttgaaccttggaggtggaggttgtagtgggacaagattgtgacagtgcatgccagcctgggtaacagagcgagtctgcacttcaaaaaaaaaccaaaagtcgaatggataaaagctaatgaatggtaagatggtattatgctcatgttgattaactatgaatgtaagcagtgcccatacactgtcttgtgtaattatatgttaccaaacatgtttaagtatttttgtttttcattgcgatgttttagtgaatctgtaaattgcattcaggaagagaccttttcctgatatgtataactttaatctttaatataaatatttactaggaccctgtgcagctcatgaggttcccaagaccactcttaggtttgatgatttgccagaaggatccatggaactcaggaaagctgttactggctgttatggtttcttacaacacacaaaaaataaagattaaaatcagcaaaggtaagaggcacatagggcagggtccatgagagaccagtcatggagttttcagttttcttctcctagtgaagttattcatgcagtgttttttttttgtttgtttgtttgttttaattatactttaagttctagggtacatgtgcacaacgtgcaggtttgttacgtatgtatacgtgtgccatgttggtgtgttgaacccagtaactcatcatttacattaggtatatctcctaatggtatccctcccccgacaggccctggtgtgtgatgttccccttcctgtgtccaagtattctcattgttcaattcccacctatgagtgagaacatgccgtgtttggttttctgtccttgagctagtttgctgagaataatggtttccagcttcatccgtgtccctacaaaggacatgaactcatccttttttatggctgcatagtattccatggtgtatatgtgccacattttcttaatccagtctatcattgatggacatttgggttggttccaagtctttgctattgtgaatagtgccgcaataaacatacatgtgcatgtgtctttatagcaacatgttttataatcctttgggtatatacccagtaatgggatggctgggtcaaatggtatttctagttctagatccttgaggaatcgccacactgtcttacacaatggttgaactggtttacagtcccaccaacagtgtaaaagtgttcctattcctccacatcctctccagcacctgttgtttcctgactttttaatgattgccattctaactggtgtgagatggtatctcattgtggttttgatttgcatttcttaatggccagtgatgatgagcattttttcatgtgtctgttggctgcataaatgtcttcttttgagaagtgtctgttcgtatccttcacccactttttgatggggttgtttgtttttttcttgtaaatttgtttgagttctttgtggattctggatattagccctttgtcagatgagtagattgcaaaaattttttcccattctgtaggttgcctgttcactctgatggtagtttcttttgctgtgcagaagctctttagtttaattagacaccagttgtcaattttggcttttgttgccattgctttttgtgttttagacatgaagtccttgcccatgcctatgtcctgaatggtattgcctaggttttcttttagggtttttatggttttaggtctaacatttaagtctttaatccatcttgaattaatttttgtataaagtgtaaggaagggatccagtttcagctttctccatatggctagccagttttcccagcaccatttattaaatagggaatcctttccccattgcttgtttctgtcaggtttgtcaaagatcagatggttgtagatgtgtggtattatttctgaggcctctgttctgttccattggtcaatatctctgtttaggtaccagtaccatgctgttctggttactgtagccttgtagtatagtttgaagtcaggtagtgtgatgcctccagctttgttcttttggcttaggattgtcttggcaatgtgggctcttttttgtttccatatgaactttaaagtagttcttttccaattctgtgaagaaagtcattggtagctcgatggggatggcattgattctgtaaattaccttgggcagtatggccattttcaccatattgattcttcctatccatgagtatggaatcttcttccatttgtttgtgtcctcttttattttgttgagcagtggtttgtagttctccttgaagaggtccttcacatcccttgtaagttggattcctaggtattttattctctttgaggcagttgtgaatgggagttcactcatgatttggctctctgtctgttattggtgtataagaatgcttgtgatttttgcacattgattttgtatcctgagactttgctgagttgcttatcagcttaaggagattttgggctgagacgatggggttttctagatatacaatcatgtcatctgcaaacggggacaatttgacttcctcttttcgtaattgaataccctttatttctttctcctgcctgattgccctggccagaacttccaacactatgttgaataggagtggtgagagagggcatccctgtcttgtgccagttttcaaagggaatgcttccagtttctacccattcagtatgatattggttgtgggtgtgtcataaatagctcttattattttgagatacgtcccatcaatacctaatctattgagagtttttagcatgaagggttgctgattttgacaaagtccttttctgcatctatcgagataatcgtggtttttgtctttggttctgtttatatgctggattacatttattaatttgcatatgttgaaccagccttgcatcccagggatgaagcttattcacttggtcatggtggataagctttttgatgtgctgctggattcggtttgccagtaatttattgaggatttttgcattgatgttcatcagggatattggtcttaaattcttttttttgttgtgtctctgccaggttttggtatcagcatgatgctggcctcataaaatgagttagggaggattccctctttttctattgattggaatagtttcagaagaatggtacaagctcctccttgtacctctggtggaattcagctgtgaatccatctggtcctggactttttttggttggtaagctattaactattgcctcaatttccgagcctgttattggtctattcagagattcaccttcttcctggtttagtcttgggagggtgtatgtgtccaggaattcatccatttctgcaagattttctagtttatttgcatagaggtgtttatagtattctctgatggtagtttgtatttctgtgggattggtggtgatatcccttgtatcattttttattgcgtctatttgattcttctctctttactttattagtcttgctagcagtctatcaattttgttgatcttttcaaaaaaaccagctcctggagtcattgattttttgaagggtgttttgtgtctctatctccttcaattctgctctgatcttagttatttcttgacttctgctagcttttgaatgtgtttgctcttgcttctctagttcttttaattgtgatgttagggtatcagttttagatctttcctgcttttctcttgtgggcttttagtgctataaatttccctctacacactgctttaaatatgtcccagagattctggtacattgtgtctttgttctcattggtttcaaagaacatctttatttctgccttcatttcattatgtatccagcagtcattccggagcaggttgttcagtttccatgtagttgagcggttttgagtgagtttcttaatcctgagttctagtttgattgcactgtggtctgagagacagtttgttataatttctgttcttttacatttgctgaggagtgctttacttccaactatgtggtcaattttggaataagtgtgatgtggtgctgagaagaatgtatattctgttgatttggggtggagagttctgtagatgtctattaggtctgcttggtgcagaggtgagttcaattcctgggtatccttgttaactttctgtctcgttgatctgtctaatgttgacagtggggtgttaaagtctcccattattattgtgtgggagtcgaaatctctttgtaggtcactcaggacttgctttatgaatctgggtgctcctgtattgggtgcatatatatttaggatagttagcccttcttgttgaattgatccctttaccattatgtaatggccttctttgtctcttttgatctttgttggtttaaagtcttttatcagagactaggattgcaacttctgccttttttttgttttccatttgcttggtagatcttcctccatccttttattttgagcctatgtgtgtctctgcacatgagatgggtctcctgaatacagcacactgatgggtctcgactctttatccaatctgccagtctgtgtcttttaattggagcatttagcccatttatatttaaggttagtattgttttgtgtgaatctgatcctgtcattatgatgttagctgattattttgctcattagttgatgcagtttcttcctagcctcgatggtctttacaatttggcttgtttttgcagtggctggtacaggttgttcctttccatgtttagtgtttccttcaggagctcttgtaaggcaggccttgtggtaacaaaatcagcatttgcttgtctgtaaaggattttatttgtccttcgcttatgaagcttagtttggctggatatgaaattttgggttgaaaattcttttctttaaggatgttgaatattggccccactctcttctggcttgtagagtgtctgccacgagttctgctgttagtctgatgggcttccctttgtgggtaacccagcctttccttctggctgcccttaatattttttccttcatttcaaccttggtgaatctgacaattatgtgtcttggagttgctcttctcaagaagtatcttggtggcattctctgtatttcctgaatttcaatgttggcctgccttgctaagttgggaaagttctcctggataatatcctgcagcgtgttttccaacttggttccattctccctgtcactttcaggtacaccaatcagacgtagatttggtcttttcacatagttccatatttcttggaggctttgttcctttctttttactcttttttctctaaacttcacttctcgcttcatttcattcatttgatcttcaatcactgataccctttcttccactcgattgagtcggctactgaagcttgtgcattcgtcatgtagttctcgtgccatggtgttcagctccatcaggtcatttaaggtcctctctacactggttattctagttagccattcatctaatcttttttcaatgtttttagcttctttgcaatgggttcaaacttcctccttttgctcgcaaaagtttgatcgtctgaagccttcttttgtcacctcgtcaaagtcattctccgtccagcttagttccgtttctggtgaggagttgtgttcctttggagggggagaggcgctttgatttttagaattttcaggttttctgctctgttttttccccatctttgtggttttatgtacctttggtctttgatgatggtgacgtacaagtggggttttggtgtggatgtcctttctgtttgttagttttccttctaacagttgggacgctcagctgcaggtctgttggagtttgctggaggtccactccagaccctgtttgcctgggtatcagcagtggaggctgcagaacagcgaatattgctgaacagcaaatgttgctgcctgatcgttcctctggaagtttcgtctcagaggggtactcggccgtgtgaggtgtcagtctgcccctactggggggtgcctctcagttaggctactcacgggtcagggacccacttgaggaggcagtctgtccgttctcagatctcaaactccgtgctgggagaaccactactctcttcaaagctgtcagacagggacatttaagtctgcagaggtttctgctgccttttgtttggctatgccctgcccccagaggtggagtctacagaggcaggcaggcctccttgagctgtggtgggctccacccagtttgagcttcccagctgctttgtttacctgctgaaacctcagcaatggcgggcgcccctctcccagccttgctgccgccttgcagttctatcccagactgctgtgctagcaatgagcgaggctccatgggcatgggactctctgagccaggcacaggatataatctcctggtgtgctgtttgctaagaccattggaaaagtgcagtattaagttgggagtgactcgatattccaggtgccatctgtcacagctttgcttggctaggaaagggaattccctgatcccttgcgcttcccgggtgaggcgatgcctcgccctgcttcggctcacacttggtgcgctatacccgctgtcctgcacccactgtccaacaagccccagtgagatgaacccggtacctcagttggaaatgcagaaatcacctgtgttttgcgtcactcacgctgggagctgtagactggagctcttcctattcggccatcttggaaccgcccccttcttcatgcagtgtttacttcttccagcaacaatgtgtggcaacgtgcatggagtattgccaactagagaagctcatgtgagccttagtgtccagggtttttattggtgtctgtcatgcaggcaagactgcctgcctgtgtggttgactttagtctacaccctctctagaaatcgagctaataccctgtgaaccaaagttcccatcataaatcacattgtatagactacctggtgtcacccgaaactcccatgttgacaaggataccctatccaggaggacattccaagagcttagaggttatcattcaagagctaggggcaagggccaaactttaggcaagggaagttctataccgcatactgatagaaaaattaaagagttagataggacctccctgtctgcattcttctgtatttcacagctgaggtatgattttgataatggttccactgttttttcttggatacatccatatgagagatcctagaactgtatttttaacttcctattccacaactaggaactacctgttccaatacaccctaggaactacctggttaatggtataagaagtaggtgcgatggtgactctatcaggataggtatgctcataggtggtagatgaaattccgtgaggtttcaggtgaggagaagacatagtgagaatagactttcaagccttgacatatgaggagtcttatgacagaagaaagagaatcttggcagatatttgtaagcttcatgtcagggggtgtggctgaccaactacaggaatttcacactagtatacaaagtgactcattcaaatattcagtcgtttaataataatctcttgcactctgccctcctgttttgtgccaggtatgccaagcagtgagaatataatctgagcagaaacaggcatgctctcagtccttgtggagattattggttttggttttgggttttttttgtttttttgtttttgtttttgcaggtgggtgggggatgtagaaataagcagcaaggacatctgctgagaaaattgggatggagtcaaagggatgtgatatgtagagaaaaggaatcacactggatccttcctcaaagtcagtcaagcaaggcttcctaaatagcctctaagtcccacctccgatggcagaaagaaaagaccagattaacagttgtatacatttgttttgttttctaatctttctgggtcagtggcgtttatctttggtcacttgcattcctcctcagagctctgcttttcctagacaaggactgactgaacgggtatctagctttcctgggctgccagcactttgggaagacctagacaccaccctgaccatcagatcctggtgttatataaagagttctagaaataggttgtgtgagggttagttcctggtctattaccactaactatgagacagacaccactgaggatgtcaatgaggtgctatcggatccccttcgtccctcacccccatcttccatacatttcagcctcaaagccttcatttttatggggtttatagacttctacattagaagtttattggaagaaagggtattattcttctagaaaaagtttttcaaaaccagttactgaacccctgtatacaactcattttttcctctatgcaaaataagctataccttttctgagctgcaaatgtatgggactttaaagagggaataaatcacctgaaaatcttgcttaaaaatgtagattctgggcttctgctctgggattctggttaagtatggcgtgagacccaagaatctgcatttttaaacagcatctcaagtgattctgaggctgatggcccatggatctgcatgtaaacctctgtgctatacagagtgtatacagattcagtagggtaatgcagtctgaagaaagcaactggaagactagagagggaccctgtccatccccagggcattcactcttataaattactcatgtaaatcctccatcctttgtcttctcttccctttttattgcaggaaaatgtgtgttttagaggcacagctttccatcatggtcctcaatgctcttgcaaattacagaatcacaaaatatgctattttatagaaaccttacttcagatagcatactgaagcagattttataggattggttttacctgaaataatgtaaattcattgttttttaaaacaaatacagaggtaccttatacatgtaaatttcaatgagatgcttcctaaaaaaagccttgaaatctaaaacaaggggtgctcctgaagatttacttatgcgtatggtgagcattgttaagtttaaagtcatttcgtttccccctaatcttactttaaaagctttccaagagattaatggacaagaaattcaaagagccaatcaccagcgcattacaaaagctagagcaacatggtggaagtgtaagtagaatattattccttaagtctttttttttaacttttaggtgtattactaaattgacatatatatatatttaacatatactatctcatttcagccacaggtaactatgtgaaattgatgctgttattttccttttagaactcaagagtttctgtctctaggtcacactgttctcaagccctgcgactcagaccagactcaggttgaataaatatagggcttgtgtacactttcacagtgcttaatgtggcactcagtgtggcgcagtggtacagtttttttcttaaaagtattttcagtggtttagttttgaccatcgaaaagttcagaaaaccgaacgattaacttagctctttgaggaaaaatacctttttctctttcatttgctgccttttctgactcagacgtccagatgattacactattctgtctgtaagtgcgtgcatacccccataggtgtacacacacacacacacacacacacggacacatatgcacacacagtgctggaatagtttaattggttattctaacttttcaaggtacaaaaatatggaggatttcataactgtatggtgtcagattactagactaattgaatttttagcatttgaaagaagcattcagataatctcgtcttagaaatatttccataaaagcagtccttgcttttggaaattttgtttaatcagatcttaatgatagaattgcatgtgaccatcttaacattgtataacttagttccattgtaggtacttctaaaggaattagttatgagaaaatttacctgatcatatacaattttaaaatggcagacataaagctttagcgaaatacctcatttgaccaatctcaatgagttgtttgattgattatattctttccatgatggatgcctagaatacagttgacaagaggaagtaagtgtctaagcctactagataatgaatttctttgttgtgtttgggtcctaggcagagtattaacattcagacaccttgttgaggagatgtgcagaactttcctctagctaatcccatgtctcctctgcagcaaggaaattcttgcttgctcttctgagaatttaaatgcaaaatatatttctcctttcttcttctgtggagtggaagtgaacaaatgctaaataatgatgccacagcttttcagtgggaaacgctccctaggtgattttccatatcctgtgggccggtatgggaaatgggacaagtagaaagggacaggccaagcatgttagattttgtggtgggagtggagggggtgtggaggaggagatagtatatgtgtaaataaagtttagaaacggcacattaagatttggaaggggaacacagagctgtagttgagtaatccaggatcccagaaatatcaaattctttttttactactccatcttactagctttgaatgttgctaatacagaattttaaaaaagattttgtagctacaagggctgttattatttattttcttctgactcctcttgtttcctccttcttatatcctacataatattttaataatgattgatgtaattggaatagaaaatttcctattgcaattacataccaaagactttctcttggcttattattgtgctaatttctgttacttcgtaatccttcatgaaactaatgaatgttcttctttctcttctaagaccttaaaagcttatatatctctttctttcttaaaatattagaaattaagtctttaaaaatgagtgttctcagttgtggtttctcatttcttgggacttgtgtatatcaatgatggaactattcaacttttggatacaggaaaatatctgttacagatagtcacagtgttactttcttagaactgatctgccttaaattgaaatcagttcattcttagcctgatttgattttttttctaagtgaaatgcacatttattttggaaaaggcacaatgcaaatcctgatctttattgattgtgtgggaacttattacatggcaggtactctgctgagtactttttagacatgaaacccatttactcttcctagtcatcagagggagattttgttgttatctccctctaaagatcacggaacttaggcacagaaaagtaattagtccaggtttgacgaataagtgactagtagatgctgaattcagatactggtagtctggcttctaactacttctctagttagatacttcaaaaaaagagaaagaaacagcctatattttatttaactcagcaaaaagtccttcttatttcatcattttgttcttacccctttttgtttgagttttagatactttctaggcatattcctgcaaatataatacctattaggggaactctgcatgatactaatgatgctcaatttttttctgttgacaggggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagtacaattttgaggtttattttttgtatttttattatttgtgcgaagaaccattattgagtttgcaagataagatgtatttgtattttctagtgtctttttatttataacaacacttttttggcaatcagtttgtagctgtgcccttatttttatagatagtttgccatttcttgggtttaatgtttaacaaggctatagaagtttaaaatagtggacaaatgtttgtgaatacacttttaaaaaattgttttaaaagagaaaagcggtcttgctttgttgcccagactggagtgcagtggcataatcatagctcaccgcaagcctcaaatttttgtgctcagatgatccttttcatctcagcctcctgattagctgggactataggcgtgtgccaccatgcccagctaattttgaaatttgcttgtagagatgggatctcactctgttgtccaggctggtctcagaattctggtgagtgatcctcccacagtggacttccaaagtgctgggattacaggtgtgagccaccatgcctggccccatgaatacactactaatattatttgtaaatatgtattttataatgtacaatgcttggaaaattttcagagtattctagtttaaaaaattttttctaattctgtaaattctattacaagtatgttgtttattacaactcattacaactacctaaattttaggtgttaactgtatttaagtaaatgtgttatttttgcatttcatagccagaaaatactgatgttcacttaaagatattcagcaattaaaatgttaaaacttgtacatgca

SEQ ID NO: 356 - DNA, 27945 bp, Homo sapiens; identical to SEQ ID NO: 355

SEQ ID NO: 357 - DNA, 27945 bp, Homo sapiens; identical to SEQ ID NO: 355

SEQ ID NO: 358 - DNA, 27945 bp, Homo sapiens; identical to SEQ ID NO: 355

SEQ ID NO: 359 - DNA, 27945 bp, Homo sapiens; identical to SEQ ID NO: 355

SEQ ID NO: 360 - DNA, 122053 bp, Homo sapiens
aacattttattttgcttttattttttctttttgaaatacaaaatgtgcacattgagtttacacaaacacgtgatggcaaatttcagtgtacatgtattgtactactcttaatttctacactggtgatagcagggcagctttcaacatcctatctctacaccagaatagatacctgatttattgttgcaaagacagttgcaaatttcctccttctgtagcctcttggtctttgtgatatttctacaaaacagggacgatgtgtgtggctttagtaatgtggcaactttacagttttggctaagatgattaaaaataatctgaattatgatgagctaaatcatactgtaatctggattagttgttgagcacttattttctactaaatcttggtagtagttgtcaatgtaatggaaccactggtgctttcaaagtgaattttgcttgctaattttgcttgctgtttgttcttagtagacagtggggtagtcaaggtttctttctttgtccctgaatggcttgtaatataaataaacatgctgtaaggaagtcaggggaaagaggacagatttggcctttaatgctgttaggattacttgttattaagcattactatatactggaggatagatatcctgaccctttgcatatgtctgtaaacatccttgttttgtttgatgccttcttcaacttccacttaatgattgatactaatgattgatacaatagaaaacagcctgtaagaaagattgaacaaatccaaaattattatataggccttggctgtaacatattatggaaaattaaatgcttattaaaataagttttattaggcatatgctgatatctgataataaactaatttttaaatgtttaataatttttaaatgtttaaaaatgccagataaaactaatttctaacagaaggtgggaaggccatagaaactggaactatgtgtttttttaattgttgtaatcttgtttccttaaagtatataaatggaatttaaatggaattacagcattcaaacatgaaaattaatttaatttctggaaattaaatgcagatgtcactatattagaaaaccattcaaaatcctaggactgaatacatacaaatgagtagcaaaaaacactgatattttaaaatcactgatatgtgaaagcctcaataatcccatggctaaggaaccaataaaactatatgccagattctattacttttgaatattcacagagtatgaaatgagttagaccatcccctgaactcagtggcattatgaaaaggatgcaaatttataactgaaagctcaaatcttttggggattgctttatattaaaacaaagcttgtttgcataatatgcttcagtgtcaagctgagcaatctatgctaaaagtggtagctccaactttaagggtggtagaatagttcacatttgtctgttggattcaggatctatttgacaagttaaatcacattttcaaagagctgcatggagcgcattatgttttcatcctgtaagggagaaacacagagcgattaaattcagcatatctgcaaggaaaagtacactattttgcccctgagtattgcctcctcccatcaaccacctcaaccacctatgccaaaagctcaaatattaagtgtttgcaaatgtaaatgccattctattctatccattttccacatagatgactatgaaggacccattttatattttgtggagtctattgaccaggcattaaaccactttatttaaatctttacttggtattaatagaggatatttctcaaatcataatgccaaaatggaaactacagaggtgcagaggtgtgtcaaagcaaatgagaattttggcattctatgtagatcacaggccaaatcacacagacttttatacaggtacaaggaaaatttgtgtgtatgagccagcagttcatgaagattggaggctggcgcataggaggcagggtggtggattaagaggtaacatgtttgcagtaatcatctctctttctgtctgctagttatggctaaagctgcatggcctgaaggagcctttaaaaatgaatggtctctcaattacagagaaagaattggggagcagaaaccactgctcagtggctgtgttcagtttagcatattctttagaaatgagttaggggacagactttgggcattattggagcacttgtcagttgcatgtgaatagcacttactgagctgtttatggtagtggtaaatggtggctgaaccaataatggcttccactgctagaaaccaagtaacatcaccgtcaagcagcttaatgtcaccaaattaattctctcaaagaccactgcatggaaatccaagttgagagacaagcagacatccagaaaagtaagaacaacaatttaaaaataaagagaaaaactaaagaaacaacggatttctttgttttcaggattatttgaaaaattctttttttctttttttagttttgaggcagagtctatttctgttgcccatcattctggagtgcagtggcacaatcatggctcaacagggatcaagtgatcttcctgcctcagcctcccaagtagctgagacttcagccacgtgccaccgtgcccagctaacttaatttttttttgtagagatagatagggtcttgctatgttgcccacattggactcaaaatcctggccttaagttatcttcccgcctcagcctcccatagtgctgggattacagttgtgagctactgtaccaggccttaacaatttttaactgtggttctgcccacacatcaagtcaaataattctaagtaagctaacactggtttctttgataacaggctactacctggagttctcttcagagaaaattttccactgtttattttttgtgactgaagaccattagtgagttcagtcaaagagccatttcttgtccacatacactaaaacaatgacttttctcttagaaatcagatagaagcttggcctgttgtgatgccatacttggctatctaggaattctaatgctgtggagatatgatagataatatatgagtgatgctaagttttggcaaagagcaattcaaatctcatgtatgttttatcctccatgaatactctctaaggaatttgggaatcaacacagtacatgtacaacttttgtatccccagggtttcctccatagcctgactcagtgggcactctaaatgttgattatgtaattggtgcttgttttcagagtggtaggcttatgctgcatgttgtagaagtggtaaacttaggcatatgatctctatatttcgcccagttcatggtagctagctgctaatactcagtttagctgttatgatagctgaattgatagttattacactttcattacttactttttggcagctttcaatgaactcatctatggtaacaaccccatctttatttttgtccattttctgttcaggaagaaaacaaaaattgtatttagacttatcccttaataccctcacacctggaccaaatgagctgaagctgataaaaagaaaacctagctgcttatttatttcacgtggaggaactgtttcagagcaggaaccagcagttttttagagataaaaatgatagggccaaatgcttctggcttttcccttttcaatataatgtggtgaagatgtagagtcactctgtcctaggtaaaatcccaccttctagatgtgacagagcttgcgcaatttgctgaaactttcagagcttgctttttgtctcatctgtaaaatgagattaatgaggatttataggattcttgtaaaaactgaatgaaaacaaaacttgtgaaacatgagaactgtttagtgttgtatcttggatttagtgaatgttcaataaatgcagttatcagcattgtaaattcaaaaccaaagctattaaattaataggatgctaaatactgttttgtttcagtaaaaattattttcctttgctctcttttgaatcatcgtggtgcatggcaaacatcaggaaattttctcctaacttcatgccctcttgacttctgttttaattcctacctgaaaaaatgtttcaacgtgttgtctgggagcatcttctttgaggacaggatatgtacatttacccatcatatcgtatattgctttcattatatcaagcatttcctgaaaaataaaaggcactcacgtgaggctgcacacatgtatgaagaaaccagtctaagaagctctgacagatttttcctactcaattttaaatttttgactttttgtttgttggattctttgttagacgactgttggttgtcccaaaggaaaaggcaacaaacagctttctgccttaagagcagaagaatcagaatttaagaatgaattctgatctcttggtttcaaaaggaagcaaatttccatgtatctaccatagtcaggaaaagaatatgctggcttaatgtttggatttctatagactttaagtagactatgtttatttaattgcattatatatcttatgtgttgatcatcagtttccatctattgagaatcaaatatacggcacatcgtatattgagaaaaaacaccatttagaattagtgaaattaattggtaagtcttaaggttcattagggtttttgttgtatttttcctactgtggctttaacttaagtcacatgtgaagactagtcaaaaaattttgaccctgggaaacacctttaaattttgttattaactttttctctaaaacagtctaatttttgccttaccactttcattcttatgagagtaaaaataatctctaataacttaaacatttagatttattgttgcacatttgtttcacgtgaaagatctctcaattaggttaatacagagcgaatatatatttacttttaagagtattcaattataaatgatagagtaatttgtaaacaggtgaaaccttttaagatgttttaagcatagataagtagcaagtagtttgttagacacaggcagaattcttgagatgtgttaaacacagaggtaagaattgaagaacaagagatatttaaggtatcctaagtatctgggtaataaatattcatgatataaaaatatacaagaagcactatttaggatatgctccatatacatgaacacaatagccataaggtcttaatttggcacccactagtgatacctattctggccccaggtgtcctctgtgcaagaaacacaaatgaaacccattactacttatcaggctatactcgtgacctggcacacttgcacctgtgtctctccagtagcgcaagttcatgtcatttgctgttggccctgggcaccttttgtctgtggggcctcttgctcaaaactcaattctggggaagtctcgtgaggcaaagagagacaggacataggcacactgagaatgcccaggatttagggagtggtctttcaaccccatttgcagcctgtcctgcgtggttaacttactccatccctttctttacttctcgctgtgttttaaattggtttaataaactgtgtaatacgagtatcttaatttggtctgtgaaccttgtttcctggatagtctgcctcaacgtgcatttggagaccccaccattgcgtcaggtcattccacaatccccatgattgtaaaatttcatttccttatggatcacatgctgtggggaaaagaaaggcttcaggctaaatgttgaaacatgggttggatacattttctttctatctgattccaaccatgatctttattccattcacagtatttattaagatgccagcaggaaacaagggtgtaatctttatgtgttatatatttactttggagcttcaccataaactacttctatcccaagtttttaattgtacatctttcttccactacataaaatattttggaatttcctcaaaaaaacttttcaaattaataattgcaattaatattttaaagttaagaaatgaaaatggtccaaattactgtgatgttggtgaggcatcccttacctctttagtgatgtagccatctttatttatgtcatacagattaaatgcccaattgagtttttcttgtactgtcccccggagcaaaatggaaagacctttgatgaaatcctgaaaagaaataaaaattcaattttatatgacatttttaaaaaaacaaaaacaaaaaaaacaaatgatgtaagtaagggctacaaccctctggatcttgaacatttagcaaaatgattgatgtgttattggttgtctagttttcagacttctctgtgggcataaatcactccttagtcttaacattttcatattctaattggaaactgagttaaatcaatggtcatactggaaattgtaccagtgcgtacccacacagctagaggcttgagtataagtggtattggctttccactgcaagtgcacatgatttactaaaagaatctaataatagttttttcaaaaaaatacaagtgcacacataacacacttcaatgaaaaaccgtttgctaataagaaatgtggctgtccataaaagataaaccaattgtggtctttaattagaaatccagttataatttacatgtggacagtgggtaagagcatggaactggaaaggacagactgcctggattcaccctccagctatattactggatggctttgtgtcttcaggcaacttaacatccctttgcctcaattttcgtatctgtaaaatggagctaataatagtatctacctcttcacaattttatgaggattaaaaaagaggctgcttataacagtccttggcaatgacattggctatgtaagtttttgttaagtaaatggagccctcagtttgtatcctggttagattgcattgcagactggccagattaacttgattaaattcatttagtgtttttttttttgtttttttttttttttttgagatggaatctcgcactgttgcccaggctggagtgcagtggcacaatcttggctcactgcaacttccacctcccacctcccaggttcaagccattcttctgcctcagcctcccgagtagctgggactacaggcacccgccaccatgcctgactaatttttgtatttttggtagagatggggtttcaccatgttggccaggttggtgtcgaactcctgaccttgtgatctgcccaccgccgcctctcaaagtgctgggattacaggcgtgagccaccacgcctggccagatttcttgttgttatgtacagcagggttaacgttacaatgtgctgtattcagtttataatccacttttaggtaggaatgaaagcagaggggaaatccaaaagtcttctgggtgaatttgcattatatctccctttctcacattccttccttttatagctgtatttctatctgaatttctcaaaatgttttttcttttttaaataagtaacatccatatagttcaacatttaaaaattgtgtaagctgcctggtgaaaaatctttcttcccttcctggacccagccacctgttcctttcactcatagactactggcataaatagtttgtatttacttccaaggaatttttgtgcatacacaagtataagatatatttgttttactagctaacagacttctatacttttttttccacttaagcataaatcagggaaacaatttgagtttccattgtatatgtaaatacatcgtagtttatttaaccaaattgttcttttacattttttctcatcattatttctaggtattttaatatttctgttgctgttgtaaatgagatatttttttctatcatatattctaaactagttgtttgtatgtatgaaagccattgatttctgtatgataattttataccctgtcaatttgctgacatacgttggttttcttctgggttttcatgtgtgcaatattagctgcaaatggaattaattttacctttttttctaatttttatatgtttacttttttctaattatatggcctaatatatatagaacagtgttacataatgaaaatgataatagatattcttagttttttcttgaacttgagaatatttcaattcgcttttaagcatgatacttacttttatcatggtaaagaattatacaacccttccacttaagcaaatttatcaagaatggccacagaccttttttagcaaaaatgaaaaagacaaaaacagaaataattgtcaaattcatattgcaagggaccctgaatagcccagtcaattttaagaaagaaaaacaaacttggaggactcacactgcccaatatcaaaacttagtacaaagttacattaatcaaaacagtgtggtactggcataaagacagatatatagaacagtagaatagaattgagtctagatataaaccagctgtctgtggccaattgattttcgataatggtgccaagaccattcaatagctatggaaagaataatctcaatatatggtgctgtggcaactggatcaccatacttagtttgcttcccattggcatgaagggtagaatgtcaagtgagagaaaaacaagattccagagaaagccacaaggaattccaatatttggcaggtacagagaggagaagctggcaaagcatcttgaaaagaagttgctaaagaagtgagtcaggagaacagagcatttccctaggaaaggattgttcattttgctccaaggttggaaaaatgttcactggaccagcaacatggaggtcaccagcaagtgatagggaacggtccagtggagtaggagtgaagagtaatttttaatgaggagcactttgaatactgaagagaagaatctaaaaagagtaagagtcagaaatgggctgtgctcttgagaaggtggggaggatccagaacatgggtagatgggccgatctgagaagggagttgatacatgagacagaagaacatggtgtggatgccagcagctgctttgcaggtgggaagatgactgtgtttctgtccgatagctttagtgagtgtgagctgtttgagagtgaggagcctggtagaagaggtaagaatctgaggtttgaggagagaggcagaagctctgatactaagcagtaagatgacatgcaaattagagaaagggagacctccctcaaattatttccctgccatattttagaaaattatttatgacatagaatgtagtttagttaaaaggtaatgacagcccttggaggtatgagtgtacatcttgcacaaccagcaggctggggatcatggctcatgcctgtaatcccagcactttgggtggtggaggtgggaaggttgtttgagtccaagagtttgcaagcagcctgagcaacgcagccagatccaaattaacagcaagaaaaacaaattaactgggtatggtggtgcacacctgttgtcccagctacctgggaggctgagatgggaatcacttgagcccagaaggtcgaggctacagtgaactatgattgcaccactgtgcttcagcctggatgacagaccaagactctgtctcaaaaaaaaaaaaaaaatccttagctttttcagaaggcataaaatatacattgcagaacatagagccttattcaaggaagattgctgagcagttttgaaaggctagatgagattgattgttatcaatgtaaacgatatttttaaaaattcacagcgtagtaataatatgtcattaattgtaaggggagctggccacagggtctttgaaaacatgcttagagtattggttctcaaaatataatgtgcaacacagtcacctggggagtgtgccaaaagatttatgggacctactccaagaattatgattcattaggttgaagtgggaccccaaaatttacatgtctgacacattccaaggggaagcctgtactgcttccagggatcacactttgagaatcactggcctacagcactcatcactggcattgacctcaccaccacacaaaacagcagagaaacaatgaaagatttaaagatagcacttttggggaatccccccaagatggctacataggaacagctccagtctacagctcccagcatgagcaacgcagaagatgggtgatttctgcatttccaactgaggtaccaggttcatctaaactgggacttgttggacagtggatgcagcccacagagtgtgagccgaagcagggtggggcatcgcctcacccaggaagcgcaaggggttggggaattccctttcctagccaagggaagctgtgacagatggtacctggagaatcaggacacttcctgccaatattgtgcttttccaacagtcttagcaaacggcacaccaggagattatatactgcacctggctcagagtggcccacacccacagagccttgctcactgctatcacagaagtccgagatcgaactgcaaggcaacagtgaggctgagggaggggcgtccaccattgctgagacttgactaggtaaagcagccaggaagctcaaactaggtggagcccactgcagctcaaggaggcctgcctgcctctgtagatgccacctctgggggcaggtcatagctgaacaaaaggcagcagaaacttctgcagacttaaacatccctgtctgacagctttgaagagagtagttctcccagcatggagtttgagatctgagaacagacagactgcctcctcaagtgggtccctgacccccgagtagcataactgggaaacacctcctagtaggggcagactgacacctcatacagccaggtgcccctctaagacaaagcttccagaggaaggatcaggcagcaacatgtgctgttctgtagcctctgctggtgataaccaggcaaacagggtctggagtggacctccagcaaactccaacagacctgcagctgagggtcctgactgttagaaggaaaactgacaaacagaagggaatagcatcaacatcaacaaaaaggacatccacaccaaaaccccatctttaggtcaccatcatcaaagaccaaaggtagataaaaccagaaagatggagagaaaccagagcagaaaagctgaaaagtgtaaaaatcagagaacctcttctccaaaggaacgcacctcctcgccagcaatggaacaaagctggatggagaatgactttgatgagctgacagaagtaggcttcaaaagatcagtaataacaaacttctccgaactaaaggaagatgttcgaacccatcacaaagaagctaaaaaccttgagaaaagattagacgaatggctgactagaataaacagcgtagagaagaccttaaatgacctgacggagctgaaaaccatggcacaagaactatctgatgcattcacaagcttcagtagccattttgatcaagtggaagaaagggtatcagtgattgaagatcaagtgaatgaaatgaagcgagaagagaagtatagagaaaaatgagttaaacaaagcctccaggaaatatgggactatgtgaaaaggccaaatctacgtctgattggtgtacctgaaagtgacggggagaattgaaccaagttggaaaacacccttcaggatattatccaggagaacttgcgcaacctagcaagtcaggccaacattcaaattcaggaaatacagagaatgccaccaagatactccttaagagcaattccaagacacataaattgtcagattcaccaaagttgaaatgaaggaaagaaagttaagggcagccagggaggtcgggttacccacaaagggaagcccatcagactaacagcggaactctcggcagaaactttacaagccagaagagagtgggggccaatattcaacactcttacagaattttcaacccagaatttcataaccagccaaactaagcttcataagtgaaggagaaataaaatcctttacagacaagcaaatgctgagagattttgtcaccgccaggcctgccttacaagagcttctgaaggaagcactaaacatagaaaggaacaactgataccagccactgcaaaaacatgccaaattgtaaagaccatcaaggctaggaagaaactgcatcaactaatgagcaaaataaccagctaacatcataatgacaggatcaaattcacacataacaatattaaccttaaatgtaaatgggctaaacgcaccaattaaaagacacaaactggcaaataggattgtcaagatccatcagtgtgctgtattcaggagacccatctcgcctgcagagacaaacataggctcaaaataaagggatggaggaagatctaccaagcaaatggaaaacaaaaaaaaagcaggggttgcaatcctagtctctgataaaacagacattaaaccaacaaagatcaaaacagacaaagaaggctattacataatggtaaagggatcaattcaacaagaagagctaactatcctaaatatatatgcaccaatacaggagcacccagattcataaaacaagtccttagagatctacaaagagacttagactcccacacaataataatgggaggctttaacaccccactgtcagcattacacagatcaatgagacagaaagttaacaaggatatccaggacttgaactcagctctgcagcaagcggacctaatagacatctacagaactctccaccccaaatcaacagaatatagattcttctcagcactacgtcacacttattccaaaattgaccacatagttggaagtaaagcactcctcagcaaatgtaaaagaacagaaattataacaaactgtctctcagactacaatgcaatcaaattaaaactcaagattgaaactcactcaaaactgcacaactacttggaaactgaacaacctgctcctgaatgaccactgggtagataatgaaatgaaggcagaaataaagatgttctttgaaaccaatgagaacaaagacacaacgtaccagaatctctgggacacatttaaagcagtgtgtagagggaaatttatagcactcaaagcccacaagagaaagcaggaaagatctaaaatcaacaccctaacatcacaattaaaagaagtagagaagcaagagcaaacacattcaaaagctagcagaaggcaagaaataactaagagcagagcagaactgaaggagacagagacacaaaaaacccttcaaaaaatcaatgaatccaggagctggtgttttgaaaagatcaacaaaattgatagactgctagcaaggctaataaagaagaaaagagagaagaatcaaatagatgcaataaaaaatgataaaggggatatcaccactgatcccacagaaatacaaactaccatcagagaatacgatgaacacctctatgcgaataaactagaaaatctagaagaatggataaattcctggacacatacaccctcccaagactaaaccaggaagaagttgaatccctgaatagaccaataacaggctctgaaattgaggcaataattaatagcctgccaaccaaaaaaaagtccaggaccagatggattcacagctgaattctaccagaggtacaaagaggagctggtaccatttcttctgaaaatattccaatcaacagaaaaagagggaatcctccctaactcattttatgaggccagcatcatcctgataccaaagcctagcagagatacaacaaaaaagaattttagaccaatatccctgctgaacatcgatgcaaaaatcctcaataaaatattagcaaaccgaatccagcagcacatcaaaaagcttatccaccactatcattttggcttcatccctgggatgcaaggctggttcaacatacacaaatcaataaatgtaatccatcatataaacaaaaccaaagacaaaaaccacatgattatctcaacagacacagaagaggcctttgacaatattcagcagcccttcatgctaaaaactctcaataaactaggtattaatgggacgtatctcaaaataagagctatttatggcaaacccacagccaatatcatactgaatgggcaaaaactggactcattccctttgaaaactggcacaagacagggatgccctctctcaccactcctattcaacatagtgttggaagttctggccagggcaatcaggcaggagaaggaaataaagggtattcaattagggaaagaagaagtcaaattttccctgtttgcggatgacatgattgtatatttagaaaaccctgtcgtctcagcccaaaatctccttaaactgataagcaacttaagcgaagtctcagggtacaaaaatcaatgtgcaaaaatcacaggcattcctatacaccaataatagacaaacagagccaaatcatgagtgaactcccattcacaattgcttcaaagataataaaatacctaggaatccaacttatatgggatgtgaaggacccttataagggtgtgaaggacccttataagggtgtgaaggacccttataagttcacccttatgtgaactacgaaccactgctcaatgaaataaaagaggacacaaacaaatggaagaacattccatgttcatggataggaagaatccatatcgtgaacatggccatactgcccaaggtgtaatttatagattcagtgccatccccatcaagctaccaatgactttcttcacaaaattggaaaaaactactttaaagttcatatggaaccaaaacagagcccacattgccaagtcaatcctaagccaaaagaacaaagctggagacatcatgctgcctgacttcaaactatactacaaggctacagtaaccaaaacagcatggtactggtaccaaaacagagatatagaccaatggaacagaacagagccctcggaaataataccacacatctacaaccatctgatctttgacaaacctgacagaaacaagcaatggggaaaggattccctatttaataaatggtgctgggaaaactggctagccatatgtagaaagctgaaactggatcccttccttacactttatacaaaaattaattcaagatggattaaagacttaaacattagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaggaacttctgcacagcaaaagaaactaccatcagagtgaacaggcaacctacaaaatgggagaaaattttcgcaacctactcatctgacaaagggctaatatccagaatctacaaagaaattaaatttacaagaaaaaaaaaaacccttcaaaaagtgggcaaaggatatgaacagactcttctcaaaagaagacatttatgcagccaccagacacatgaaaaaatgctcatcatcactggccatcagagaaatgcaaatcaaaaccacaatgagataccatctcacaccagttagaatgacaatcattaagaagtcaggaaacaacagatgctggagaggatgtggagaaataggaacacttttgcactgttggtgggactgtaaactagttcaaccattgtggaagactggtgactcctcaaggagctagaactagaaataccatttgacccagcaatcccattactgggtatacacccaaaggattataaatcatgctgctttaaagacacatgcacatgtatgtttattgcggcactattcacagtagcaaagacttggtaccaacccaaatgtccatcaatgatagactggattaagaaaatgtggcacatatactggattaagaaaatatggcactatacagccataaaaaggatgagttcatgtcctttgtagggacatggatgaagctggaaaccatcactctcagcaaactatcgcaaggacagaaaaccaaacaccgcatgttctcactcataggtgggaattgaaaaatgagaacacttggacataggatggagaacatcacacacgggggcctgatgaggggtcagggggatgggggagggatagcattaggagaaataaataatgtaaatgacgtgttaatgggtgcagcacaccaacatggcacatgtatacatatgtaacaaacctgcacattttgcacatgtaccctagaacttaaagaataataataataaaaatataaaataaaaataaagatagcacgtttaagtcaagtgtggacttgtgttgtttgcctccctagccctagtaggtcccaaatttccatttggtgctccatgatgttctgtggaagttcacttcatctctgagtctagtgatagagccatgacctgggcgaagtcaggaagcacattttatccctttggccggacaactggatttgtggttgccatttgactaaacctagtccaggtctaagaatgactccccagactcagactcttgctaggaatggtaggacagagatgtgcttctttccttgctcaacaggagcaatgaatcatggagccaaggagctttggcctcttcttgcagccctacagggtcccacccttaggttgtagccagccccatctctggcctttttgttgctgtgaaccaatgaaattaccatttttttttgtcacttggtgtatccttttctagtatttgtgaacaaaagtatcctgattcacatggtgacatctaattcacatcttcttgaatactgtatatcctgaaacaatttacattaaaagatagctatggtcttagagcacctctctctttttatcctgtgggatgatatcagtaaagagttactcaaaacaggaatgatatcttttcgtgcaaaagaaaaatgagaaacttaatgtggcttataagacttttgctccgtgcttttctgagttgtaattgaagtctcaagtaggaagtgacaaacttaacaacaactctcaatgagtactttgcacaattactttacttgtaaatgtgaaaggaggttatatctgttccctaaagtacaaaaaatgataaaggggtggagaggtctgtaccgaattctggtttccattctcttattatcaaggcaaaaggagaaagacatagagatttgactttataatagcctagacttgttcagttgtggattctgttcatctgccaaacctttaatgagtgcctcagtgctggccactatgctggggacaatcctcctgactcccctgactccctgccaatcaaagactgctatggcttagaatgatgcatttgcatgtagttgccttactgggtaatgagatgaccaatgtcattattaactggctttgttagaaaaattcccccaactagtgtaaattagttcaaccattgtggaagactgtggcgattcctcaaggatctagaactagaaataccatttgacacagccatcccattactgggtatatacctaaaggattataaatcattctactataaagacacatacacatgtatatgtattgcagcactattcacaatagcaaagacttggaaccaacccaaatgtccatcaataatacactggataaagaaaacgtggcacatatacaccatggaatactatgcagccataaaaaaggatgagttcatgtcctttgtggggaatgaagctggaaaccgtcattctcagcaaactatcatgagaacagtaaaccaaacattgcatgttctcactcatagctgggaattgaacaatgagaacacacggacataggaaggggaacatcacacaccagggcatgtcggagggtggggggctaggggagggataatattagcagaaatacctaatgtaggtgatgagttgatgggtgcagcaaaccaccatggcacgtgtatacctatgtgacaaaaatgcacactctgcacatgtatcccagaacttaaagtataattaaaaaaaaaatcccccaactgataactgctatagttaacatctaataactactgagcacatatttggtgccagacacagagccaagccctttactgacattatgactttttcatttttacattatcttattaagtagctttgattgctgatgttttagcagtatgaatgctaaggttaagaaggttaagtactcagcctagggtctcagagccgctgggtggcaaaatggagattagatcccatcataccaaatccagggcccctcctatcatatttcttctgcctttcaggtttaagcaaattaagtggaaaactcccattaccctttatcgtagaatcagatggtctctctactgtacctctcagtatgctattgctattattcaaaatgtgttcattccctaaccatttctattttctagagatttcccaggtagctaatcaatttagaaaagtaactgcaacagcctagttttaaatttgattttcattcaaactttattaatttagccattagttttcatttaaaaggaaaggcattttaccaacatgcatatcatatataatcattacaactaatttcccaaattataatcaacgttcattgcaattactggtattttacataaatattataaaagcaatgttatgcatggttccatatcattaacaccatactaaatttacatataaaattggatataatgtgccctaggaaattggtggtatatttctgacacataagtaatttcaagtaatggagtcactaatagtttttgccttactcatcctctggaagccagctataaaagtttatattaggtgaactatattaggtaaaacctttggcttctatattatagataaattaagactgtgctggaattaaacttgtttctaaagtgaagcaaacacaaacacaacattatcatgaaatgaccaaagttactatcatggagtgacctaagctgccattagcaaaagaaacattgtggagactggtacccaggatagtcttcccccaaccatctcctctccctccactaactgcttctacacccaggataaacctgcctgccccatcttgacttagttcattccctcaccttagttcattccttctccactctcagcttttatttttctcttctcagtgctatttctcacttaagttatgggagatgaccttttgggattcctggcccagaatcttcgcagttgtggtacccagtctgcatgagcatggagtatgtgtgaggaggctcttgcctgccctgttcatcctgcccctgtggtgactggctggatgacattgcagaaagctgcaccctatttttttcatcttgactccacaaagccatttcacccagatagctgcctacgcccatatgaacttttcttttaaacatgacagttctgttggaatacaattctaccaattttgttttaatttcttttgaatttgtttcatgcttcacctccaatacctttactggagttcaggcttttatcagaccctgtctgcactcttgcaatacttagctgctaattacactccatgtttccaggaatatagctctgataaattcacatccctgccaaaaattctacaaaggctcctcatctcctacaagatagtccaatctcctgcctaagacatgtcaacttctggcctctatctccttccccaaccttcgctcttggctctccaattgtgtattctatcttcttgatgatttacacgtttcccttggttcccaggcctgatatactctgtccagcctctgccccactctccattgcttcccatcccattccaagcctttgttctcttaaggagctcctgactgtcctttagacagtccatcagttgcactgagcaggcttccctgctacagccccttttgtgccagtaccatttccttgctggcctcattcatcatctgcttccctttatcagagctctcatcaaaatttctgctcatatttaagatgcatccttcctcacttccaaaaataaatgcaccttccaaattttatatatatatatatatatatatatatatatatatatatatatattccataagtaaatataaatgtatatatggaaaagagaaactggaatcacaaagcaaaatatgtataatgctacttctgagaccaagcacaacccaatcagaatgtaacaaataaatgaggtatacatttctcacatattttccctaacaaaaataaaagccttcacagctgatcagagttcatgttgggtttattctcctaatgtttaaatcaatatactacaatttatgatctgctatttaccatttgaatcatatgaattacgtgtgtgtgtgtatgtgtgtgtgtgtatatatatatatatatatatatgaaatacatatataagctatgtaaatatctaggacattttattttactaggtgtttatacacagtagttcatgaaggaaattaaatactttctagctgggcgtggtggcacgggcctgtaatcccagctactcaggaggctgagacaggagaatcacttgaacctgggaggcagaggttgcagtgagctgagattgtgccactgcactccagcctttatgacagagcgagactctttcaaaaaaaaaaaaaaaaatacgttctctacagatcacttaaagtttgtaatttaaaaagagatttcctcgtagaattgtcaggctggtgaatgtagtctttttctacatttaatttcttgcctgtgtgccccacttactgagacttccataacaggacttttgactttatcatctttgtatttccaaggtctaccacagcaactggcccataaggaggtgtcagtaactgttagttaactcatttgccttccaggacttttcacatgtaattgaagaagtggactctccttgtatgagccgatataaagcattagaaaataaactgaatgtggcttgcaatttgtacatcttttgaaagataatttttggcaattacatgagagaaagggagtgtccttgggctttctttcccctgagcaaaaataatcatcaccaaactcacattttccccctaaaaagactaaactctaaatagtcaaatgatatgaaaataatccagagcttacctcgaaactcacagctccattgtggtctgtatcaaatgcattgaacagaaaatgtgcatatgttgtagagtctgaaatggtaaaaagggagtatcattaagtcagtgtttccatatcctacataagacttggatagcagtccaagcttcctttgatccagaagaattaactctgcctcctttagtttgtgctttcttcacaactgcttaccctctttctgtagaggactagagtttgagattcacaggaagaagcaacctacatagaggccattggtgacaaacattctctatgagtttctggctggcaatgctgtagtcttgggtgatgagattaacactgggacaagaaatggtcccataggtggatgtgaagattgagacttgtctggaatttgcttagtgtttggaagagaccatctctagaagtaaagtactaaaaatactaccaatgagacagagatgagttgctattattagtgtctctgtcattattagaactttcatcattgttacaactcagaaaatgatattgggaattagagaaggtgaaaaacatacccaaagtcacacagtgaagaaggagtaaatctgggacatgaacttaggtctttctgactctgagaaccaggctagccctcagccagtaccaggctagcccacaggcagtaaagttggctgatggattggggtcattggtgacttgggaagtttctgtggctgtgttggaaggggactgggtggtcctacatgttcctagttgtatgaagttgcatgaagtagggagcccctactctgtctgggtcctgggtgggattcaaggatctgggtaatgatggacaggtatgtcttctgaagtctaacaggtgttcttagtttgcttctattgggtattcttcccctctcatttttccttccttcctttcctgtttctccgttgtctccttaatctctgggctttctgccatttcatttaaaagtctgtattttttccttattgttttctgttctgagtgcctagctttcattccttagggtttctttgcttgacccttgataaaatttacattattattttcagtgttgcatctcatgggctttagccttttatcttaaccttttttgtcttttcaaaataaaatggtaaccttttagctcattggctctagccttttatcttctgttttaaatctcatctatttctattttataacttttaacctttattgggttttaacttatcattgatttaatttttactttatgaattgctttttataggctgtcaagaagctaagtcatagtaacaggagtacagaattgccctctgaggaggccatctaaatttctctcctggctctcagggctcacggcctccttacaggttgtttttcccgaatgcttcagtgtagtaattaacactactgaaggctatacatttcatgaggtagactgtacactcaatttctcaaaatgacagtggcatcttcgctcatctctcacctttttaatatgctatgaagaactacttatctttgaacacaggaattaccagcaccgttttcagtgaactaaccaagaaccaaaattgggtctaaataacatgtaacactgtgacatctagagtggatatccatccagtattgatacattgcaggaagaaattcttttgcatatggagccaggagtttaattaccataaacttagttctgttgttgggaagctccattatagagttatcaagaattggcagcctatttcaacttgcaaagttgttttactctcagcagtactttttcatgtacttcttgaactatatagtgccctctggagatgtgaattgatcgatggtgtgttgaactgattttcagaggaggaaaaaaaaaagagattttgcatattttataatgagcttcattaagcaagtctctagttaccctgttttcacaatcagagtaaatgcctttaccttagcaagcagtactcaccataaataatggctcaaaacaacgatgtttgctatttttttaatcaaaaagaaaaaagataacatgggtatatgataattactattcttctcaaatggagtttttctagcttaaagcttgatatgtgggaattatgctttcaaggtttacactaatgtggtacagaggacatcctgttcttctaaatgtgcctctgcagttcttttagaagttacagcggcttcccagtctagacaatctatgcacagaggttttgataatagcatagtggagtcagactgcctgaatttcaatctcagcttcaccagagattaactgcatgacctcaagcaagttgttttacctttgtgtggctcagtttcctcatctacaaaatgataacaatatcagtatgtacttcatagagttttttttttttttttttttgagacaaagtactgctcttgtcccccaggctggagtgcaatggcacgatctcgggtcactgcagcctccacctcctgggttcaagcgattctcctgcctcagcctcctgagtagctgggattacaggcacctgccaccatgcccggcgaatttttgtatgtttagtagagacagggtttcatcacgttggccagactggtctcgaactcctgacagcaggtgatcagcctgcctcagcctcccaaagtgctgggattacaggtgtgagccaccatgcccagccttcatagagatcttactaagtttaaatgagacactatttgcaaagtgtttagaaataatcctatatacttattaaaatttcagtaaatattagctattattatttcctaggcaagccacttttatttcaactaccttaaacacatgtgatcaaatcttttacaaacgtaacatcttttcaccttaaataacttgctgtttttgtaggatttctgttgtgtgtctaggtgacgagttctaatttaatgcaattttctgctcaataaaagacaagataattatgtcctaaaaatcaatggtccttctgatggagtttggatttcttctggcaagcacttgaagacagtggaaagttttaaagaagaggagtgaagccactggctttgactgggtgagagaaagaagcaaaggcaaaggaatgtccagctaggcagaaaactggataaaatgacgaaaagagaaactgtctacaaaagcatctatggttctggttttactcaactgtgttcttaagcactcaataaatatttgttaaaagagtgattaactgacttcttggaatctagatttcagtacagtccagggcttaaaagatataacaatgatctcccttctccgtctatgacctcttcgtgatcacattcctttacataacaaaaatagttactgagtttgttaagctgggattgcctcagtttcttataattttacttgtgaagctgaaaaataaatgttgagattttatagttgagcaacaaaatttacagattcttagggtgggaagacattttggatactatttagcattgtatttacattgaacaaaggtaaaaatagggacttgtagtgacatactgaggtcacctagttagttcatggtaaagttggcaatggaatcaagatattcctataccatctcttagaaatcgaggatactagagtagaaaaaacccctaggattcctttggtgtgactcctgcattttatagaggaacaacttgaggctaagaaaagtaaactactcgaggttacataccttggtggtggcagtctatccacaaactctgaacttagtccaaagttcttaacccaattatatcgagaacacagtgaatatagcaagtaaccctagagttcgttcttcatagtatttgaacaaacacacttgattatcatgccccaggtttgtagaatgaaatcaatctggtttatttctttttcctttcccacacccctactcccattgaattcaagcacgaggaatagaatcaccttcatgtatttgaatatacaattcatgacatcgttactatggtaagacaagttcatatgtgtgaatagtagcttctgtcaataagccctctgtaaatcaccctgaaaattgttagaaatactgtcctaggacaagaaggatactcagtgggtgaagtcttttttaaattttattttaatctttatgtctacagaactcatctgactcaagtgacttgcatacagcggctgcttaaaaaatgtttattgacagattattctgacttgagctcatttgttcattcattcattcattcattcattcattcaacaactgtttattatatgcctagtgtagacaacataagtgcattcctacaacatgagcaggaatagcccaggaaactatgatttttatgggctttaaaaatgtttagtgaactaaaagcttacacactaaagcttctgttgtatgtggagtttaagaagtttttgtgtaaccatataggcaatagcaccaacaaaccgtttcctctctgcttgccttacagtaggcatactttatcccctgccaacaagaggcttttgttcaatccagttttttctgacatccagctcaccaaacaagttgggtttgataaactgtttcacaaagcaatagagaaagctaacagcctgacacaatacaaattgcagagagttctgtagataagacaaagcactttcctggaggaaatggtgagatgttgtgatttatggacccatcaatgttactgttcataatgagaaaaactgttgcattcagaccatcatcctgaataaaggatgactccgtggaagtgtaaggatggccatcacatgaattcgcctgccatcagagatcacattcttccttaggacatttttccttttctggccttatgtaagaaacaatttgtatgtatgatattaatttttaaaaatgcaaagcaaatcataattctttaaaatatttcatttccttcagcgatgcctcatgtggtcagatttctgcattcaattaacatgaataatgaaataattgttaagagtgtaacagtaattttttctcaaatccctaatccctttggattttgtgataggaatcctttgcaaaatagatgtgctctgtttaagaagatgttctctaatgcagaaatgttatttttcaaataaagatataattttaatgtggagctctatccaagttttagtatgtaataacttgatttgaaatgattgaaaaataacttaaagattttcatctgcattggtgctttgatattaatgcctattaagatgttggtaggcactcagatagtaaatataatttttctttaaaaaatccatgggttttaaacaatttagaaaaacatgaggtagttaattaattccccaaattaatctctcattaatgcagacagtgaactcattataatcctggcatcaggtactattaccaatacctgtctgtggtttgttagaagggccctcccctctgcactgtagtaatgagatggggtgggagagttgtcatccaaagtatatccaaattcacttaataacagtcttcctgtgttttcttagaattctaatttaattcttttaaaagtccaccgaaaacaaaaatttgttttgacatgttaggcacaaaattgttttaaatccactaaactagctaaaaccaaatggattaaaaccccaaaggaaatctgacttttgtatgaaacaactaatacttaagtgctgtacacttttcaaagagccttttacagatattattccactgtacagtgatagccagccaccatgtgaggtgggtgtcattcattcattcatgcaaaaagcatttatcaagtgctattacttgtcagccactgtcccatgacctgtggatacaacagtaaacaaagtggagaaatcctctgttcccctggagctgacattctagtggagagaaagaaacaacaatggtacaagtgaaatatatattattggattgtctcgagtgccgaaaagagacataaagcaggggaaggggatggggaatgtttaaggtgttgcaatttaagatagagtggtcagggcaagtctcactgagaaggtggcattggcgtaaatgcaaaggtgatgagatattgagatagatatttgggagaagataatttcaggcagagggaacagcaggttcaaaggcccaggagcagcatcatggctggtgtgctggtgggatggcaagggggccactgtggctgggtggggtaagttgggtgggagaatggtagaggataaggcagagaagggacaagagacagtagccaccatttgtaggccactctgtaggttgtggcttatgttctatggaatggtatggtttcgaacaggcagtaacatgatttgcttgcattttaacgggatcactctgactcattttaagagtagaccatggttaggggaggggtcatcagaatcagagaagtcagtttggagactactgtgtttattttggcaggagataacggtggctcctttaagtggaaagtagtaaaaaaaaaaaaagtgttggcaaggtcaatggcaaagtcaactctggccataataacagagagaaacagttgtcccctatattgagtagatgtcaaagttgaaaggaagtactagatggttccctcttgtcttgagataaaaccttcttcctgaactcccgattcatggactccactatcccatcgcatcactatctttttcctccaattctgaatcctatttatctcttttcttttctatcctaaagctattaacatctccttctttaccagtcttccctgtgtataaacaatgtccagtcttttctacattaaaagataaagtcttccactggtatctacccagcactatgatcagtttcctcatcacttcactcttccagcaaagctttttgtaagtgctgtctctattggttgtcgctgttttcttctcatcgtccttttcaccctctgcaatttggcttctgcttgtgcgctccactccctagtagttcatccagggcacttgggctgtcctgatcatgcccaacaatgactcccatgttgccacatcccaaagagaccttctgatccttaccttactggacttcatcatttcatttctgaactatctatctctcttgtgtttatttccataaactgttcattctctgtctcctttgttgatcccttttccttatggttcttgacatgtgttctggagtttcatgctggcctcatggagcttgcaaccttttataattcccccagtaacctcatctacatcatggatttaaccactacttcttgattaataattctcaaatctctatctctttctctgacttgtcctctgagcctcacatttgtgccaacttcttgttgagtctaaatccccacaggcacctcagatgtaatttgtccaaaactgagatcattatcgccctattcctcctgtaaagagtcacctggtgtccatgatggaatcctggaaggtatcacaaactcctctcttcatctctttatgccacaaaaagttagttcatcactaaattcttccatttttgtcatctaaatatgtctgtaatctgtccccacttctcattttctcctatgcatatacttatttaaagaccttattgttttgcctcctacagcagtaatcttctaattagtctccctgcctgcagtattgctgacctcaagttaatcttccactgacctatcagtgaaatgtatcccaaacacaaatcaaatctgactgtaaaagatcccacttaaacttatcagtggctttgcatcacctcaaggataaagtcccatttcttcatatggcatccttgactctctaggacatttcaccctccattgtacactctctaccctagccacacccaaatcctggcaatttcctgcaaatgcccatcttcagttctatgctctgaccctttgtttacaccccatttgcctaaaatgtcatgtccctactgccttttaaagcgggaagacatcatactcagaagtgaacttctcctgagaggtataatgggagagcgaaagactatacactttggaaatggatcaaactctctgcaccttagtttccacgtgtgtatctttaaaaaaatgaggattataggtagggttgttggatggtgaggcatgccagggacaggcacatattagatgctttctgaatggcaacaacttcagctcaggttcaactcatctggagagtctctttttatgtcctctctgtcctgcagctaatttaatcatgccagcactgtgctctcagaatattattttttaactcccataatcacagttatacttgagtttgacattgtccatctgctacactaggtataacattcttttgggcagagattacatcctattcctcttaattccccctacgtgatcagcacctcatgcatggctaggcacaccataggctgtgggacaaatataagttgggcatctgttaggtaattgaaagaaaaactataaggtccaatggcaagaatatcttttcactcatctctaacatgcatgtattatcattacgctatccttgtgttttctttccaattaaaataatatctaggatggttttaattttctcagatgagggagcacagtaaagaattactgaaagaaagaggaacagcagaaaatatacaaggggaggctgcagaaaatctaggttataacccagatctgccactgagtcaatatgtggccctgagcaaaccatttaccttctccaatccccagatttcatatctataaattgaggataattacatttttcctaattttcagagttgggagaatcaagtgagacctacaatgcatgtgaatgagctttgtggcatttttgagcaccctcataatagtcagaaaacattgtgcatttgagagccacagtactgggcacacagtaatagttgtattaaactaaagagcagcctcttggatatttgataatttctaagtcgctggcttttatggtacattaaaaattatatacacttgcatgctgtgcattaattcttttacataacgattaaaaatgtagcatcatgctatgaaaaattaaactcaacactgcaagcataattgtaactctgatagtatgttaacaagtccacatttgtacttacctccctgtggaaagaactgcgagtaaatctctttgaaggtttcttcattaacaacaccactggggcattcctagggaaagtggcagagaagcaatatgagcaaagtgttcataaaactgaattttttttgcacattttgaaacagaactgtctaccatgcaaagctgcaccaagaaaattaaccattcatccattattacaaagggaataaaagcacactataaacttatgtttgttccagttctcacaagaaaaaaaaacgtagatgtaaatatctttgcatattgagtatcaaagtaggtgtaatgtattcagaaacacagtgctgcttttaagaacacatatgtttattataaagtaaaaggaaattgcattatttttcacacagcaagcatgttgcaagatgtttataatatagtctttggtgaatcttggttttgtcctttcaaggttttctgaactcacataatcttcgattcaatggcagaattactctattggcatctctagtggctcaagaagcttcaaccagtaatagatactaatgcttgttaacaggatgtctaggcatacccaagacatggttttgtaacaagtgaccttgggtgagatagaaccccatatttttgaacttccggaaaggagagtctgcaaagaaatggcctggcctgggcttaatagatccccacctttgtccctgggtcaacttgtcaaagaatgatggacattgatcttgggaactacacccatgttggacaactgacctggaggggccacagggcaaggttagccctctgagagtggttttggcatttttgctaataaaaaaaagaaaaaaagaaactttaaagtgtcagaagggggctgccttggtgcagaatataaggtttgagcaagcaaattgtcccccaatctctggaaattcctccattttttggagttataagaaccagtgtggttaagaatttaggcgtagaggccccttgagtggtggagactgacaatcacatgatagcccagaattgaatcatgtgagatattaactgtatggtgatcccttgttatccttggggcattgcttccaggaccaccgcggataccaaaatccatgcacattcaagtcccacacttggcactgcagaacctgcagataagagaagttggtccttcctatcctgtatctttgatctgcatttggcagtggatgctgaagctgcaaattcagaggggcgactatatttattgacaaaaatccacatataagtggacccacacacttccaactagtgttgttcaagagtcaactgcacattgtaagtggagaagtggtaagttctgtttagtctcttttagtagattctcatgaacagtcccatgtgatcagagctcccctgactctagttgtcacagcactcccacgccacctaacgtccacccaggactaagttcactggggaaggatgaatggtgtgctaactccccaacagacctgactttagacatgaatattctgtgtactctaaatttgatactgtttccagcatctttatcaatcacctatggtagtatttaaaacatcacttaacccttaaaatcattgttccctcactaataaacttactttctttattccagtgagtcagttactcaactgtaatgtgcttcacctgcagaattttctattttctcatttgttgttttgaaaggtaggacctttgatacataaacagtgttaacagtttcaatgtgaatttgtgtttacagagcttctcgatatggttttatcccatttgttaatgatgagcttaggtaggcaaaatagctgcattcacagaggcagaactggaggtgctgagtggcaaagcactttgttacacactaagccagtggggaagctggaatgtgggcttggaactctccaggtcatgacaaggtttcgtattagatgacccctgtggaaataatgatgacctcaaggacctaagagaattggagtaaagaaaaaaacaaccaaaaacaaatgagcaagcaagcaagcaagtgaactgtgatggttgattttatgtgtttaacttctctgggccatagtgtccaagtgtttggtcaagcattattctggatagttctgtaagggtgtttttgagatttattacattgatgcaaaattgcggcttttgctattactttcaatacatttaagctggtagactttaagtaaagcagattgccctccacaatgtgagggggcctcattgaatcagtttaaggcctgaacagaacaaagacggaccttcccagagaaagagtgttcttcagacatcatctgtaatattggcttcccttgttcaccagcaccctgcctttggacttgaactgtaactgttttctgaggctccagcttgccagaccccttcattagatatcaagctggccaaggctccacaaagtgtgaaccaatatcttaataagtctctttatactcacacatcctattagttccatttctctgaaggaccctaatacataaatgaattaacaaccaatagctacaactccaaaggtggtatgtatacagctaatctctcaaacattttgactatctatctagctgacaccaatggacccattttaagactaaacactttgcagttagaccctctcacacatggaaattgtgatttattggctatttaatgctaagccagttgcttgggatagtaaggagagagtaaatacctggctctctgccatcaggtggcaagcttgtgcaaagttagagctggaaagttgcctgggagttaaaagttgatgctgataaaggaagaggacttcaagcaaagggacctctgcatcaacaaatttgttagctgccttcagtctctagatatatttgatagatataatgtgaaatgaatttgtaaactgactatctgatatgcatgtgttttatgtttaatcacatatctgtgtcagaggaaaccttttctctgccaaatgaaaactactggccaagtttcagggtggaaagtctcaccagataaatttgtttttatccaccttatattcattacattagtttacatctctacaaacacatactgtatgcctattattccaggagtcttctaggaactgggactgctacaataaaccagtcaaaggtcttcccatcatggaacctctatccaactagaagaataaagactgtctttgttcaggctcctttaacaaaatgccatagactaggcagcttataaacaatagaaatttatttctcatagtactggaggctaggaagtctaagaccataggattagcagattcagtgcttgatgaggccacattcctggttcatagatggcatcttctagctgtgttcccacatagtggaaggggcgagctagctctgtggggtcttttataaaaggacacttatctaattcatgaagtctctgtccacctgatctaatcatctcccaaaggccccacctcctaatactatcacattgggggttaggatttcaacatatgagttctaaagggacacaaacattcagaccatagcaaagaccaataactaaatattaaaaaatcaaatccaagaatgatgatcttttatttattcccagagattttttattgaaactagtgcatttttttaaaccttcaggtgagaaaaagatgctagtgatttacaagatggtatacattctgtaactttttcttcacctcttctgtgcagtgatctctccataaaagtggtctctctacttctctatcaagaatgaatttggccaggctgcatgtgcagcaaagtgtaaaacataaacaatgtgctgtattagttaactcttgctgctgtaaaattaggccttcaaatgtcccttaatcaaaatgcttgggaacagaagtgtcttggattttagattttttgggatttggaatattcacattacactcagcagttgtgttagttcatttccacactgctataaagaactgcccaagtctgggtaatttataaaggaaagaggttaattgactcacaggtcagcatccctgggaaggcctcaggaaacttacaatcatggtggaaggcaaaggagaaggaaggcaccttcttcacaaggcagcaagaaaggagaagtgctgagtgaaaggcaggagccccttataaaaccatcataactcatgagaactcacccacttatcacgagaacagcatgggggaactgcctccatgattcaattactccacctgctctctcccttgacacctggggattatggggattacaattcaagatgagatttgggtagggcacaaagcataaccacatcaccagttgaacatacctaacctgaaaatctgaaatactccaatgagcatttactttgaatgccattttgtctctcaaaaagttttggattttacagtattttgcttttttggatgagggatagtcaacctgtataacacagttaaaaaccacgtagtatatttcttattcacataacaatcttgggtgagtgtacagatcagctgatggttcttctagggacagaggctaatgaagatttggtgactttaacatatggcgccaacagtctctgtgactgtgtcatccagaaggaggaaaagaacgctgaaaagagtacatggaaactttttatgggccaggtcttaaagtggtatacatcatttctattctcattttttttgttgttagagatcacttaatgtgtctaccccaaacaaaataagaagtctggtatggccagaaagaagacaagaatgcagatttgtaaagagtttggaatatctatccctgtggcatgtttgaaagatactccaagtgtctgtgttctgaaacagttctcccactgatgctttatttattgatttttattttgtatttttgtaaagatgggatctcactatgttgcccaggctggatttgaattccctgccacaagcaatcctgccttggcctgccaaagtgctgggattacaggtgtgagcccagcctcccactgatgttgtaacatgaagattatcaagtcatttagcagtataaattgtctccatttcccaggtgtcatttttaaagactgtttacttgcttcaagtaaacaagtacaatgaagcttaaatgtttgagcatgaattttttcattagatttttctaaggatccaagaagcagtagggttcctgggtttagggatagtaagaaatgcctcactcatccatcttctgagaatttgctgcaagcttctactaacccttatggttctgtattctattttctaatgaaattttgtctgattattagcaaatgattattccatgaaaatatgccctctatagaaaaaaattaaagaaaatgaaaatcacccataatctgactactgtaagagtatattggtcatttatataagcatatataccgtagaaataaagttttaataagacaaaattatagcattttatgttctttaactttaggaaatatcctgaacattttttacatcatgatttttagtgactgcataataatgcatccattgaacttaccatactgttgcatattgaggcgattttggcatttttgcactacataggaataatgatgtaattaatattctatgcatccttctgtgactgcacttgtggtttcttctttatgactaatcccagaaggagaatcgtaagaccaaccagtttaaaccattgaaagctctttctatgcacagtcatggtgctttccagaaacgctgcatccattcgtgctgccaccgcagctttatgagaaagtctcacaccgagaggagctaccgactagaatcacatgggaattggacacacacacacacacacacacacacaaccccatgaacaaacagcaataatttgcttccctcatgaatccaatcgtcattctgaaaattaccagtggacattgaggcgtttggacaggtccctccgaggcataaagcaatttgcctgtttttcacacagacagggtcgctgtgatggcactcagccggaccacatcaccacaatcacagcggtttattgaggataaaataaacaactccattccttcttatgcagaccattacttttaacactttcatcaaccctgaaaggtgggtattatttagacatgaggacaatgagcttggagagatgaagtcacttgtttgagtcacacaggttttgacagagacatctttttgctcatttattcaataagtagttatttaatgccttctaagtgtcagcaaatagttcatatgccttttactattctgggcactggagatacaggaatgagtttttaaaattccatttcttttttgctcttgtggaatataacatttagtggaatcagactcataactctgactccatgaattgcaatgctatcttgccttctggattattactttttcttctattaggactgaaaacatagtctcctggagagtcatctgtggaaatccttcttctgggaagatgtacacggtgtatttgtacccagaggcacccatcacagctgcgttggagagaggcatgtgcaaagggaagccatttcaatcaaaattgggatcaccgattaaaatttattgtgcattgtagcttgagagatttgaggaaagcaatctttttctttttagaaatctttggttttagtgtaacaagaacctccccaccttcctgtgtgccacatactctttactgtcattgtaaatggctagatagtaatgggctgaggaaaatgttctggtttttaggaccagtcaaatgaactgctccatccagtatttaggagctggaggtctctggttctgctggctggtatacttatctatgatgaccattgcatttctttcattgcctgtgaaacccttcactgtgatatgatcacaacacaataaaagtagaatgaggttttctttgcaatataactgccatagatttgtctgttggtgaagaaacagtcgccttttggggccttactgctgtgttccctgatgagccttttcagtcctctcaggccatgtggggacacatgtgagggtcaagattagttgtagatatgcaatgaatactatgctagtactaatatcaattttaataaggcagtattactattgtaataatcagcataaagtaatactttattggtattgatattttataattattaatgtgatgatgacaatgatgatactgatgatattaagctaatacacatgagcactttttatgttccaacccttgcattaaatgttttacatggattatctcgtgggaatagaaagatgttagtattaactccattttacaaatgaatgaactgtcttagagaggggccactgcattcccaaattagaaaatagcagatctaatctatagatcacagaatcaggaaacttgagagtttaaagcaactttagaggccaggcacggtgggtcatgcctgtaatcccagtactttgggaggccaaggtgggtggatcacctgaaatcagttcgagaccagcttggacaacatggtgaaaccctgtctgtactaaaaatacaaaaattagccaggcgtggtggcacatgcctataatctgaactacccagcaggctgaggcaggagactcacttgaatctgggagatggaggttgcagtgagccgagatcacgccactatactccagcctgggtgacagagcaaaactccatctcaaacaaacaaacaaacaaacaaacataaagcaactttagagacaattcaattcaatgtcctcattttgaaggtgaggggatagagattaaggaggttataggaactgaccatagatacacagggggctgctaagcctgacctcatgtctaggtttcctgaggtctaggactaagctttgatactgcaaatgtcttcgtgtccatacaatagctggtaatttttgtcaggtactatttagaggaatctagtgcagtgcttatattcttgggctctggagttaaatagaaggcctgggttgaacccctactctgccacttgggagctgtgtagcttcaggcaaactgtttaatctaagtctcattgctctcctctgtgaaacggggacaggaattgacctcagagagctgctataagaatgaataagatacacatattatgctattatcctagccctctaccttacacatcatatttggtcatttaatattagctgttagtaccatggtaatagtttaggatttggtaagcagaactccatcacgcaatgagtcactgtaacatcaatgccgatagaccaaggataaatcatatttatcaacgtggttgaatctagaataacacaggtctgaaatgcaatcagcttatgaagtatatatgaattacgctttctattctagtgttataagttgaatcactctatctaatatcatcagaatttaccctaaaagaaaggaatattgtaattgtaaatgatagcagaggagaataaaggccaccatcatggaaataaatgtcagtagaaacccaggagcctcttatttattaatttaaagttttccccagcgatgcttacatggtatgtttgaaatcatcatggaaagtgttgggaagggtgctttggagaaagatccatgtatgcataggaaattgctaagaaacatattttgtgagtgcttcaagagttcttatactttcaccttataaggaaacctttcagcatttcctggaaggttttcagagctctgttgaaatgcatgagaaatagctgcagtggtatgcaaatcacaggtataataacatcatataattataatattgtccactccaataatctttgcccactctattagctgaaatcttctcttcccctaaatcattctgttctgatatgtgtcttctcctcaggatcagaattgttattaaacatttagagacttcttcaggattaaaaaaaagaattacagtaagacatttcataggaaaaaaaaactaaaagtgcttgtgaaatagttatttggggatcctttcatgatacctgtaatgccacatctcttaggcatctgtatatttcaccaactctcacacccatctctggtgctaaggagaacatacaaggtagtctgctcggtctatcagttaaaatagtatttagcatgtagtatgacaattcagagattctctggcattctataattgcaggagaattttcaaaatttaaatgacacaatcctacaacctgtgctgctgatatcaccagattctgtggacttctctgctctctttagagttagtaaatacaaggcagggactaacctttacgatgtttagaatagggaatactaaaaatatttatgctgaatgaataaatcttcagtcagttcttagcttttaataaattagaaaatgaatttgctctgataatgtccttcaaaacttgggcctacatttttagaactcctaagaccaagaccaagatagtcatgggggttccgatatccccatgattgcccacaatgactatgatcgcagaaattaaggggagatggctaggatcaagaaaaacacttcttatttcaacataaaaagcttaacatagtcaaaaattggattctaaaaagctcatttaaaaattataggattaacctttcagttttcaaagcagaaaagctgatcattaagaactagagctggctataaatttctgttctaatatgcccaggtgtttgaactcctagcaactcatttattccttcttagtctaaatgttctcatctgatataacaggtaagtaatactaacatcacaggtaagcaaaagaaatgcaaactaaaatagacaatggatgaaagaaacccaaccaattttaaaaactgaatatactcaacatgttggatattttcttgtttccaaaatctgcattaactgcctcttccatttcctgaacacacttctggggtcaaagtggttaaataggcactgcagattaaaaaaagaaacagccaatggtgggaaaaggctgacctagatactatccttggaaaaggaatgagagctgggtgaccaagattcaattcagctgcaaggatgtgggcacattctgagccccacgagttctcagggtcacccaggatgaagcagaaatccaaggtactaggcaaaggttctctccccttcagttctgccctctaaccatatggaagaaggaaatcacatgagatttacagccaaaaaaaaaaaaaaaaactggctcaagtttcagctctactactaatgaagaaataattgaaaagttctgctttgagtcttagtctttaaaaatgcaggaaacaatagcatcttatagtaaagaaatgagaactaattggcattatgtatataaagattctagcataatactaaacattctacaaattgtacttatttttactattatctcttcaagtaacttaagttggttctgcaaaaagagattttccaaattttgtaggaaaaggcttcctgggattgggcccaattcctgaatctttagtggaatgcatgtagaattgtttgatttacggagacttttaaaaggattttcccaactttatccagaagacagtgtccattttgtcagggtcttttaaaaattatgatgtagtgaaattctataggcacccaaaaccatttagtggaaaaaaaagacaatggtgccctgggacaaagcctatgtatcagttttctattgctgcataaaaaatgaccataaacttagtaactctaaacaacacaaatgtatcatctcacacttctgtgggataaaagagtctgacatggcttagctgtgtgctctgctcagtctcccacttaaactggctatggttctcatctgggccttgcagtcctcttccaagctcactgaggttgttggtagaattcagcttctgtggttgtagggcccaggtccctgtaaccttttggctgtttactgggggcttctctctcagcttcattccatcttcaaaccagcaaagcaaaggcctgttgagtccttctcacactctgattctctctgacttcccctttggtaaaggactcgtgtgattagatcaagcccacaaagatcatctctgtatcttaaggtcaactgccctgagactttaattatatctgcaaaatctcatcacagtagtaccttgcttagtatttgattggataaccaagagacagggatcttgagtggctgcatttagatatctattaatacctcccacagcctgcttcttctgaacatcagttcattttggttttcatagcagtttttgtttaacaacagtcttttttttacaattatactcacaagtgtatccaccacaactcgcaactatatttcttggcacctgccatagtttaatgcgatttgaaaagactatattctgtcaaggctttagaatcagcagtgtaaagaccagctgtgaggccaaaattcaatattttttatgagtgctaagaatagtatcccatatgctgagtgttccccgtctagagtatgtctgcctatatccagagcagaaataaatttttttagattttactaattgattagatcactttcaagttggcatgatatcagcctaataatattgaccaaaaaaaaaaataccgagtaaagaattctacttaaaagaaacacgcagtgtttcaatcagaaagaataaaataaaatacagcaggtactccatatcgcagctgcagcatgcacagattcaactaactgtggcttgagaatacttgaaaaaataaaaattaaaaataaataaaaaataaggcaggtgcagtggctcgcgcctgtaatcccagaactttgggaggctgaagtgggcggatcacctgaggtcaggagttggagaccatcctggccaacatggtgaaaccccgtctgtactaaaaatacaaaaaattagccctgcatggtggtgcatgcctgtagtcctggctactccggaggctgagacagaagaattgcttgagcccgggaggcagaggttgcagtgagccgagatcatgccattgcactccagcctgggagacagagcgagactccatctcaataaataaataaataaacaaacaatatgaatgaaaaacaatataacaactatttacacagcatttccatgtattagttattataagtaatctagagatgatttaaagtacatgggaggatgtataggttatatgtaaatactacaccatttcatataacgagacttaagtatccccagattttggtatccatgggggagggttctgaacccagtccctcaagaatacagagagatgactgcatggagatgatggtatacacatatgttcatatatatatacatggttgtataaagcctttttattccctgaagatttaaaaaaatctattctctcccagtctgatttctgtcacctactaaattggctagattctggccccttgataacttcatttagactatgatttctggactccttatgtgagattacacattttcctcatgtgtaagccattttttattgatcttttttgttacttatagtcaaaagcattctaacataagctacaaccttcttgtccttgtattacacctttctacagaaagagaaaataaaaatgagttgagtttacaggttgctgacaagtttggtgaaatgtctgctggagaaagaggtgtcgtctatagattacggtggtgggtgcgcatatgcaggtccagatttttggagaacgtcttttaaagtctatccaaagacactttgagaaagcataggaattgggggtgaataaaactcactttttttttttttgagacagaatctcgctctgccgcccaggctggagtgcagtgctgcgatctcggctcactgcaagctccacctcctgggttcaagtgattctcccgccttggccttcctagtagctgggactacaggcacccgccaccaagctcagctaatttttttgtatttttagtagagacggggtttcaccgtgttagccaggatggtctcgatctcctgacctcgtgatccagccagcttggcctcccaaagtgctgggattacaggtgtgagccactgtgcccagctgaataaaactaaatttaatgatcattcgtggtctgctgggcactgagccatgtggtgtaggagatacatgttctcattaaatccctgagaagtagaaaaggtagatgttttaccacacaatgtttaagaaatgagcacagggaggtttaaagaactttcccaaggtcagtgggactgggatttgaacttgagtttgactgcaaatctttcacatcttcctaagcttgaaaggtgagtgcacctgcggggggaaaagttaactaaggggtaacttttatcccaatgtctttcaatcctattaatcactaaaacacaaagtattcgttatttgttcaacacgtattcatataccaagcacttgactacgcacaggagcgtaacggttaatcaacaagcatggccctcatccaaaggagcttactacggaggaagcagtcagtattcaaatactgacatcaataaatatattgaaaccctcagggcaaagcagcatgaaaacttgaattgttttttacaaataaattgaaatgtcccaggtgaggggttggaggataggacctcaagttgtctggtcatctgctttggtgaggcaggttcaggacaggtcagattcagctctaaatacattttatacattttattatacattttgttccctttctctctctctttctttcttcttttttttttcttccgagtttcgctcttgtctcccaggctggaatacaatggcacaatctcggctcactgcaacctccatctcctaggttcaagcgattcttcagcctcagcctcctgaatagctgggattacaggcgcccgccacgacgcccggctaattttttgtatttttagtggagacgaggtttcaccatgctaatctcgaactcctgacctcaggtgatccgtccacttcagcctctcaaagtgctggcattacaggcgtcagccaccacacccggcccctttccctttcttattgccattctgagaaaatactagtttgtccctcttgcacaagtttttccctcagtgagctaccatttccaggagcagccctgagtctctgaagttaaagaaaaaaaaaaaaagtttagtctgcttaattaagttcttgttgcaaaactttcttagttattactctcagttgtagcttttggaatctaacagcccctcgcttatgagccactcatatcacttactagcctggaactttgaataagttactaaacttcttcaagctggattttatcatcactcatttatgcaggacgtatttttgaaattgttgcaattgttgcaaatacttgagaagtttccaccctcctttgccttctcctagtgcttcttcagaggctatgaagggaacaattatcaagggtcacggtagctgcctaaaaggaacctgtgtctagtacttcagtgcttccgagctctcaggtgggacagtaaagcctctgtctcctctccatgccaggcaaaatgacccaaaaggaaactcccgggcctgttgactctgagcaagctggggcagaacgcttccgagggctctctggagctcagacggcgctcagcgtgagttggaccaaacattcttagggttgtatcatcataatgaggcacaagggggcagtagtgtcctccatgatagctagaaaagcgatttccagttctttttcttaagggattgttcttttcctaagcttggtgcctgtctgggtaaatttctttcaagaaggctatttcctttttatgaacggtgacagcctcattcctacattagataatttaaaaaattaactatttctgggaatggggcccagagactctgatctccattttggatattacatttggtgtacgtcagtctgaattcacaatcacttttttggcagttgggccacctttaatttagtcaccaaaaacttgtagatcttagaaaacaaataagcaagacaacgccactaaagttccaaagcttgagtctgaaaaccttctgaaattgttaagtgtatgtgggctctggagtcaaagctgcttgagcctgctttgctgtttaacaggggaacattttaaacctttaagatgaaaataatgatactaccctatctggaggttattatgaggcttaaataaagataacccatgcacaatgtctagcgtcgtgcctggatgtataaacacccagtacacattccccatggaggaaattatttctacaatgatgctcgttctgaacctgttagcttttgtcatgttttcatgtaatatgggatattatgtttatccttgttaaataccatctgcttatttaatttcagaggattttcagaatatcacaccagtgttccacttccttagttattactctcagttttgtagcttttagaatctaacagccccttccttatgagccactcatatcacttactagcctggaactttgaataagttactaaacttcttcaagctggattttatcataattaattaatgcaggacatgtttttgaaagcatattatatgtcagagagtgtaagaagaaatggagctaaaacaatcaagacagatgaagtccctcctggagtttgatgactatcagagaagtcacacataaaacaaagttctgtgtaaataaccattcagttacagttgcgataagtgctacaaaccaagtatggaaggtctaatttatagggaagacttccctgaggatgtgacatttaaagagggacctgaaggataagtaaaaactagcaggagatattgctggggaagaggcaaaggaaccctgtgtacaaaaacctgtgatgtgatcaatgactaaagagatggcaaatgtgcctggggagtgtggtctgagacaaggttggttaatttggggcctgctagttacattaagaatcaaggtctttgccattcacaagataggtatcatatacctgtttttcagagctctggagagaattaagagatgatttacatcaagtgcccagcacaatcccaatcgcattctaaacactcagcatccctctcttttctgtttactctaccagagttgaatttttacctctggtttattatttattcaatacgtaattatttagcgtctactgtgtatcaggctctctgttataaactgaacaaacaaaaggggaaaagcagacatggtcttgcctttatagaatctctccactgatgagctattatgttctttgtgcatatgaatttatttcaagggaacaatagtttcaacatatatggcgattaaaatcttgtgctcctatctccaaaaattaaaagtaaataaaagcaagcaagcaagcacacagaataaactcacattgccatggattgcaatgtaaataactcaagattatgaacttgtatgtaggagttacttctgcatgtttctttgcttttgctaatgattaataataacgagtccaggccagacacagtggttcatgcctgtaatcccagcactttggaaaaacaaggcaggaggattgcttgaggccaggagtccaaggccatcctgggcaatatagtgagactcagtttcttaaaaaaaaaaaaaaaaaaaaaagttagccaggagtggtggcatacaccttttgtcctagctactcaggaggctgaggtgggaggattgcttgagcccaagagtttgaggctgcagtgagctatgattgctgctgcactctagcctgggcaacagagagagactgtcttcaaaataaataattaaaaagaataatgatgattgtttttacagtatattcttgcacatggtacagatggttagaataaatctctgtactactgaaagtgctaataagtctccattatattatcttaggggctaagtatccttcaggagggcagaaagactcccagctattaggtgtatctaaaccccacatggctatgtttaccctgaaactgaggcagtctaactcttattcctttctgtttacctgttttaatatattgcatatttatctatttaatatatacaaatgttgtcttctgataaaggtccagaaattccaggcatataaaagagcttcaaatcccaacaattctaccacattcacttttcatttccatctgcacatttttcatttttagagctcatggatagtctagacatttatttgcaaatattatgaaggtattatttcaatcagcaagggattctcttcaaaacttatatgagcttatggtaacaattcttattctctctagtgaggcataaagctaaaagttttatgtttttgccccgtaaggaaggaaaaacaatgcatgtttttgtttttttctagtatctcacagatattttcatttcctggtttaccagttgttaaccttaatgcatcccagaaggagattaatatttggatttaaataataggagctctactttcggtttcttgttatctttgctgggagatgagaagtctggggtggtttattctctgtacaacctctcaaaattgtactatagaccaacatactgaggaagataaggagcaatccctccagtacttacaatgctcatatgaaaatagatgattttctgaaagaattagaatgctatattttattaattgtttctagttagactttaattccaacaactaatatctccttctttaagaatgatttccctaattctaccgttaggaaattatttaattctaccataattatgttttatttttttccattttatgccactgtgccaggcactgtccattttatgacatatttgtgtcagcttaacaaatctagctcatcagttcagaatcaacaatgaaccaaatattactgtagattatatgttaatacataggagcacagttattacatgtataactatttctccattttgtgaccattatagggtaattatgaatagatgaaggcatgattactttagatcaaaacacaggcaaaaaaaatggatcttctttggggaaatgttttatgctatagactgaaagtgtgtgtggcctccaaattcatatgttgaaacctaatctccattatgatcatattgggaggcggggtctttgggaggtgtgttagttcattctcaggctgctataaagaactgttcaagaatgggtaatttataaagaaaagaggtttaattgactcatagttccacagggctatagacgcctcagaaaacttagggcagaaagggaagaaaacatgtccttcttcacatggcagcagaaaggagaagtgccaggtgaagggggaaagccccttataaaaccatcagctcttgtgagaactcactcactatcatgagaatagcatgggggcaactgcccccatgattcaattacctcccactggatccttcccagaacacatggggattatgggaactacaattcaagatgagatttgggaagggacagaaagcctaactgtatcaggaggtgattaggtcataagacttaagtttttaatgaataggattaatgttcttataaaagaggcccaaagagctgctgtgcctcctccgccaagccctagtgacataatggaaatatggtcttccatgaaccaggaagagggactttaccagtaaccaaatctgtcagcacctcgatcctggacttcccatcctccagaaatgtaagaaataaatttctgttgtctataagccacccagtttatggtaatttgtgacagtggaggttgtagattacagagaaaaagtggaggttgtagattgcagagatgaattagtgtagtttatgaaaccatgaagtttgacgttcctgagggatatcccagagaagttgggaaaccagtaattagaaaggagtttggaactcaggtcagaggtcaaagcttacagctatcagtttgtgctcctttagcacataggtatagagatctcccaaggaaaatacctaatgaagaaaaccagggagctgaatgcacagccttggtgggaagctacatttaaaaaacaggaatgggataagcagtccatgaagaccaggataaagtagacagagaggtacaaggagaagccgtagattatatcaaaggaaccaaggaagaagaggcattcaagtaactcaaggcctccactcccaaactcagcagagacttcagttaggtccagagaagtcacaggagaaagtgttagtagcatagactctgaaacaggctgtgtaggcttgcatctagtctccactactcacactagctgtgtttcttaaattctttgtgccagtttattaatttacttgtgcctcacttgccttatctgtaaaatgggactaatagtatacttaccccatagagttaatacaaccataacattgaccaatatttgtagaaccttaaattcttaactcatagttagaattaaatatatttattgaatttaaatcaagcaattcatagatgtcaagattggaaactattcagtggatttgcaaatgaaatgtagttttgacacacacacaaatcagtacaaggaaaactggggaaatctgaataagatcagtggattacatcaatgtgagtaacctgatttaatattgtactgcagctttacaagatgatactactgggggaaatggtacctggtgacctccttggactatttcttactattgcatggcaacctattgttatctcaaaataacaagtttaatttaaaaatattggtagccatggaaaataaaggtggtcttgacctatgaaagaacaatttaaatgacatggtagaggcagaagccaagagttaagaaataaatgcagatgaggggttatatagactgaacttagacagctgttttaggaattttatgtaagagtataagaatgagacttgccaatagttagagagagctgtgtgtgcatgtaaaagttgttgttattgctgatttggaatgagtatgtcttctaatgcattttttaagggtgaatgagacttgactagcattacaatatgtaaggaggcagctaggaaaagaggaagagacagggaggaggaggaagggagggaggcagataaattataaagaggaatcaagatatcataggaagtgggattgaaaacactagggaaatggaacattcttttcttttatacaggaagaataagtcagcaaataaataccaaacaggtgccagctatacactggacttccttctaggagttaattaagcactgtggttttgattgaataatacagatcaaattcctctgtcccgtgagaaaatgagacagttctgtaggtacatttactgctggaatcagaagagctgtaaggatgtataggcatgttactgtaaatagatgaggagacactagatcatgaaaaagagacaagattatcaagctgagtgtaaaaattgctaattagtagtgactctcatatctggatttttgtttggttttccccagcaagtaatagagaagtggaagacaaatcattctctgaccctagagttcggtgaccccagagccatataggtatgtgacaggttggaaactggcttctcaaaatatattgataacctaatctctggaacctaccttacaagtcccccctgccccacaaccccccccccccacacaaaaaagaaatgaaaacaaaaaaaatttcaggtataattagtttaaggatctctataaggagagattatcctggattatccaagtgggccttttaggctatcccaattgtccttacaggagagaggcagagagatgtgacatacatacagaggaggaagggatatgatgatggaccagagagacatttgaagatgttgaccttgaaaattacagtggtgcagccacaagccaaggaatggtgacagctgccagaagaggaaggaaaagattctcccccagaatttctcaagggagcatggccctgctaacaccttgattttggctcagtgatattaatttcagactttcgacctctagacagtaagagagtaaatttttgttgttttaagcctttcagtttgtagtatgttgctacagctgcattaggaaactaatacatgcatgattgtaggacatggataaggaagtagggatgttcaagggtatttcaggaaatcaaccatatagtgcagattagtatggaacttgtgagactaagaagggctggtgatcccaaaggtcttgcttgcagaatcaatgagcagaatgtagtgagattgagggcttaagacagttgaatggatataaggttgtggtcaaaagggtgagaccatcatttaggatgtcaggaattaagtagtttcaggtaataataaagtccaagtgatatccatcagagtgaaaagtggaatggaaaagaaaataatggcatttaaagagtcaaaaaacactgaagctcaggtgagtggctggtaggcaggtcaactccatggatattactgtcaagccaatgaacaaagattttaaagtcagcgatcaaagtctggaatgagtatgatacagaaactctcccagtaataacatgagacgccctgattctggttctctgtgactcagctctgttagacaattttcttacttcaggaactgccaataccccatttaacatgatgctggtgaggcttttaatcccatttccatgggccacagggctaggtcaaatgatgcaggcttttccaggaacagttctccatcccccaggccaaaatgattggttcagtgtcatgtgactaaaactagttcctgccttgctggagttattagcacggagaaaaggtgagtaaaagagacagcatcctgatacactgttggagccttgatccagccatgcctgatgctgtaagtattcctatcttagatatgtgagtcaataaacctttaacttaagatactttgaatgggtttttgttacatgtactcaaaaatatcctaatttataccagaatagtattattttcttgctctttgttctttacagggtggctacaaaggaatcaatgtagcctcgtagtttctctggatggtatttcagtgctttgggagataaccaccacataaatgagagagttcctatttttctttgttattgttttactatctaaccccagctacaagaaaggatatattggtttattttacaaactttatcttcacaatcagaaggatgtgagctgtagagcattattttaaagaccagtcggaagatgaaatggtgcaaaaaataaaaaaagaagaaaaccaaattaatctgcaaacacattagaattttcaagatttaatttcactgttatttttgcccatttgaagcaaatctattcactagatctctattaaatccctactgtaagccaggtacaaataaatgagatgaacaatttgaactgatttcaagttgcaaagtaacaattatatgatgaatttctttgagaagcaaatgttggtatatcagtccattttcccgctgctgataaagacatacccaagactgggaagaaaaagaggtttaattggacgtacagttccacatggctggggaggcctcagaatcatggcaggaggcagaaggcacttcttacatggtggcagcaagagaaaatgaggaagatgaaagaatgaaacctgataaaaccatcagatctcatgagacttattcgctaccacaagaacagtatggggaaaaccaccccatgattcaaattatctcccattgggtccctcctacaacatgtgcaaattatgggagtataattcaagatgagatttgggtggggacacagagccaaaccatatcattcaatccctggcccctccaaatctcatgtcctcacatttcaaaaccaatcatgccttcctaacagtcccccaaagttttaattcatttcagaattaatccgaaagtccacagtccaaagtctcatctgaggaaaggcaagtcccttctgcctatgagcctgtaaaatcacaagcaagctagttacttcctagatacaatgggagtacaggtattaggtaaatatagccattccaaatgggagaaattggccaaaacaaaggggtcacagggcccttgcaagtccaaaatccagcagggcagtcaaattttaaagctccaaaatgatgtccttttattccaggtgtcacatccaggtcatgctgatgcaagaggtgggtttccatggtcttgggaagctctgcccctgtggctttgcagggtacagcctctctccaggctgctttcacaggctggcactgagtgtctgcagcctttccaggtacatggtgccagctgtaggtggatctacctacagctggggtctggaggatggtggccctcttctcacagctccactaagtggtgtcccagtagggactctgtgtaggggctccaaccccacatatcccttctgcactgccctagtagatgttctccatgagagccctgcctctgcagcaaacttctgcctggacatccaggcatttccatacatcttctgaaatctagacagaggttcccaaacccaaattcttgtcttctgtgcaggctcaacaccacatggaagctgccagggcttagggcttgcaccctctgaagccttggcccaagctctacattggccctttcagccacagctggagcagctgggatgcagggcaccaagtccctagactacacacagcatggggaccctgggctcttcccaacgaaaccatttttttcctcctatacctctgagtctgtgatgggagaggctgctgcaaaggtctctgacacaccctggagacactttccccattgtcttgggaattaacattcagctcctcattacttatgcaaatatatgcagctgacttgaatttctgctcagaaaatgggattttctttcctacagcattgtcaggctgcaaattttccaaacttttatgctctgcttcccttttaaaatggaatgcttttaacagcacccaagtcacctcttgaatgcattgcttcttagaaatttcttctgccagataccctaaatcatctctctcaagctcaaagttccacaaatctctgcagcagaagcaaaatgccacaagtctctttgttaaaacataacaagagtcacctttgctctagttcccaacaagttcctcatctccttctgagaacacctcagactggaccttattgtccatatcactattagcattttgggcaaagccattcaacaagtctctagggatctccaaacttttccacattttcctgtcatcttctgagccctccaagctgttccaacctctgcctgttacccagttcctacgtcacttccacattttcaggtatcttttcagcaacatcccacttctggtaccaatttactgtattagtcagttttcacactactgataaagacatacctgagactgggaagaaaaagaggtttagttggacttaacagttccacatggctggggaggcctcagaatcatggtgggaggtgaaagtcacttcttacatggcagcagcaagagaaaatgaggaagatgcaaaagtagaaacccctgataaaactgtcagatcttgtgagacttattcactaccatgagaactatatggggaaccacacccattatttaaattagctcccactgggtcgctcccacaacacatggaaattatcggagtacaattcaagatgagatttgggtggagacacagagccatagaatatcagttggtaacacactgaactagggctctaccattaagtaagcacacagaaatacaaagttcaaataaggataaacagggaatataaaaactattctgcttaataggaattcagatacctcttaattttttatattatctagtaattaagagtgagtgatattattgggaaaccataaaggatccatttcatcagcactgttttttgtttggttggttggttgttttgagcccttacatatatctggcactgggtaggctctgagaatacaatggaaaaatggcaggcctggttcctgcccctaccctttggttcctgtcagggtattctctgaggcatcacagggtttatccagttcactatttagtaaatgataaaactcacattcaaacactagtgtcctaaaacaatataagtctgtctctcctaaatgagctcattatttttgttttagccacctgagagtagagtttctaattcctatctagcttgctgttcaaataactgataattaatcccagaacattagtttgcttgaattgaaaaggcacatcacgttcaagtgcctcgtttttaatataaggcaaactgaggcaaagaatgttaaatgttcttcacagaacaagaggagaggccacttttcaccctcagcctagtgtttatctgactaaaccacaccgtgaaagataacagtctatgaagacaaaaattacaaggtttagaatcctctttccttctccctcagacaactgggaaataatattctttaataaagttgtggttattggactagcacagtagccaaatttaggatgacttatttattcttaaaggttgggactttcattctggaagtacttttaactgttaaagattcctctttccctttccttcttctttccttgcctccctcatttttcctacattccctccttttttttcttgtattatttcattacacaaatgatcatttattccatacaaagttatggaatgtgtagggtgggtatgctggatgcaagggatataaaattggcacagcatctttcttgctgtcagttggctcacaatcgagtggaaagcaaagatgcattcagtgaatcattacaaaacactgtgatgtgtgcattacggttcatcacagaaggagttttggacccttactgggaagaggagaattaagagctgggtgactgcgaaagatttgcaggggagaaaatggctggagagattttgaaataagggaagggcattcccccattccagcatgcagaactaccacttgcaaaggcaaatacgattttctgcagatcctcccctaaccccaccccagaaactggggatatatatcattgggaagagatacagtttaatagagaggaaacactgttggaccactctcccaacacctgtttctcaaatgtgaggcagggctagccaagcatcccacatcaagagaagattaggatgggggaagaggtagaagtcaggcaggaagaatgtgaaagacaagtaccagtctatgaggctggactggtaggtaggaccaatacttaattttctaaatgcatgccactttccctacagatcaatgactgctagcacttccctacttgcttttctttggatttttttttctttttttttttttttgctactgcatgcttctttgactactgctgccaaccttgggaatggattgatgacccacttgcttctcaaacagctctgcagataccacttaggaagctggtgttcgtgttctcagactgaggaggagcagtgtccaaaatcaattacctgggatggtgtgtgctgatccacctagcaatgaactcagatctttggagcttgtttataacacgtacattgctcaacataccctggttctaagatcagtgatgctatttcagagcacaatggggataatacattttacatttatttaatgtgaattttggaaaaatttgattaaaaatgccacctttggcttttttaaataaagaaaatcacaataaaggatagaaagtaattaatgatttttaaaactggttaaccatatacaaaaatcaactcaagatgtattaaagactgacattgtaagtccccaatctataaaactcctaagaccttggtggaaggatctccatttcttggtgggaatgtaacttggtgcagccactgtggagagcaacatggagatttctcaaaggactaaaaatagaattacaatttgacccaggaataccattactgggtatatacccagaggaaaataaattgttctactaaaaagacacatgcactcatacgtttatcacagcactattcacaatagcaaagacgtggaatcaacctaggtacccatcaatggtgaattgggtaaagaaaatgtacatatacagcatgcaatattcacagccataaaaaggaatggaatcatatcctttgcagcaacgtggatgcagctggaggacattaccctacgtaaactcacacaggaacagaaaaccaaatactgcatgtactcacttatacatgagagttaaggcttgggaacacatggacataaagatgagaacaagagacactaggaactccaaaagaaggagggagaaaagaggacaaggactgaaagactttctattgggtactatgctcagtgtctaggtgttgggatcaatagaagcctaaacctcagcaacacgcaattatacccttgcaacaaacctgcacatgtaccccctgaatctaaaataaaaataaaagccaaagaggcaagttattttagtgattttaaattttctttattatagtcttctatatttttccatatttctataatgagcatagtgttgtagttagcaatagatggaaactttatcagaaaaagaagaaaatcatcacaaccatcaacaaacttacctgggtaatttctgtcctgttctcttacgaaagttgcaaaaataaaaaagacaatttcttgctcatttagaatgtacactgtgctttataatacatatggccactaccaatttcttgcaagtgttttttttagactctgggaatatagtggatgggttgagagaaaaggtaccatttgttaaagagaaaacagtattagactagaaattggggtaggatacagttctttatctttatcaatgatatagccttgaacaactcccttaacatcatagcatgtgttttgttaacgtaagacgggcccgataaagtatctcccatctgccagacaggatgactggaaagaagtataaatattttgtaagctgtaaggtgctctatctatgtaagttgtttttgaggcgattattcttagtaataaataaaatactgcttagaaactcaacgtggacagtcttggtctagggacctacttattgtgcaattggcaaaggggcccttctgagatgatgcataggcagacagtttagatacaaataactagaaatggtcaaactgtaatatctgtcctttcccaccttttacatctcaaaaagcagttttcatgtttcatagtaataagggcttttacatctataaattccctttcaaacgcctacatctctcaacaaatttgctaccaccgcaatttattttttaggtggttttattcagatgaaaatagtttatttgagcactttggagttgctgtttgagaatgctatatgagtattaaatactgtattatatttctgatgctctttaaagattttcttttctgtctgcaatttaattttgtttttagaggttttttctcctcctcttctcatattgattttatttttggcgctattaaaaagtgctcaatgaacaacctttttggaatgaatgtaaataagtctgtatctctatgtatatgaatatttttaagtgcattaacttttagtataagacttatgtaatgattaatttgctcctcaaattctaattcttattcaatcaataaccattgttcacaattttaaatacattttattgatttttgaacatttaggtcattagtagtaagatcaatgttagccataattcacctttaaatttccaatgttcaggttattaaaaatcatttgcttttatttccagcataatttatttttaattgaaattcttccttgtgataatttttctttttaaagcaaccatgtcttctttataactgtctgagtgtccaattacattttcttacttatgaaggtttttaatatctaatcatatcttatgtaatcagtgggctattgtgtaaagtaatagttctttttctcccttatttatagggattttactacacacttccttcctccctatttttttctttcctgaacacctttcacctggtattgtgatagttcatttacttgtatgtattgctcactagatggtaaactctgcggggaaaggaatttttttgcatgtcatgttcgctacatcattcctgcatttagcatatgcctaacaaatagtagtctagcaagtattttaaatggattaattaaggaactctaaactacaagacaccaaggaacagatgttcagataaatacataaagatataatctacatgacaatgaaaaggttatgttaaaagtaaaaccctgaagtgcattagaataaatatttaaaaatactatccaggacatataacagttgctatttttctatttaatgaggtatattttggatcccagtcagcaaacaactctctctaccaaaagtagctgactatagcccagcctgtctttgcagttcatggcagaagaagagcagagaacacacagggctcaggtccagagttagctcagagaaaacagaaaatccaatctcagcacagtaaacatgtaggaattcagcatctcatagaggttactgaaagcaaagaatcaaaaataataaatggttataaatagtccatgctctcagagaactttgagtgcataaacaaaacctataaatcttcagcaaatgaaaataaggctctggttaataaaacaaaacaaaacagaaatggcctagtgtaattgttaagaagaggagaaaaacataccccaaagaattcagtatgtagttggtgaattcagagcaaacaaaaatggaaaattacaccttctcagccacacaaaagaaaagacttctaaggatttaaattaagagtatcacagtgaggaggaaggaggagttgattattgggcaaaatattttgcctctatcaaggcttgagctcatgagtaaaaggtgtgcgaggcctccttccatagtgtgcattcagtccttctcaaagaatccattcatttccacattaaattctcaagtaaagaaatcaatcaaacaaaaaaactcccacatgtgttattatagtttctacctggactatgtggacatgtcctgtctgtctatagcagttgcaatgctattgcccagagtggaaaaaaagaaaaagaaaaggagcttcccataaggtttatttctacatgttaaaaactctattgctaaaaccctaccacactagcttaggaatcacatttttagtaaatgtcaccaacattttaaaaatttggggccatttttatcctctaagaaatctcgaagagatccagaattcatgtatttaaaatttgtctcatataacaaataaaagaaaaataaagacaatgaacagcttcacagacaaaaaaagaaagatactccaggtaaagccaaaacaatacaactttctaaaaataatatagaaaaacagctttatgacttgaaaataacactagccattagttattagtattagattgcaaaaatagctacaaatgtctctccttcctgaatctatgcccttgggcagtccacttccatatctatgctgggcttggccctgtgcctgtctttgaccaatcacaaattgctgcaatcaaaggcctcgaaagcactaggtcattgaggtttgccctcttttgctgctctcaggacatcatcttaccactgccatatgaaaaagcacaggttagttttcctggctgccaacctgccaactattagatatttatgagacatcatcctagatcatccaggctccagctgatgtagctcagatattagctgagccatcaaaagcagaactgtaaatcatgagctgaatcaatgtttgttgtatttagttcctatatatgggaagggtttgttatacagcaaaagctaactttgtagaaattggtacctagaaacggggtgctattataactaaacttaaaacacagtcatgtatcacttaatgatggagatactttctgagaaataggtcattaggtgacttccattttgtgcaaatataagaaagtatacttacacaaacctagatggtacaccctagtacacatctaggctatatggtataaacttttgcttctagactgcaaacttgtactgcatgtaactgtaactgaacactataggtagttgtcacaaaatggtaagtatttgtgtatttatacgtatctaaacataggaaaagtacaataaaaatgtgatataaacaataaaaaatggtatccttgcacttaccatgaatgggaattgctctgggtgaatcaacaaatgaatagtgagtgaatgtgaaggcctaggacattgctgtacactactgtagaatttataagtaggctaccctaaatttatttaaaaaatatatatcttcaataacaaatttaactttaggttactgtgacttttcaaactttacaaacattttaatttttaaaagcatttaaactcttgtaataacacagcttaaaacacattgtacagttgtacaaaaatattttctttcctcaattttataagctttcttaatttttaattttttttttttactttttaaacttttttgttaaaaaccataacataaacaccctcattggcctaggcctacacagaatcaggatccctattatgactgtcttccacttccacatcttgtcccactggaagaccttctagggaaataacttattcaaaagaagttgacaaagccataagaaaactgatttagctggctggaaaaagggaaaaatggtcacctgcagtaagttggagaatagacaacatgtcaaatgaacctacagaccttgacaagttggtttgtaggcagaattttccaagtgccatttggattattttgttgcctaagataaaggaagaaaagagagagagagagattagccaaagaaagatggcttattttgcaagtagaattcagaaagaataaggagggacaagaacttgctaggttggaaaataaatctattgctcatccccaatcttctgtttctaaaatattctaaaataaagtatgttctggggccagatgaaaagacatgttacatatacaaggcaaactataaagatgacagtagttttttcatcataaataatgcaagttagaagacaatagaacaaaatctttccaaatactgaaagaataaaaatatcaaactaaaattccttatccagtaaagatatatttcaaaaacaaagacaaaatagacatttttagatgtcaacagctgaaagacataacttactacaagaaatgttgaaaaaagtcattcaagcagcagaaaactgatgtcagtagaagcctagttctacacaaagaatgaagagcaatgaaagtagtaatcacatgagtaaataaaatatttgtctttattatttaaatatccttaagagataaccaattatttaaagcaaaaataatgatgatttgagtttttatcatatataaacataaaatgtatgaaaccaatcatacaaaaaccaggaacaaagaaatggaagtacactcttgtaagatattttttttgcacatgaagaaatataatatcatttaatgacagactgtgaaaagttaaagatgtttgctataaaccctaaagcaaacgctaaaataaaacaatcaaactttataattaatgtgatgcttaagtttatatgttaagtttatatgttaacttggctgggacataatatctagatatttggtcatactctattctagctgttctctgaaggtattcttgaatgggattaacatctaaatctttgagtaaagtagactgccttccataatatgagagttcatccaatcaattgaaagccttaagaaacagattgacctctcctgagagagaagaaattctgccataaactgtctttggatgtgaaccacaacaattgccaccccaccagtctaccctgcccatattggacctactaacctcacagacatgtaaatcagttccttaaaataaacttctatatatacatctatacacgttattgattgtttctctggagaaggctgactaatactactaataaaaatcaagatagaggctgggtgcaatggctcacgcctataatcccagcactttgagaagctgaggcaggcggatcatctgaagtcaggagtttgagaccagcctggccaacatggtgaaactctgtctctactaaaaatacaaaaattagctgagtgtggtggagggcacctgtaatcccagctacttgggaggctgaggcaggagaattgcttgaacccgggggcagaggttgcagtgaaccgagattgcactccagcctgggcaacagaacgagactccatctcaaaaaaacaaaaacaaaacaaaacccaaagcaaacaacaacaacaaaaacaaatagcaatgcaacatatgtaaacccaaccatatcaataattatctcatatgccaatgggataaatgccacaaataaaaggcaatgattgtcagactgataaaaagcaagagctaattatatgctaccaacctactttaaatatagagataaaaatatgttaaaaggctgaaaacattaaaccactctgtgttagtcaaaagacagttgaagtggcaaacattagacaaaatagatttcaaagcaaaaatattgtccataatgaagatatttcttaataaattcaagagcacagaataatcttaaatatttatagatctaataatatagattaaacatatatgaagcaaaatatgataaaattacaaagagaaatagatgcatcaaaatagagtcagaaatttcaacttccttatcacaatgtttgatagaattttagaaataaattcagtggtttataggacacttgagcagtactatccaccaacttgaatgaaataacccaaatgttgttgaggatgtaaacaaactaaaactttcatgtacatctaatgaaaagaaaaactagtagaagtatctcatagaatagttggcaatatcttaaaaagttaaaaaatataccaaccctgtgatttagacattgaaaatatacacatttacccaggggaaaagatagtaagtatttatacaaaaacctgtacatgaatgttaacagcagcattatttgtaacatctttaaactagaatcgtcctaaatgtccatttacaggtgaatggataaacaaattgttgtatatacctataatggaatagtactcagcaacacaaagaaatgaacaacagtgatacataaaacaacatgaatgaatctcaaaggattaagactaagtgaaacattcatattcttattttataaaattttagaaactgcaaattagtcatgctgagacaatgtagatcaatggctgtctgtgaatgagattggcaaggaagggaactaaggaaagattagaaacacaagggaatatttaacagtgatggatgttttattattttgattgtattgatgatttcatgaatgggtatattcatatgtaaaaactttcaaggtgtatactttaaagatgtgtggtttactgcagcagtccccaacctttgtggcaccagggaccagttttgtggaagacactttttccacggatggggtgggatgcttttgggatgattcaaccacattacatttatggtgtacttgatttctcttattattacattgtaatatataatgaaataattacacaactcaccataatgtagaatcagtgggagccctgagcttgttttcctgcaactagatgatcccatctgagggtgatgggagatagtgacagatcatcaggtactagattctcataaggagcacacaacctagatccctcatgatatggtttggctgtgtccccacccaaatctcatcttgaactgtaactcccacaattcccatgtgttgtgggagggacccagtgggaggtaattgagtcatgggagtgaatctttctcatgttgttctcataatagtgaataagtctcatgagatctgatggttttaaaaagtagatttcccctgcacaaagtctctctctttgcctgttgtcatccatgtaagacgtaacttgctcctccttgccttctgccatgattgtgaggcctccccacccatgtggaagtgtgagcccattaaacctctttttcttcccagtctcgggtatatctttatcagcaatgtgaagatggactgatacacctcacatgagcagttcacagtagggttcatgctcctatgagaatctaatgctgctgctgatttgataggagtcggagctcaggcagtaatgtgagcaattggaagtggctataaatacagctgaagctttgcttgcttgctggccactcacctcctgctgggtggcctggttcccagcaagctgtagaccagtatcagtcagttgtggcccaggagttggggacccctggcttactgtatgttaattatacctcaataaacttaataaaattatgtactctataattccacttatataaaagtaaatacagccaatagtaaactatattgtttatggatgcaaactttggatattgaactgtaaatcaaagcaaagtagggataaccttgaaagttaggatactgaataactctaagatggatggaaagatttatcattgggaataacatctggattctagtgaagttctatttctcgatctctgtgtgggttatgcgatatttgcctaacaaaaaattgtttaagctgcacctgtattcatgttgcataggcatataagtgtggcttagggcattcagagcagtctttacatgatctaacaacacaacactgacctgcacattctctaagtgggacatctgagtttcatttctttgaaatgttctttaaaatttttgagaaaaaggtgttaacaattctgccacaaagattaagactggatttggttaatcttcaggaaagcagaaacttgtttgtaactacttgaaaatccctttctggtatttgagctttgtgggacttttgcagtaatttacagcttgattttaaccgggttgaactttaatttaaccagttgattgtggcaagttatgataaacagcatgaaaaagaaaaaacaatttctttcataactgataatgtacacatgctgaggagaaagtgggactctgaattcttttggtgatcagccattaaatcataaagaagaggtgtcttctttatgggaagatagaatagaagcaagatcttcttaggtatgtgatcctgggcagatgactttattatacttctgtgaaatggtgcctcagcaaccacttatattttggctgtgaaaatcaagtggctataaatgtattaaaatacatccgaagcctatagccctaaataatgtagcaactctcaagttgcttttattaatatcagttttcatagttttcattctaatttgtcatagttttcattctaatttgtttgctgatttcttatcattattctcagtaatgcagtctttctctgaatcatagttagtattcttgacccagtgactcaagtcagcatgtctaatttcttaaatctgaattgtctgcaagatttcatcttgattctatcttttgggttgcgctcaagccagtgtaccaatttcacaatatctgctaattggtacattgttgcctaccatctttaaaatagcctgctctataactctagtttttttaaggaaatcaaaacaatgccattattataaaagttaatgacatagcaataacagatctattgtcacagtgcttatccactgcaagtgtccaatatatcttactaatttttcagagtttagtatttccactgttgaagttctttttatttttcataagatggttcacaatggacacagggctcaacattacagaagaaattgtatcagtctttaacatcttatccataaataatggcattgtaaatacacacacacacgtcaattataattgatataccctcatgcaaaagcattattaaaatctacaatattgatataataataccacctacatcattgagttctgaaaattcaatgagtgcatacatgcagaaagtttaaaataaagactaggaaaatgtgtcggatgttttcttctttgatcttaaagacagagataaaatgtacatattttcttagtcgaaatctaacttagtatatatctattaagttaatatttactctgactctcaaacattctgaatctcttagtggccaatcacttgtctaatgccacccagttggaaggagctaaaattgcttttttgttttttatttgcttgtttgttttttgagacagggtctcactctgttgcccgggctggagtgcgctggtgtgatcacagaactggtttttaaccacgttttgggtaataatacttcacaagaatgctggatgattaaatgaagtagtgtgtgtaatgtgttggctcattggacagaacactgggtgctgagggatcatataggagtctgactctgcctaactcttcaccttgtttaataataacactctggaaagctcatttatctatacatgcctttaaaagcagacaaagcatttttattgcttttttttttttttttaccacttccatggcctaaaagaatcacttttgttttgaagactctaatttgcagagtaaacaaaaaagatggaaataactaagaaataaaacctccaaaagtttaggaccccaaataaaaatcatttgaaatgcataaaaatgcataaaataggtacaatgaatagtaatagatggaaaaaaacagattccatcataggtttgttacttgaatactaaactttttcaataattagctgttataatatccgtgttcaaaaacacagcactcagtgcagatcaaaattctaaaataaacaacagttactttccattttctcttgagtaagttatgagattacctctattgctctaatctagaagatatgaaaacaggccctccggccctaactgactctgtgttgtgtaataatatttcccttcaccaacctttacaatgaatataaaaattcaatttcagacctacaagctagaaagggctcaagtgtcaccagacttttctaaggggatattttctgtttttgtctacatttatatttgactcatttagtggagggaggtaataggatttttctatctgctatagaagctatttcagaagtacacagatataaggtcagaaaatatattttaaaatcacaaaagaaaacaaaatgatatgttggttttgaaccctagggtctttcaacattataatcaagcatgcctgagaatatctagctgtgacttcagagagaataatagtacacccttgagtctactgcaacagtcttccatggtatggtaggaaaagaatcctaggatagctcccaagacttacaagatacacacctcctggtgtgtatgccctgcataatctctgggaatgtgaatttaatggattttcctctgcgattaagtaaagctatgtacactatacagttgatcttaagacagagaatttatccaggtgggtgcgacttaatcacatgagacctttaaaagtagagcattttatctggctgactgaagaagaggaaaccagaaacggaaagcaggaaaagaatttgcatcactcttgttggtttaaaggtagaggggatagagagcaaggaaagtgtgcagtactccaggagctaagagcagtccctggctgtgggtcggcagggaattaggaaactcagtaatatagccacagtcaactgaaatttgccaggaagaatgatcttagacgtggattttcctccaaagtctgcagaaaagaactcagctttgcctatacctggattttggttttgcagtttctttggaagataacacagtgatggtgtgctggacttgacctacacaattgttagctagtaaatcagtgtttttagcctctaagttggtgataatttgctacgcagcaatagaaaacaaattcacatggcttggatcctacccaaatagtttttattatttcattaattcatttgttcatctctatatttatttctgaacacattcattaagtgcctatcatgtcccttctctaatcgttatgacgagtttttaacatacaagacaattttatgaccctcaccttaaagactatgttatcaggatactggaatgtaacattatttactgttcctaaacattatcaaatacacatactgcagatactctgaaagttgtgaaagctttaaataattcagtatgcagttttgtggctcatatagaaagcttgatgggccttgtgaaaagctgtaggcattgcccatgtctaaaggataaaagcggtagatgacagtactccatgtaattattttggctgtctcacaggcttattgaaatttccttggagtgacatcaacaagatggctatctagaagctcctagcatccttctttctaccacacacacacacacagacacacacatacacacacacacacagacacacaaaaaagctatgaataatcaagtactttttgaccaaaataactaaaggagagctctagagaatagcaaagaagcagcagaaatcctgtagagcatagaaacccaggatggctgcatagggaagggaaaaagatacctcgcctccgccactccatcccctcagttggaatcagctcagaaccagggaggactcctttctgcagggaaaaataaagacgaccccagcaattctgattgccactgcagacacctgcagcctttgttatcagagactcctacagtcctcacaagctctaaactcaactgagagagctccctagagtcacatgctgagctatattcagagaaggtgacaacactgtgccctggcctcacttctccccactgccccctgtcccctatcctattgcctgtactgctactgcactacaccattttggaaccagagacactactagagtgcatcctgctctgggggtgaaacccattgcaccaccctccattcctgagagtttgctgctattgcaacatgcacactccatagtgtgccatacctgagccaagctgctactgtgccctactccctagggccaatctactatatagctgctccatcctgcccattctagttgctggggcacctccacttaaggccaacatccagtgatggtctgccagcaggggatttcagatattctgcacaccagagctatcaactgcacctcaccttctagcaccacaggtgaggcagcttcctgaacctagagactctaataactctggcataccagactagttgtttgccccagcatcacagctgatacagtgccctgctccccaggcatctggcagccccactaacccacatagccatgctttctggagctgagaagacatagtacctgaagtcccaggaaatcacaggagctgtgccactaccatctccaggacaaagagccacagttcctgcatacctgtaactggactaacctccacccatctgagctggtgagatgtcccacctttccagggaatgaagtcattgctgtgctgctccaccaccctcaatcccaggcccaagccacagtggtgccttgccattcctgagtacttgctgttactgtacccaggctcacagagcctgggcttctgtcatgtcccaccatcccagggtccaaactccacactatgtgctatctcatccctcagatcctgagctgcttctatgtcctgttggttccaggatctgaattgtagctgtgcactgttccgtgaggatttagtctctggaaaatcccttcttctccagagctgcaccagtgctgtaccctgtttcccagggtcagaacatagctatattacagcctcctgggtttaagctgctagagtttgtctcaaagcaatagatcccagctttttgggagaactgcatccacttgtgcctgggaatgtgaacctgtgtctcaagtcccaggtgttacagtaatttcacaggacgccccactgtgggggaagataagaacagaatgattcccaaagttcttgccataataacatacatagccaccattattgccacaaattcctgtagcctagaccaccaaggtaccaaggtatgtcagtcatcactgacactgatcacaattgaagaagctgcatacagactgtatcactgggcccacacagaactacagccactgcactttgcccaaccagtaccctcaggcccaccttcggtgaaagcctacaaaagctactctgtaaagtttggaagaggtaactacacaatcagatgtgcagacatcaatgcaggaacacaagaaacacagaaaacaaggaaacatgacatcaccaaaggagcacaataattctccagtaactgaccccaatgaaatggaaatttacaaattgcctgaagaggaattcataataatattctttattattaacaagacacaagagaatacacataggcgattcaatgaaatcaggaatataattcattatctgaatgagaaattcaacagagagatataataaaaaagaacagaaatcttatagctagtgaatttaatcaataaaataaagtttaaaaatacaatagaaagcttcaatagcagactagagcaaacaaaggaaagattctgtgaacttgaagataggtcatttgtgacttggtctgacttagaggaaacaaaagaaaaaggaatgaaaaagagtgaagatattctttgggacttatgggatatcattaagcaaataaatatttgcattatgagattttcaggacaagagattaaaaaagggacaaaaatgcttatttaataaaatagtggctgacaatttcccattttgggagagatatggacattcagattcacttagctccaaggtccccaaacatatataacccaaagaggttctctcaaaggcacattatagtaaaactgtcaaaacttaaagacaaagaattttaaaagcagcaagagaaaacatcaagtcacatacaagggaatctccattagaatatatcagtagatttctcaacagaaactttgcagacaaggagacaattggatgatatattcaacatgctgaaagaaaaacctttcagctatggctgttatacccggcagagctatccctcagaaataaaagaggcataaaatattatccagacaagcaaaagctaaatccatcaccactagacccatcctaaaagaagtgcttaaggaagtttttcaaaaaaaaaaaaagaaaagaaaaaaggcattataattactgtcataagtatatatgcaactataaaactcactagtggaagaaaatgcatagtcaagttcagaatactccagtactataatggtggtatgtaaattatacatctgcttagtatgaagattaaaagtcaaaatggtcaaaataactacagcactacagctacaataagttgttaagaaatatacaatatgaaaagatgtgtgacatcaaaaacataagttatagggggtggagagtaaaagtctagagtttttgtatgtgatagaagttaagctgttatcagcttaaaatagctgattaaaactataagatgttttatgtaagcctcatggtaactgcaaaacaaaaaacatggcagatatacaaacaataaaaagaaaggaataaaagcttaatactacagaaaattataccacaatgatagacaacaagagaggaagaaaggatcgacagagctacaaaacaactggaaaagaaataataaaatgacagtaagtccttacctctaaatgataacctagaatgtaaatagattcaatcctttaataaaaagatggagtggctgaatggataaagatacaatccaattacatgccgcttgtaagagacccataaaagacacatgtaactaaaagagagcaagagtggctacagttatgtttgataaatcagacttcaattaaaaaaactatcagaagagacaaagaaggtaattatttaatgatatagtggtctgacaatcaagaagacttaaaaattgcatatacatattgcatatatatatgctatatatatgctatatatatgctatatatgctatatatatgctatatatatgctatatatgctatatatatgctatatatatgctatatatatatgctacatatatgctatacatatgctacatatatgctatatatatgctacatatatgctatatatatgctatatatatatgcaatatatatatgcaatatatatatatgcacacacacacacgtctccaacattggaacacctgaatacacaatgtaaatagttataaacctgaagagcaaaatagaaatacaataatagtagggaactttaatactcttttcagtaatgaatagatcaaccagatagaaaataaatgaggatataatggactcaaattgcacttttgaccaaatggaccaaacagacatatacaaaactgtccatctaatagctgcagaatacacaacttttttcacacatggaacattctccaagatagaccatattttaggccacaaaacaaggttttaaaaatttaagaatatcgaaatcatacctagtattgtttcagaccacagtagaaattagtaaccaagggaatcttgaaaaattaacaaaaaacgttgttgtggaaattaaacaacatgcttaaacaacaaatgggttgaagaataaatcaaaagagaaattttaaaaatatcttgaagccgagcgtggtggctcacgcctgtaatccggcagtttgggaggccgaggcgggcggaccacgaggtcaggaggatcaagaccaccctggctaacacagtgaaaccccgtctctactaaaaatacaaaaaatttgccgggcgtggtggcaggcacctgtagtcccagctgctcaggaggctgaggcaggagaatggcgtgaatctgggaggcgtagcatgcagtgagcagagatcgctccactgcactccagcctgggctacagagtgagactctgcctcaaaaaaaaaaaaaaaaaaaaaaaatcttgagataaatgacaatgaaattacaacataccaaaacctatgggatgcagccaaaccatttctaagaggaaaatttattgcaataaatgcctacattaaaaaaagaagaaagatctcaaatagatagtctaacattatacctaaaggaactagaaaaagaagaagctacaccaacgattagcagaaggaaaggaataataaaaatcagaagtgaaataaataaaatagccacgtgcagtggctcacacctattattgcagtgggtcatacctataattctagtactttgggaggctaaggtgggtggaatgccctgagctcaggagttcaagaccagcctggggaacatggcaaaacctcatctttaccaaaaaaaaaaaaaaaaaaaaaaaaaaaaaaaaaaaaattagctgggtgtggtgtcatgtgcctgtagtcccagctacttgggagattgaggttgggaggatcacttgagcctgggaggtggaggctgccgtaagctgagattgtgttgcttcactccagcctgggcaacagagtgggaccctatctcaatgaaagagaaagaaagagagaaagagagggagagagagagagaaagagagagagagagagagagagagaggaaggaaggaaggaaggaaggaaggaaagaaggaaggaaggacggaaaatagagaacagaaaaaccatagaaagaatcgagaatatatttttgaaaacaacaaattcaatatggaggccatttgatttatgagaaaaaggaggaaattctaggaccatgctgaatgggctctgatgttgagtctgccattttctagctgtgtgactctaagcaagttatttaatatctaagccttatctataaactaaggatagtgattacttaattcccaaagtagttgtgatgatcaaatgatataaattcagtaaaatattaaaagtgatggggtaggatagtaactcaagtgtaatagtgatagtgatactaacggtgactaatattagtgagcaaacatgatgttcccaagactgcacaaattattttccatgctttatctctcatttcctatggtaagtgcatcagataggtactgttattttacccattttgcagataaaaaccaaggcacacagtaatccagtaatttgctcatggtcatgtaaataaatttgaacccaatttcttgttagcactctcttctccttataatgttctttttatcccttcagtaaaaataagtaaaaatattaatgtgtatgttttaccacactgctgtactttagcatacagtagacattgtgaacattttaaggtcataggctgaatttccttcatagaaaagaaagattactttctttcatatatatattctatatagctctttttcttctaaaaccacatatctacaaccagcttggaatatccttacctaatatctttgtttctttttctcctccttctcaaaatctttttctctactagctctttcttcattgtttattaaacatttcttgcccttaagaaagcaccttttgttatactctctttctacttgattgggtgtgtattaatcagtacatactaggttgctagtgtcagaaacttaatgtaacttaggaaaagtagaaatgtatttatttacggaataaaacaattaacaagaagagcaggtctatagttggataacggaaacaactggatcaaaatatatgaaagtcatagggaatggaaacctcatctctacctttttctgatactcgatttaattttctctgattgcagaccagcttcctctgtgtggtggtaaatctaactgacacaattctagagcctcataaatgaacagtttcttctaatggcaggagcagagtcgtgattctggttccaaaatttcccaagaagggttctgattggtctgatttgggtctgtatcccacatgcttgctgacaagtaggtagtggtaggtcaggtaaaatccatttagctcctactaaaggcatgaggatggagaatgtaggcaaaaggaagttttcagacatcaggaaaatactaagcagaaaatatcatagatgcttccttttttttttttttttttttttttttttttaaagaggcagggtctttctgtgttgctcagactgctcttgaactcctggagtaaagagatcttcccacctgggattcccaaagtgctagtattacaggaataagccactgcacctttctgccttctcctcttaaagttgctgttccctttaatactcttcttctattgactaaattttgccaagctttgtaactgttctgagaaatttctttgaatattatacttgtcatctgttatctcttcaccagatatttttctgtctttttttcttatatagaatttgaggtttgggttggatatttgaatatagcaatatttgaccatatttatgagaaattacttgaaactttctgctacattcagcatagagaagagttggtttataaagcatctggcttattggagaaattttttccttcagtttctttcccaataaatgccatttctgctaactcttgattagactacaaactgatctctgtaatacacagacaagtcctataaatctgtctttaatggttctcattcaattaaagtcttttcattgcttaaatctttctttcctcagagtagtagaaaaatttcaaactgaacggatttcaatttcatctccttacctggttcaatagtggtattttgaggttggctggctgctcaaaagaaatttttgttcttgaagtcatgtaaatgtactagggtatgtttaatgttgaccatatgagtcagtttttcctaaggcatgctgtgctttgacaatatatagattcaaatcatctactatttcaagaatttgaaatactactatttctgaattatgtttttaaataataattctgttccattatttctagtttcctttgggggggctttctttaatatattctttgcctgttctacattttaattactttttccgtctaataactttttaaaaatgagtttctttattgtcactttgttttgttgccttttaagtcctctatgcaccttgctgtatttttccttccttatatgtcttctaattttgcctttaccttttttgagttttatttcttttacttttatttcctgagatctgctagtttccatttcatgcatattgctgtttcaccatctctcttgtgtgcttttttatttctgtactatgttcttgctttacagaggcaactacttcaatgcattttactcatttgttttaaaatttatcacaaaatatttgaccatagttttcatctattttgttgcaacttgttttcttttcaggatactttgccatttgaccttcttatttttttttaatttattttccattatattattatatagatcctgttcttccttgcttcttgttttactgcttattatcaaaggacatgaattttccccactagctatttgtaagcagtttatatagggtgggttgggaggtaaaacagaaccatgcttagggctaaaaattactcaatatgaactaaaaatctgaaaaacctgaaaatactcactataagaaaacaatttcaaaagatattaaatatctgtaaaaagttttcaaagatatctggtttggtgagttagtgtttccaattatgttagtaagcagcagaactgggttttgaaacaaggggtatggatgtggattctgcaatgtttacccaggtataagaccaaatgaaactagcaagttaaacataaacaaaatgacagagccaattgatatccaactagtaacattcatttaatctgataaattctgctgttttgctgaaatgaaattgcccttcataaggtgaatatagatgagaattctgctccatatggaataaactcacatcattgtgagtttatatggttctgtcatcactgtgggctgtgtgctgagttaattctctcaccattttttaaacaactgtgaaaccttcctttgtagagttgcctttatgacatttatgacatttggccaagtcatttagaccaagtatgtcatttacacttatactttggtcatttagaccaaatatgtcatttacacgtaatgttagtcttctttattttctcattagctcatgtcagtataaatggaactacttgacaccaacataaacattagtgcaaagacaagtgtgaagaccctgtaatcacatggcacttttcagaaatatgaggtcatccagtgattctacaagaggggttggcaaactgcagcttgtaggccacatccagtttacccctatttccataagacccatgagttgagaatagtttttacaattttaattgttaaaaaaaaagaatatgcctcagagacatgtgtacttctcaaagtctaaaatacttagtatctggccctttaaaagaaaaaggctgctgatccctgtcctagaatatacttatgtcatttttaaaaatggttattatgagatgaaagcacaaaatgaaaagcatcttttagaaagcttcaggatacttgggaatactttttcagaaagcagggaagaaaacacatttctacctactgaaaaatgtgctcagtaactcatccccaatatttgtgagttaaaagcacaaacagaccattacgtgggagaggcacaacaattcttggcactaagattaaatagaaatcactcccaggattgtcataaagaagacactatggaagataacgatgtcttcactggcgcacctacagtacatctaacaagtttcacagggcccttttaaaagacaatttaaaatatagcctgatgacaacattcctaaaaacaatgtagtgaaggcagttttagagaacttgagagtatgggtcagagattttcatttctattaatctgactccatgcaaggctagattgtagactctggacatatgaagaaactggaaacccttaggacaaatctcttttttggtaaaactgttgaatatatgagtagataccctgctacacaactaaaggtcagcttttctatgttgccagctgaattcatcatacccatttcacattatcattacagaagagcgtgacaatgcaaaattctggagataagatcaaacatatgaataacaacatttaaggatgccatgaaggctatttgagacaggtcctctgtccatgtgatgcaaaaatgacagaggacacatcagacataatttgtcacaacccaatgacattcatgtcagtaggtgctgagatgtaatctgtcatgttttagttagaggaaactgtatgtagctcttttgatggattgataagtagattcatccatccttatactttgaaagaacataattattcataattatttgcatgtagttatttataaacacaaccctttacattttatcagtaaatgtcaagagttgcctcactcggtgcactttatgctagtttagctaatttgcttaaattgggatgcccagagcccaagtatatcctcttgtgtcctgggaaacccacccttgccctttgttaaaggagtagcagttccatacgctggatggattgaggaatttcccattattgattaaaggtcaactatactctgggttctattaaataggtacacatgaaattaattaagatgaactagttaagacaggttcaccatttggagccactctcccccatctccacctcatcatgcaaatcttttttatggaagctctattcagcttagatatttaaatcagctctcagtaacttatctaccataaccgtttacttagttgtcctctctcactctcagcaaaatcaatgagctaaaaagattaggaaccatcattctttgtatttccagcacccagcccagtgatggtgtgaggacacatctgttactccacaccttctattctcagcacaccttaagctaaaacaacttgtgtttctggcacagctatcggagactttcagaggtgacaaactcatgctcatttatttagttgcctaatttctccagtgtcagtaataatctatattcttagcaaatcattgggaattggaaaccactctgacagattaaggccaggaaattttttaaagaagaaatgcaagaactggaaattacatatgtgaccttgtgccattcagcctgtgaatggtgtgtgggcttaaaaggttgttagggttgggatggtagaatatgtagagcttttggagaatgttttttgttactgttgtttgacctacttcattcccttcagactccgagaggtcataacacacgatataaagtgcaaggttaataatggagaatgtcgcattcaggagtttctctgcctagatgtggaattctggcttataggctatttctttctgtgtgtctctttctcttcactcttgaaataagttaagaaattctcaacgactggaatatatgttttccaccttttctggccatcaactgcgttatcaggatgaatgtcaattactgtcattctggaagtcatagggtgcattatcctgttttcctattataggggtatttgagtaataaacttactctcttgtaatatcatataaaattttattttaactgacatctaaaagcacgaaacctcttaaagtttggcttgccccatggaggtgaatgcagctgcagctcatctcaggagtctgcccttatatgaactgcttgttcttacctttctactcctcagcatgttgaaactcagaccacactcctaaatgagacatccaaaggctccggcctgctggagtgctgacaagcatgctgtttagggcaggtactcagaggcaaagtcagagaaacatgatctcttcagcagcacgtttttgcacatgaaacctgtgtaaactcagcatgactcactcaggccaaggtgagcactctgatgtctgtgaacgactgcagcaacttggcaactggggccagtgtgcttccctgtagcactcagcagagacagttcaggacttgaaacaattttcctcattgctgttgtcactggagaacaaaaactgcaaaagcgagccattgttcacactgaaagtcattttgtggagaaaatgagaggcttggaccagtctttttgtcctttattgtatcgtcccctctggcatccatttatgggtctgatttcatttctattttcattttgagacttttctctatgacctcaggtcagagacaatatcaaaggcaatatgttttagtgggtttatttgtctgagtcaacagaaaaagagagagggaagggaaatggaagagtacagggcaggggggaggaaggggggagagagagagagagacagagagagaccaactgagactaaagctatgtctgtatgaaaagatgactatagttggatctggaattctgaatttgcaactaacactgatgccatttacaatgtaacaatcagctttagtcttccatgtgaatgtagatattatatcatcatctcataacattttattccatatacatggtcaccaagatgaacagaaagagttagatctgggtggtgagaactgggagaaaaccagccatgagaataagatggattgtcttttgtcacagaaatagcaaatttttaagtgtatttgaaatgataaatacttttttttaaccttttgtaacatttcacaaaacttttaaatcaaatttcaactggaactttggtctgctttccttaaatgcagctgatttcttgctaaattccattgcatttgatgccttcagggatttgggaagttagcgtactgggacagaggcattgatgatacatatgacgtggacaaaggaaatgaactcagcatatgtgggaagtatagcaagtgttcacttgtggccagtgtcaccaaaaatgccaccaaggtaactcaacatagtcaaagtaatgaggcagaattgttcttcagttaacttgttaatagggaaactttttataagcctaactggtctagtgatatttggtccagttctcaaacctatcttagaggcttccctgtctcatttccatagggaaaaaactccctatccaattattaaatggataaataagtgcttaaaacgtgaaaaatagggaaattcatgctatttgaactagtttttgcttaagtatgatatggccatggcaccaaacttcagtgtgtatttaggatcaccttagatgcatgttgaaactatacacatacagcctaagctaatcctaatgaacctgcttaagttggtcttgagtgtggcctaggaatttcattgtaaacaagtatcccagatgattctgatgcacatagatgcattctgatgtgtgtgtgcatgtgtgtgtgtgtgtgtgtgtgtgcgcgcgcgcacgcgtgcacgccagaggggagataagggaaagatttcaagttaaaaatgggtttgggttactttgtgaaagaagttgaatggcatgctaaggagtttgtgtttttaaataaagaacaaacgtgatcatatctgtactttgagaagtataactctggtgacaggacggtttgaagagggaggggagaggagtcaagaagactagttaagaagtttttcaaaagatgagcacttccgccaaattcttcatcacacattgtacaggtaataaataagacatggttcctttcatgaagttgcttatgatcttgtaggaaaagattcaatgaatgaggcagagatggagaagtcagagaagtggcttggatgggcaggttggggctggacagattttgcagagctttaagaagcaaaggaagagcagattcccagaaaagaatataccctaagagacaggccactaaattaaatgacagtttgatggtgccacttttttcccccactggggtgtctggactctacagacttacataaatgagcagtgagaaaatgtaagtacagattattgattacttttggggacatgtttgcgtaaagaaagacagagctaaaatagcagcttgaagatatcaaaggctaaggaaaggcaatttttgtgttgttttgcttttgttgtgagtctgttgttctttataggggagattggaatatatttccaggaaaaagggaaagaaaatccaaaacctagagaagtgaatgttggtggggcaaagagaaagagagcaggaatgagaccaggagggcaggtgaggtgaagaattcggtattgggaaggaagagaccagaaagctgaagaggatggatggctacacgatacctttgagactgggaggaagcagcaggagaaagagataaagaacaatgagagatatgagttagacactgggatatgagttagacactagtcacatttcaccaagggaagagtccaagcttaaacatatttttcatgtcgcaatatgcttagggaaagctggcccctttccgaatcccggaggatgaacacgtgattgatctaaacacggcatagctatcccattctcttctattggagttcggtttggggatgggcaagtgaccaactttaggccaaatattaaggagatttcttctgagggtacttctgggaagtatttgcttcatgatatatacatttcctcccttgaacttgatagtataaaggcataatgcttgggatgagggaaccatcttggaaccatgaggtgcaaacttaaggacctaagttaaatactaaggataggggaggagaagaaatctgagtctaatgataaccttgagacagtgtggtatctctgggactgcgtacctccaatttcttgtttgtgtgtgagtgtgtgtgtgtgtgtgtgtaatcaaacaataaagaatatatgtatgttctttcttgtttaaatcacaactattttaattttgtgatatttctgttaaaagtatatgtaagtgatgttggaaaaattggtctccatctttttattaaagaggtagtcatgtgcccagaaggatggaggcccacctgtgatttagggttgggatgtgtggaaaatacctgaagctaccattgaagatactgagaatggcaggaagctaatgaaataaatcaaagaaaggcagcataaacagacctcaaataaagtaggactggatgtggacagaatgactttgcaacattgccaaacctcaacaaaggggcaaaaaaggatagagtccttgttgaggagggtttaaaattggataccagaacacagcatcaacccaaagtcaaaggcacaaaggtgtcattgaggggagcaagggcagatttaaatgttttatgaaggagcaaaatcaggattaggattggatagtgcttggacaactcatacaatatgtttttgcctcagttttgtcattgctaaaaagtaaaattaacagctagtgcttaggtttttgtgagggtaaaatgggataatgtataatttattttacatggtatctaacatatttttaagaactcaacaaatgtggtaataattagatcctgaacttctgtcaaagccaggcaggggggcactaaagaagctcacacaacagaaataatgtcaaatataagtgcgacatatatatttttaaaatcagcaagatgtataaacaattctcactattaatactagtaagtttcttcaaagttgaacttaggaaacaggaaaaaattggcacagaacatcctgtgtatcttaccaagataaattccaaataaattgcctgctggcagtacccattaattatttgccgacaatttttcagccagcacatgcttttttatttagctggtccagcaagtcactgcagttgtagttgttcatcttgtcacaggactgggtagaaagccaaatgcagaggtatgagctgccaagtaacccactatctgtgcagctgtggggaggaaccagaaaacctcaagacttcttgctgcttccattttcctagttttttttctctagaacctcatccacatcgtatggtgctgggaagggtcccacagcgtcagtgtcttctatgagtttgttaaaaatgcagactcccaggtcccatcccaggagaactgaaacagaatttgccttttgataagatgtccagatgatttgtttgcacattaatgtttgagaaccactgatatttaggacttatctgaagccacctcacaggataggcagagaatcgctgtttcacccaaaggccctctcatttccttgtcatcccttcatgatgctggatgtggggttcttaagtgagacctcatcttcactaaatctctcattgctgtgcccactgaagccagccttcagttaccagggagcattgccttagaccactttaaccagagagcaacaagctcaaggaaattgtatgaactcaggtgctagacgttcctgggtttattctaggctctgcctcatattagttgacctgggacaaattaactcaactctgtgattgcacctctccctccaagcaagagcctctgcagccctttttcgtaactgttgacccttttctgatggccatcacaggtgggaccaagggagtacactaggggatattagaggaggatccctaatacaagattggccaataagctttgcttcctaggacatctggatttggaaatcagaatccactagttgcctttctcagtgtttgagcaaagaagaattataggacgacctggagaaattatttctcagcaatgggctcagagatacagaaaaaaacaaagacaatatggctgtagaaatatcagtcttcatttctgatagttttctaattttggatcctgctgtctactgaagtctgcattctgcttctgggttccatccctttattcatctaataatttatctctctctctcgcccacactaaattaaattccttaaatccacacagtcctgacaaagcaataagctttaatgaatggtagttaaaatgattattattgctactactggctgatcaacttaatcattattattgtaatgcctcctatatcagctgttttttcattcaaacatagtcactgataattgatcctcaaaatggtaagaaaaccaatcatctgaatcactaggaaaaataaggaaatactattttcatatatgtttatgtattcactattgcattgatgttcaaataattaatttaaaatagaatgatgtctaccataattatagagcacagtggcagctgtcatttaagagcacattttaggcctgaacccctgcaccactgagggaaggaattgtctcagccttcaagcctatcgtgtcccatgttattactcagatatcacaggagacctaactgacatcaggaaggtaaactcagtgacccaggaaacaaaactgttaagttataaaatgatgttaagaatccttgattccacttgctgctgtgggtctcatataatatactcccctccaagcccacagagccttatctcagctggcagcgatctggaaacctacctgttacattaatcaaaacatcttactggaatgctaacttcttgcaaagttccagctcttttcatcaaaaccaattatgtatgaaatgttagacattgtccagtggaagatatatattatcaatattaatgataaaaatcacaactaacatttagacggtagcatgtatcacacccctttgaaaaacgcaacagtattttcagctagtcatcattttctacggttttgtagtgagacatgtgagacttttaagaggtcaaataactttctcaaggttcccagtttgcctgttgcaaattacacttctctgacacatatggatagctctgtccagtgaacactcttagaaacctttaagtaggctgggagtggtagctcatgtctgtaatcccagcacttttggaggccaaggtggatggatcatctgaggtcaggagttcaagaccagcctggccaacatggcgaaactccgtctctactaaaaaaaaatacaaaaattagtcaggcatggtggtgcacacctgtagtcccagctacttggggaggctgaggcaggagaatcacttgaacttgggaggcagaggttccagtgatccgagattgcacccctgcactccagcctgggcaacagagtaagactccatctcaaaaaaaaaaaaaaaaacctttaagtagaaggcagagcctttctcaacatgctacaccattaaaatgtcacatgttccttttttgagaggtagggagaacactttagggagaaattgtctcttcttcagagatgtggctggcaaaaaagcaaagggaagtcgggacactttccaaaaaagcaagctacgtagggcgcagactgcgggcaagacaaaagacctctccagccatcctgaaacattaaacccaatttccttatccccagcaggtatctggcacaactcgcatcattacaattttctagtgtactgagctggggaaatgtttccaaaggaaactgagtagttaccaaaggaagagttgaagacactttgccaattctcttttcttaaggacttagtaactcagactttttaaggtaggaaagattttgccttttgaaaataactagagtttttgctaccttgacaattttaagcaacactgaaagaaccgtggaggttgtataaaccatttgaatttttccgtcatagacctaataatcaggactctggaatggatttcatcttttcttatcaaaagggctgctctcatgctcaatcagctattctgtttcttttcaaaaccgattttgtgttagccatggggagtcaggcagtggattgtctaaatacttttatacagaaacaaaaattcatgcttgatgttcaggtcagttttacagagttgtaatttagaggcattcaagggagtttaatggagaaggaaaccagtcaatattttattcaatccaaacatgaaccaacattattaagtcgaggaatctttctgctgagaaaataatgtcacaaaggttcagtcaatctctgggagaggaaggagggttcataaaagactgcacagtttacatgtgttgtgggaatttaaattttagtaattcttgatgcagaattggacctgtggaattagtcccattttacctccataggaagtgttcaagccagctttctaagcagatttcaaattctgcgtttaattacatttcctaaaacccttagtttgcacacacagcccatgctactctggctccgatgtccttttcagttgctggttggcccttcttcatcaggagccctgttctcgactaaaacccagctccacgctgctcccatcctgctaggcatggtcatgatcatcccaatgcctgcaatgccccctctctgtccagggaatgctttctgatctttaaattcctgaatcaaatatcaccttcccccttttcgctcctcttatgctgcctaacaagcttaattattcttatttctctgttttacctttgctatcaccttattgccatttatcatggtggctcattttaccttttttttttcttttccttgattacaagctctttgaggatcttttttttttttctttcctgcctggtcagtgttcaatacttactgagtgactgaataaatatatatattagataatgcaattactatggattttaaaatctaagatcaaattattacatttgttgtataatcagatattttctttgaaaagttattctttctccaaccagtaactcctctgagcaagtggtgcaagcactgcctaacttcttgagcgtagagtatgaggagaaggagcagttgggtacccacaattgtcaggataccaataatctgaattgtgggtaaaaaaattattctttagagctatgcttttggattcatggcaagttgatgttcacagggttaactgaaaataaatgtctactgctgttgtgcactgtaaattgggtgcaagttatatggcctccactgttcaagatatatgatgagtcgatttctaatgattgcaatacctcatgagataccttacccactcagttttagagataggaaatttgaggttcagaggtgtcaaaatgatgtctccaataccaaatagctaagtaaatgttgaaactaaaaggggagccccctgccaaagacatcctatgagtagcaatagaatagccagaagggcagagtattggggtggtggtggtggtatcagttctcatgattttaacccaaaatgacagtctaagaaggaaagttagcatagaatattctggtagatatcatgaaactcccactccaacttatcagaagaaaagcagcccttttcagaagcagccgactctagcccttggtatgtcttgtcagtggactggctcagatctcataatagtgccatcccttgggggactttttggaagctgcaaacctcccgacagaagcgctgtctaatgagagcctcattcctccaagtgctaagggcaagagtctgggcagaaggatgtgtgtagtgctgttgtgagagaactggttggtactgacacctgaaaaatctccactagcttttctgcaaattataacattaatatgcttgagttcagccattgggaaattaaacctaatgtactatagataaaagattgtaggccttattcaaaataagattcagaattaaagaagactatgcatggtacctccagaaacactatgtataatattaagtattccagaataatcataagaatgcaactaacatttttggatatttacatgtgacaggcactatgctagtcattctatatatattatctcttttttttttttttttttttttgagatggagttgactcaccacaacctctgcctcctgagttcaagcgattctcctgcctcagccttctgagtagctggggttacaggcatgcaccaccacatacagctaattttgtatttttagtagagacagggtttctccatgttggtcaggctggttttgaactctcgacctcccaaagtgctgggattacaggcgtgagccacagcgcctggccttatgttatctcacttaatcctcacaaagaacttatgatatacacaaacactatcattatctcgttttacggatgagataacaaagttacactgttaataactaacagaactagcacacaaactatattatgctgatctactcattttccattcaaattaattgaggactgaagacccaaagatgaagggacacaacatctgctcccacagtatgatagggaaatgaataaaacaaaccaattgttcaatggaactatggcactatggcataagagagaggcagaaatggtctggtaggctaggggtgggcaggggggatttcggagctatctgagacttggaataataaaaggagtttctaaggtagaagaatcaaattataaaactggcaaaagaacatagcatatgctcagagaatgatgggttgttatagtttgaatggatgaggtccctccaaaattcatatgttggacctgaataatcaatgtgataatattaagagatgtggccttttgagaagtgattatgtcatgagtgcttcgcctcattaatgggattagtgctgttacatgagaggttgaaggaagcactctaggaccttcagctcttccaccccttctaccatgtgaggacacagcattcatcccttctggaggatgcacttccaaagtgccgccttggaagcagagagcaagcccttaccagacactgaatgtcagagccttgatcttggacttgccagcctccagaactgtgataaataaatttctattattgataagttacctagtctcaggcattttgttatagcaccaggaactgctggtaccaagcagtggggtgttgctgttaacaaatatataaaattgtggaacaagataatgcagagaggctggtagattttggaaccgaatgctagaaaaagtctctattcctgtgaataaagcattaaggcagttctggtgataactcaaaagagaacagctgtaggggaagccttaatcttacagactacttaagtggttgtgatcagaatgctgatacaaatatggatggtaaaggcaattctgatgaggccttagatggaaatgaggaacgagggattgtaaactggagaaaaagccatcctgtttataaagtggcaaataacttggctgaattgtctgtgtcttagtgcttagtcagaagctgtgagcaatgaactagagtatttggtggaagaaactgctaagcaaaatattgagggtatggaacagcttctcttgactgcgtatagaaaactgtgtgtgagagaaacaaattaaagatggaatttatactcaaaaggcaaaaagaactcaaaagatttggaaaattcccagcctggccagattgtaaagaataaaaaggtgtgttcaggagggaacaccagggtgtgatcaagtgatatttgataagattagtgtggatagaaggaagccagatgcaattcagcaagacaatggaagaatgaccctgaaggcatttcagagagctttgagggtgctcctcccatcacaggcccagaatgccagggccttgagagcagaatgggttcaaaggatgggggccaaggtccctgtgggactttgaggcttactacccagggccaactcaatttctgctccacccattccagtgcagtgctctttggctgctccagcatggctcaaacaggtacaggtttaatgcaggacactgctccagaaagcacaggcagtaaatcttggcagcacccacctggtgctaactgctggtgcacagagtgcccaagctgtggaggcatagctacctccacctaggtttcaaaggatgccttggagagcctcatagcccaagcagagaactgccacagtggtggggccacctcacagagcctctactagggtaatgcctgatagagctatggagtattccacccatgagagctgctgtgagggctgtgcccaactaagccatggacgggtcttccctgggttttgggtcccaacccccactcagtatgtcaagaaggcaggacatggagtcaaagaagattattatcacgcctcagaggtgaatgtcgtttgccttgtcgggtttaaatttacttgtgaattattacccctttcttctttcctatttctcccttttgtgatggaaatacctgccctgtgcttgttccacccttgtattttgtaagcatttaacttgctggatgtcacagattcacagctggacaacaatttgcttcagaatgaattgtaccttgagtctcatccatatccgagttagatcatatttacaggagactctggacattatttttattttttccttaaatagtgtttgaggtacaggtggttttttgttacatggataagctcttttgtggtgatttctgagattttggtgcacctgttacctgagcagtgtacactgtactcaatatgtagcctttgatctctcaccccctcccaccctttccccacaagcccccaaagtccattgtatcactcttgtgcctttgcctcctcatagcttagctcccatttataagtgagaacatacaatatttggtttgccatttctgagttactttacctagaaaaatggcctccaactccattcaaattgctgcaaaagacatttttcattccattttagggctgagtagtatttcatggtgtgtgtgtatgtgtgtgtgtgtgtgtatctatgtatctctctctctctctcacacacacacattttctttatccacttgtttgatgggcacttacggttccacatctttgcaactgcaaattgtgctgctataaacatgcgtgtgcatgtgtctttttcatagagaattcatgactaagacccccaaatcaaatgcaacaaaaataaaaataaataaatgggatctcattaaactaaaaagcttctacacagcaaaagaaattatcagcaaagtaaacagaaaacccacagagtgggagaaaatatttggaaactatacatccaataaaggactaatatccagaatctacaagaaactcaaacaaatcagcaagaaaaaaacaaataatcccatcaaaaagcaggccaaggacatgaatagacaattctcaaaagaaaatatacaaacaaatggccaacacacatatggaaacatattcaacatcactaattatcagggaaatgcagactaaaaccacaatgagataccaccttactcttgcaagaatggccataattaagaagtcaaaaaacaatagatgttggttggtgaggattggtgaaaagggaatacttttacacagctggtgggaatgtaaactagcataaccactgtggaaaacaatacgaagattccttagagaacttaaggtagaactaccattcaatccagcaatcccaccactgggtatctacccagaggaaaggagtcattttgtgataaaagagactctgaactttagaattttgagttgtcgctggaacaagttacaatctttgaggctactgggatacaaagaaacaatgcatttcgcatgtgagaaaaacatgaattttcacggggccaggggtggaatattattgtttgaatatatatgttcctccaaaatttatatgtcagaacctaatacccagtgtgttggtattaagaggtgggaccttttgagaagtgattaagtcatgagtggtccaccctcaggaatagggttactactctcataaaagaggttgaaaggagtgccctaggccctttttcccttctatgtcttctaccatgggatgacacataatttttcccctccggaggatgcagcaacaaggtaccttcttaaaaatagatagagagcagcgttcaccagacacttgatctgccagtgctttgatcttcaacttcccagcctctagaactgtatagtctgttcctgctgctataacaaaatactttagactgagtaatttataaacaatagaaataaattatggtttacccagtctaaagtattttgttatagcatcaggaacagactgaaaaatggatactatgtcctgtatgactggcgcatagaatgtgaaacagagagtgacagggcatcagagtggaatatgggaaaaggccaaatcctgaaggtccttgtatgtaatgcaaatgaaataaaattttatttaaataaaaggatagggagccattgaagaatgtaagtagagttggtatcaatagcgttgctatttatgatgatcatgttatggagtgaatgagtgtgtgtgtcccctaacagtcataggttgaaattctaacccccaatgtgctggggttatgaagtgggacctttgggaggtcattaggtcatgagggtgtagccctcatgaatgggattagtgcagttataaaaagacacaagaaagcttgctttctctctctgctcttcaccacatgaggctacaaggagaagcaaacaatctgaaccaggaagcaggttcttaccagacataggatctgctggaaacttgatcttggatttctcagcctccagaactatgatcaataaatttgttgtttaagccacccactccatagtattcttttatagcagtccaaacttacaaaaatatatcactttgatggagtgtagtgaatggactgataatggtgagactagaaataaggaagctaatggagatattgcaatagtcaaagccttaaaattgagtgggaggagtcggaatggaaagcaaataataaattccagagtatgggtagcatagaatagtggctaagaatatggcttctgggctggctacttaagcttgaaccccagcactgctacctcctagctatgtgttctttgggaacaccattagcttctgtgtttgagtttcctcatctataaaattcataataatggtatctacctcatagtgttgttgtgtatattaacatgacatttgaacatgttgctgaatattaccgtacagttatgcactttatgtgatgtgcctaagtgtctagcacaaagacagcattatgccagaggcatttgtgtctgtgtgtgtgtatgtgtgtatacaatctatatatactttttgctcatcacaatgggcaaaattatttttgttataaaattgtattctaaagtaaatttaatttacttaaaattatattcaggacaagtaggcacaaaaattagcctggtttagaatgacaaatatgtataaaaattaaaaatgtgattctttaggccaggcgtggtagctcatgcctgtaatcccagcactttgggaggctgaggcgggcagattatgaggtcgagaaatcaagaccatcctggccaacatggtgaaaccccatctctactaaaaatacaaaaattagccgggcgtggtggcatgtgcctgtagtctcagctatttaggaggctgaggcaggaaaatcgcttgaaccctggaggcagaggttgcagtgagccgagattgcacttctgcactccagactagcaacagagcgagactccatctcaaaaaaaatgtgattcttcgacatttatgtttttgaggtccttttaaagtcctatagttgcatggtataatgactttggagatagaatgtttcagaataggtaacattaaaggattgtcccatgtaactggattctcataattgcttttttctttttattactacttaatacatatcctagataacccagataacttggttttgaagaactactaaaacacaattaagtattatcttttaccctaaatgtggttagactctctgtttaaaattattgatttttggatcccatatgctctggaaattttagtgtgttttaaagcaaaatataagagaatgtgaaccgagggatattttactctttacagcatgttgaacccaaactctcactagtatctcatcgtatttcccaaaggtttgccaggataaacttcagaagcagacagggtgccttggctcaaggatttgagaaatttggtcttactgagagaaaatagagtgagtaaataattattttcaataaaggattgacctggtcaattttacgttttttttttttttttttttttttgtaagatctgatgttgggatgaggaatagattgatcagaagatagttgtatggagacaattagaacattcctaactacttcataagagagatgatgtaggcatgagttatggcatgtaggactggacttaagaggaagagaaagaactgagaaagtggtagaaaaaaatctcatagaacttgatggctgattgaatttgaatgactagggaaaagaaggagtcaagaatgatcccacatttctaggctgtgtaaccaggtagaggatcatgagccccaactgacagagaatgtggaagaaaatgtagctttggggtatggagaacagaacgtttagttttggacatactgaatttcaaaggtctatgccagagctaggcaggcatgaccagcagataatgggacacacagctccagtgagaggtgtgggctggagatactaatttgagatttattaccagaggtgggagatgagtcatgaacatgggtgtgctcttcttaggagaatgcaaattgcagagaataattggtcaagaacagaaccctaaggaacagaagtgcgtaaagaatttgtgtagaaatgaaacccttgaagatgaaagaattctggattagacatgtaggaagaacaccacggaaaccaagggagttgacaatagttttggggtagaagggatctattttatgttgtgaaatgtccaattagataaatactaaaaagtttccattacgtttttaaaatagcagactttttttttttttgaaaaccctcttattcagaacaggttcagtggaatgttaggggtagaagccatattgaagacagctgagaaactaatcctaggtaaagatgtggaaattgcaagacctcactttcaaaaagttttgaggagaagaggagaatggcaatactactgtagagcatactttgggaaactctgggaccacctgggtcatactttgggaccaggagaggcatgtgcctatttattggctgagaggaaggagcttatagaaagtgagcagtttaagataccatagagactccggccattgtggctcacgtctgtagtcccagcactttgggaggcaaaggtgcaaggattgcttgagcctaggagtttgagactagcctgggcagcatagtgagacccccatctctaaaattttttttttttttccaaaatttagccagacatggtggcacacacctgtagtcctagctactcgggaggttgaggtgggaggatgcttgtgtccaggaggtcaagtctgcagtgcgacatgatcatgccactgtactgcactccagcctggacaacagagtgagaccttgtctcaaaacaaacaaacaaacaaacaaacaaacaaaaatacaaaagagagagtgatggctaaaggaaaatgtatgggaatgaagaacattctagtactcaggtgccttaactttgacccagaagaaatttttttgtaatgagagcctggaagaaaagagcaaaagaagtaatggatactatcattgatagaactttcagcagagacgcagaaatttgtggcttataacattagatggcatcaatattccccctgagataggaaacaaggtcttctaaaagtgagaaggacagattatttaatacaggggctaaagagaagccccttcctcttgaataaagcctgtgatagatgatcttcaaagaggaccaccatcaacttcttcttcccctggaagcacacactgccacatcccacatcaagaggtgggatttgtttccccttctcttgaagctgggaagacgtgttattgcctttgatcaacagaatacagcagaaataatgttatgccagttccaggcctagctttctaagcatagtggagttccccttcttctctcttagaagccagctaccatgaataagaaattcaactactctgagatcaccaggctgtgagaaaagctaagctagctgaattaatttgctaggactgccatgacaaaataccacggactgggtggctgaaacaccaggaatttattttctcacagctctaagagcaaggcatggacgggattgcttttcactgaggtctctccccttgacttgcagatgactagcctcttgttgcctcttcacatgggaatgcacgtctctctgggaatgcacatccctggtgtctctttctcttcttatgaagacgcaagtcataccagattagatctcatcctaaaggccttatttaacttaaatgtctctttgaaaccatttttccaaacatggttacagtctgaggtactggatgttgggacttcaacatatgaattttgaggatgcagaattcagcatccaacactaaccatgtacagagatcatgagagagagggacaggacagatgggcaatgtggagattcattggtcagtattctgagcttatattttctcacataatcatccttcacataagtctctttaagcacatagagcaaagctgtatcaatttcatgctgcagttacacctttctatttagaattcacaaaacaaaattacccatccccctcaaaaaaaaaaaaaaacaaagaaaataacacatatacatcttctgatggaactaaatctgatatgtaaaatgactcaagaaaaatccccagctagtgagactgtgctactctctattagggtaataaaataacctgctaatatcactggcttctgatacaattgtgatgtgtaatatataggctgggagaccactgtggatatctatttttctctcatttttccttatataatttgggaagtggaaggaattggaaactacaatttcctcatgccttcataatagattctgtacatcctttggaaagtccacaaatctaaaactttaaaaagctacagggatcaggcgcggtggctcaagcctgtaatcccagcactttgggaggccgaggcgggtggatcccaaggtcaggagatcgagactatcctggccaacatggtgaaaccctgtctctactaaaaatacaaagattagctgggtgtggcagtgtgtgcctgtaatcccagctgctcaggagtctgaggcaggagaatcacgtgaaccagggagttggaggttgcagtgacccgagatcgtgccactgcactccagcctggcgacagagcaagactccgtctaaaacaaagaaacaaacaaaagctacgggaagtaaaatgttgtcagtttaattctatgagaaggtccatattgtgataagggaataatattaagtcatgtacagaaggctgatactcagatacaatagtgaccatctacattgcagggtggatttgaagctgtccatttcatcccatcctctgcaatggaatgggaactccaacaccttctccaaagctgagtcgctcactcattctctgttattctcttggttttctaagcagactgtgttccagtttccatttcattctgtattttcttatgcacattgtttgttgaatttttatatccacacagaaatgcacatccctacctccatacctacacacataaaagatttttgatgtatggatgctggatgcaaggactaaagaatcaaaagcccttggaataagagagtactgagagataggacaaacacattttttcaatgttcagacttgctggaaaggagaaaataccctaaagaaagtgtcagaaacccccctttaggcctcttttgttactctctctagcttttcaattggggacgtcagttttgctggtgatggcataggcagggcaaggcaaaattaatataaaattagagaagatacgctataaaccggcagaggtccatctttaaaccattgtgaacaggcaggggttcatctttaaaccattgtgaagtgtgtcttctctaagtttaagacgaaggtccagtcttctccagtggggccagaagcacaagtccttttattttttattttatttttttttttgagacggagtctcactctgtcgcccaggctggagtgcagtggtatgatctcagctcactgaaatctctgccacccgggttcatgccattctcttgcctcagtctcctgagtagctgggactataggcgcctgccaccatgcctggctaattttttgtatttttagtagagacagggtttcaccatgttagccaggatggtctcaatcttctgaccttgtgatctgcccgcctcagcctcccaaagtgttgggattacaggcgtgagccaccgcgcctggcccagaagcacacattgtaagagattctgccttctttgctttcaggccacaaaaataagaggtggggcctggtccttgtaggatttttttctataatatacttttagtttagctagtattatatttctgtgtacaatccatttctgttattaccatggttactactattgtttattatccttgataatcactagcttgaaccactgcgataagtttgaagctgatttaatagcctctactctcattcctctcactctgctctgtcagagtgatatttcttaaacatcaatgtgaccatatctgtggcttgtcctttcggtgatctcatccagtctcacggagataagtatgatatagatgttggtgtcatcagtatttatttcccagcctggacctctcctctgaactctagatttatatatatgcaactacttactccatagctctcttcggatgtctaagagacatcctaactctccaagcaagatgaggctcctgatcttcctctctaaatgtcatcctccctccctcagttctcctttcccatttcagaatgtcaatccattcttctgaatgctttagtcaaaaaggtcagagtcatctctgaataggaactgagatacataggctaaatgacatcatggcatcctcattacatgagtcagtaagtagcagcatcaggatatttactcggacagtgtaactccagagtctttgttctttacccctatgtttgactgcttctctaccttataaatccctttacaggtaatccaaaaacttcatatagaatctaaatgacaaatgccaactgctaacctcaaggcaagcttgctacatcaaagaactatgaattctggtctacctagctgtctgggaaaagagctgaaaattcccttggttgagggccaagatcttttgattcatttttctctctctttcttataccttctgcatgttcttatgggaatcctagattctgcatgttcttatgggaatcctaggctgtgattttgagatgggaattcagaagtttctgttataattctgtctcagctactaattagctatatggccttgggaagtttctaaactttttggtattttataattactctgccaaaaaatgacatgcatacactagatggcccagagtctatagcaataatacagaaaaaatgtatagagaaatagataaatcaaattacagggcctgtttgcttcttgagggaaagaatcacaagtttgtttactatccatctcccaagtgcttattgaagttacatcttcggcagaaactcagtaggtatgtgtgaattgctggttgaagattcatgatttgctatatggtacggacaagatgccttagaattccagaggcagtttggaatagtagaaacaaatctgaattgagaggcagacaacaggatctaatagcagagaaggcagagatgtgtaagttagttgacttcaggacaaacatctatcatatagtcaagacttttagtatttgcctctgtaaaatataaagagagtgggattggttgatctcaaagatatcttaagggagctgtgactgtataatttactttttccataaaacctaaaaagtgtaagcatgaaacatttttgtgtgtgtatctattccattggaagggctcagcaattgagcatcaggatctagcacatataatcatctgtttacatttcatttattttagaccccacaccaatactgtgaagtggataataatatctccatttatgcataaggaaattgaggtccagggaggcttttcaaggtaaaactcagtgtcagagctgggattgcaatccaggattaagtggctctcagtttcaattctctttgcattgaaccacacatcctccccaagtctctggcactagtgatgcacatcaggaggcaatgtaggggctcttcaggatataaagagggctcatgggtacaaacatacagtgaaaaggacatggccacacttcttgaaaaccaggttcatccaactctaacagaaagtgctatgattagccaaaaaatatattctagtcacacacacacaaaactaattaattagaaaaatctggtgattaactgcatgccttcattgttttcaataaatgtaacctgtccaataaatcagtaacatttattaatgataatacaaagtatattcagtaataggcttgccttccatgaggagactaatatggggttttatatggagtcccaaaagaaaccaaataaacattgttagcatttgcttcattgcacagattacatggtgccttgattctgctgctgacaagcagtaaattgctctgttgtgtgtggtgcttaaaacaggtttaatctgctattattaatagttccatgaagaatatgattgcctatccccatcccactttcaaccactgtggccaacatacgggaactcaggcaactaaaataattacagaccacaagctgtaacaataaaccacaaaaggactaatcatatcctttcttggaatttacttatttcaaatagtttgttactttttttttcatgaagagctccatattggaccacaattgtgatgagaagatctaacttggatttcagctgcagaaattatgctatttactttcttattacaggcactaaattgctgtttggattattattatttttttcctttctctagatagttcaacaaatagattttacggtctctttatgggacaaagcagagtatgatttcgaaaagtataaagactaaataactagataattgcctagagttgaagtggtgtattcaggaacttcactgggaggaactaaaaataatttaaaaataggagaaagtgtcattggcccatttatgcaaagccaatgcaaagaaaagctgaacacttgacttctgagaaattaaagacaaactgtggtgccaagttacagcaattcccttggcctaatttttggtaaatttaattttatcctttctcaatgttgtggaatctataatgtatattttattggtcatattatatgcatgtctcatgcaggtttccttcagaacttcttgaagatcaatagggaatatattaaaaatgaaaatagaaattaggttgaatattggcctacctacaatggttgaaaaatcactttagaaaaaagtggttttgcttatttccttgttgacctatttgaatgctttttatttaaaaaaaaaaaaaaaggtcctcagcatgaaggatttggtaggtgatgttttatctcactgtaaacatttctttttgctaatcaaggatctttgaatgacagaagggattttaaggaagacaacaagttagtcttctggagtaacattatctgctctagtgaactggtcctttggagttcggtggttttaaaggcatgctttcttttattatttggagattatattgtttaaagttttctgcatggtgaatagaggttgctaggggaacataaaactctacacagagacagaactatgactaggtccaggctctgtcaccaaatagcttgtgatgctgagtcagtctcacaaatgtgcagcctgttgtttcctcttccacaaaatgataatatttctcttcatgtggctttggcagtgatatgacctattacatgtgaaggcattttatgataacgtgcggtgcacattagacatcaaactttgttaacatattaataatatacctcatttggtgacattgttctttttcctttataatttttcaatgataattattaaaatctttgtcatcaacttagtgaaaccccgtctctactaaaaatacaaaaatcagctgggtgtggtggcacatgcctgtagtcccagctactcaggaggctgaggcaggagaatcacttaaacccgggaggcggagattgcagtgcgccgacattgtgccactgcactccagcctgggcaacagagtgagaccccatctcaataataataataataataatactttaaaaaaatctttacgggtcatatgtgccccctcccagttcaccaactttgccttctcactggatggttctcataacttaactctatttccacctacttttctaacacggtatttcataccatacaaattggtcctttacgcaaaataatttatatgttaatgacttggtcagatgggctcaatattaactttttcctcgaaggtgctagtttgttatcccacacacagtgcagttaatacactcataaatgtccttcaaaaatgtttctaagggccctgcagactgaattttagactccgtgctcatttttacttcagtaatttcattagtagtgtttattttataaatagtttgtaaagtgtttgaaggcagaaacatttttaaaatgtttatatatttttgttccaaagtattttgcagagaaacaaatccacagaagcacccctaaactgggagtgtggtgaagtggggaagagcccagcccagggctgcagatctcgggatccaagaatacatagcaggtagctcaagagggaatttagagtctaggcctgcatagaattcacctgaaaaggtggaacagagaccaggactgaaaccaggaccaaaacaaggaccaaacaaaccagatattccagagaagagtaagtggtttctattggtaagagttgggattagcagaaatttcctgaaacccagatgtagtcacagaagccctagagatcccatggccctgcctaagtgaaattagggagagggctcagtggggtgtcttgaatacatttacttgttcaggtgtcgaataatgcctattgagaagcaactatgtgccaggaaaagtacagggtactgggtatatgtgggtaagccagacagcagcaactctgccctcatttacctcccatctcagaaaacaataaacaaattcattaattattagagataatgataaatgctaagtaaggaacaaactggacacagcaggggtttcacctacatggagctgtgattaggggagatgatgtttaagatgacattggaagcatgagaaggaaccaaaaggtcctcagaccaggagaggccaaaagctcttctccatgagtgatttaaagtaaatgtacataaagagtagccagtggaggagatggttgttagcaccgtgatggaaaggtattgggaaatgctggaaaagcatggcataagggcaagaagggaaggtcacccaaaggcaaggttcttgtgggcttcccaaacctcctctgcttctctgcaggtgccagaatttggttatttctctgggaagaacttgtgtcatgaaattgaaagaagcccaagagagttgcgccatagagaatgaggagtgtttgtcagatatatagttgtcatttactgaatattgtggttctcatcttagtttactcccaagaaaatacctggaggctttcaggtgcttctctcttacgaggcctggtactaatgttttcattcaattctttgagcttccctagattcttttaggaacttcttttttttctcctgttagatcaagattctgttgcttaccatcaaagagcccaagctaatacagtcacctctctgtccttatcttgcttgtctgcttagcattcaatgcctgttttttgaaggactattgtctttgggtttatgtgataccacatcctcctggttttctttccatctctctggttgcttcttttcagtgtcctttgctatctcttccagctttactgatcctctaaatgctagagtccctcctgaccaggactaaatccttttgtctcttttaagtcattcttagtggtcaaaaaggtatgcacttaggtgctagggtaccttggttcaattcccagccttgccacttcctagctgtgacctcggagaggtcacttaacaattccttgcccatttcttttattattattattattttaaaaaaacctatttcgtagggctgctaagagaataaagagggttaatcatacctaaagtattttgggcagagctggttcattatatgcattcaatgcatgttatttttcttacaattgttagtaatcatcaattcccatggccttaaatgttacatatatgctggtgacccttaaatatgtattttcagccccaaacacccctcttagctctataaaattatgtatccaaccactagaatttatcaaactttagaagactaaattcaaattttgattactaattcttaacaccccccaatctcactcaacaatttccccccagttttctgcatcttagtaaatggtaagaatacctgcctagttgtttaagtcagaaaacttggaatcatctatattgttgctctttccctcctagccacattcaacctatttgtcaaattctgtcatttttatttataaaatatagattaaatactttcacttctttgtatctcaacaattaaaatttctaatccaatgtaccatcataacttggctagtttactgcaatatcttctttacccattctttatttttcctccatgaccaaatccattatttgccaaatagagttttgttttacaaacataaatttgtgtcattctcctacttaatcctttaatgattttgccctgtgcaatgagtcaaatccagtctgcaagactctgcttgacttgctgtatgtctacctggctggtctcatcttatatcaccttctccctcaatcatggtgatttggtcacatcaacctccatcagtttcttaaatccaataaaccctttcctgccttagggcttttgcgcttgctgtgtcttcaaccaggaataactttttccttgcttctttcattactggttttctcctgaggtctgccattaaaaaaccctcaacttcagaaaggcctgctacatcactcagatttctccagagaagagagatgattggatctatgtctatctatcatctatccatctgtggatttattttaaagaattggctaatgtgattatggggaatggcaagtccaaaatctgtagggcaggtgagcaggctggaaactcaggcaggatttcaacattatagtcaaggcagaatttctgcttctctgggaaacctcagtttttgctcttaaggccttcaactgattgagtgagccccactcacattatcaagggtaatctgatctacttaaagtcaactgattatagatgttaatcacatctacaaaatatcttcacagtaaaatatagattagtatttgaccaaacaactgggcaccctagtatagcttagttgacatataaaacttatcatcatactttccttaggtctcctgcatccacaggagtctctttcatagagttctctctttttttttttccattggatgtaccataatttacccttaagtaattctttgcttacttattaatttccccttcctccaccacactctaatgtctatcaggtgagaacgattcttttttgcatcaatatatatccaatactagcaaagtccttgggatatattaagcattcagtaagtagttggtgctcgatgcttaatatgtgtttgtgaaaacaattaacaaccacagggaacttgagatgaaaagttttgacccaatcttctaaaatttttatgggagttagaatatcagatgttaagcataatttactaaaatgtgaatagacaagaaaataactgattatttctcattttcttttgacacattctcctcccttgtattttcctgaaattaaattagtcaacacagatttaagaggacttagagtctcacacactcagcccaaatatagcattgaaaagacttccaaagctttggcaacatattttattttaataaagattcaaatgcctgcaggatcactggaataattgccagttacacttctattaatgaacacatttaaatggggattgtgaaaagcagaaaatgatctgattttatggagtacgtttactgccagcaatgtacagtgatgaatggtgccctagaatttaattttagttttagccacaaaacagccaaaattgcacagcagcctctttaacgaatatgtactgaacttgaaaaattatttattgagttctcagtgatatatatatatataaattatttattgagttgtcagtgctatatatatatatatatatatatatttttttttccttggagatggagtctcgctctgtcacccaggctggagtacagcagtgcaatcttgctcactgcaacctctgcctcccaggttcaagcaattctcatgcctcagcctcccgagtagctgggactacaggcatacatcactatgcccagcaaatttttttttttttgtatttttagtagagatggggttttgccatggtggccaggttggtcttgaacatgtgacctcaggtgatccacccatctcagcttctcaaagtgctggtaatacaggcatgagacaccacgcccggcctcagtgatatatttttgtgaaccaattagttacttcaaaaaataaagaagagtaatgctgttaaagttgatccacatagcagtcttattaccacccttgcatgggctctgtgctgtgaagactaggttctatgtgcaacaagttctattaacaagcctctttggatgaagctgcttttgaacttgatatgcattcagttctgatgtacagtgctaaaggaagtagaaaatctcaaagggttcataagacagagtcttagtactatttctaaatgctggttcttcaagtggtatttgagtttgaagtacatcagttcacactgctcccagactaaaacaaaaaaatgtcttagaaggattagctgaatctaaggaaactttttaggaatattaaccagaaaaattcaggagaagcaagttttgttgactttatcagaatgctgtttgttcccctaaatccaacttctccttttgcatttatatactgatatttagccagaaactacatttcccatcttcccctgtagctagatgatccctgtgactaagtttgagcccttaatgtgaataaaagtgatgtagagactcttcatgttatctttaaatccagactcacttgcccctggactatgactacctcactttccctcaggatctgaacatgacactgacccagtttataggatatagatggtagcaagggatagcaggacaatgtgttggaaggaacctgggtcgctgaatgacatcctgctagagcagagctgccacatcagcctggaccaaaccaactatgacttgaaagaaaatgggagctttcttataggattgttgcagatgaatcaatacagaaaatcttgaagtctttagaaagacttgtaatgaatttttatattatttagaggttacttttacataagttgtttttaaaaactacctacattttaatgttatgtctttaagacatcaaaaattatgctatctcttttgatttttgcaaaatcccagtgagggaatcattatgagaaagattatgttagcttctggaggaactcaagggacagaataaaagtaaccacaataaaggcactattttcagatttgtcctctgacaactctttgtagggctaagaacaaatctgtgttttctaactttttttagggaggtgactctcaaatctgtatgtgtgaatatatgtataatattaccattgcgataaaacttataaagtgatgtctaacaagtaagtcattagacatccagtgcttagcatgtacccaaattcaactatattccaatttgaataaagcatatatacatctatagagatatagatctatagatatagatatacatagttttcaaaaagcaaatatctacctatagacatctatctctatatatctatacacatagatataagaatatattagattcccctattttagattattcttcaaaaagcaagtagatatctatattgtataccatgtatatatctatattatatatatatatatagataggttatttttcaaaagcaaatttatatatatatatgtacataatgtgaatcaaagtttgagagggggaaaaagaaactttaagaaagaacttctagattatacaacacaattcagagtactggcatgataataatggtgctaatagtgataatgataatagcaataacaataatagcagctacattttgagtgttgtcatgagacagggtctgtgctttttgctttacattcattgtctttgcaaagcatctatgagatgttattcttcaattttgcaggtgacatatgaaacccagggagtatcttgcccaagggtaaccagaaccagaatctaattacattataaattttacctcaacatatatccatttttgcacagaaaagagttagcataacaggtgtgagatcactgtccttagaaaggcctgcttgcaaggctagccacttggatgttgggaaagtgtctaccattctttgaagcaaatggctcactgtgcttaaactgtgcaaacaatatggtttatgttgaacatctgctttgcttcttggagtctggaatttgggtacatactaagtactgaacgtctaatggcttccttgctagacaacattttataaatgctatcacaatgactcattgctgggagaattaagcacttcctgtgagacttcactcagaaagaactcttggaagcttgcctcaggtttcctccaaacattaccccatgtgccttttccctttgcagattttgctttgcattcttttgttgtaataaatcataaatgtgtgattgtatattgggtcttgtacatcccctagcaaatcttcaaaactagagacagtcttgggaacccctaacatatctatcttccatgtcattctctcatttggagaaaataaaattttattttctacctgagtacataggaagacgtatttctcagcctctcttgaaatcaagttggaccatatgactgagctctgatgggtggaatgtctgttagtccaaaataggcccatcaaatgccccacaccatccttctgctctcaactgaggaccagatgcagatgacccagtggaggaagctggcaccataggcaatagtggaaccacgagatggaaggagtgtcctcaataaatgagttgaacagaagtcccatcctgtccccaacggagtcacataggattaggaaatgaaagagaaacaaacatttttttgtcttaaaccactgagttactggagctgtgtgttacagcattgatccttctctgtctaatacatatggtgacgtgctggataccaacacccccatctccttccgctcaactttgaaatatgttgcaagagtgaaagggatttttaagccatagagatcccattactcatttgatagaataatatttgatgggcaaacacaggacacgaataatctaccagatggcgactcttgcaagggaatcaaaggaagttcttcattaccatttgagattgctcttaacatttttgagtagtacttgataaaacaaatagaaggtgttaaactactgggtgtagttcttttactaaaggagccatgctctttcactccccctattattagattatttttcaaaaaagcaaattaacagcacttcaattttactcagtagatgtggaaagaactaaaaagaagaaagtgagagaagataaaaattttattgggctggcctccaatctttttgtttggggtcattcatttgttcacatatatttattgattacctgtcatatactagacacagcctgaagggctgagaattttgtagtaaagaaggtgcagcacctgctgtcaggaagcttaaagaataggggaggagtccacaagcaaagaggaaacccaaaataagcactatgatgggagcacatagcagagtctccaaacctactttaggagatatcagagaaagcttttccacagacaagtctttcaaccccaaaactctcaagatagctgtgagtcctcctcagtttccctccccttttaatccaaaacatcacgacgtccactcagctcaacctccaccacatatccaagcccatcatttctctccttctctacttgctactaccctggtctatgccacatctcctttccgtcttaatctcttggaccagatttctagagggtccccaattttactctgatgtcttacactccattttgcttagagtagccctccagggccatcttaaaaaaaaaaaatcaatgctttgtttgtatctgaacttttaaaaactggtagttccccactatccttagaataaaatacaaatgacgttccaggttccagccactcttgctcactcttgcctcatgattttgggttgttctttatgcctagaaagtccttttttctaccttcccatggccgtgcccttcttgacattgcagatacaatgcaatgccacttccctttctctagccgccccatcgaaagaagctccctgctctagttctttgtaacaaatgtcatcctccttctactgccactagatattttcttatttaactatgtgtttgctttttgcccctcttttcactatcttcccccaatggaatacaaactctaaagaaaaattacctgtctttttttgtcagtgtatcctaaataccttttacagtgatgagcctgaactcagcactcagagaataagccatgaaaaaatatattgaaaggaagtctaagtatggatgtggagaaggtgtagctgttgtcctgatgaagaagggaattgtgggaagcagcatttctcgcaggagaaaaagtccaggtcaaggcccttcagaggggtgcacttcagctgcaggcagttccttctggctggagcagagtaaatagggatgagtgaggggtgagacgcgaaaagtcagcagaagatggttggtcaaggcctggctgatcgtgaactagttgggtcactgcagtatagacagcatctaacccaatatctgacttatagtagatgttcaagaaatatttgttggatgagcatgtaaggcaattgagtctctcttctaatggcaaaaaaaaaaaaaaaaaaaaaaaaaaaaagccagcaattggttttaagtaggaactgactggtttctatttgttctttagaaagaccttttcagctgcacagtggagaatggttcagaggaagacaggactgtaggcaaggagtctgggtcattgcagacatgcagatgagaggtgacagtgacagcagcgtgtgagaggcagggcagtggagagggaaaggcagaggcagatttgagagatacaaagactggagaattggctgagcttggagattaattagaaacaagaggttctgagggaagagcccagaaagacaactggatttacattttttttttttttttgagacacgatcttactgtcacccaggctggagtgcagaggcacaatcttggctcactgcaacctccacctcccaggctcaagggattcttgtgcctcagcctcccaagtagctgggatttcaggtggacaccaccatgcctggctaatttttgtatttttagtagatatggggtttcgccatgttggccaagctggtcttgaactccaggcctaaagtgatccagccgcctaggcttcccaaagtgctaggatttcaggaatgagccaccatgcccagcctggatttctaagtgactgcataaatgaaggtaacatttttgtcaaaataatctctccacacagatgtatgcacataaaatatacctatgagaataaaggagaaaactaacagtagttacctctagcaaggtgggatgagaagtttcctgtacctaggacacttcgatatttcaatttctaaacctctgtatgatttcaaatgtttagcatgacattttatgagtttaaaatttgaaagaaggccgggcatagtggctcatgcttgtaatcccagcactttgggaggtggaggcaggcggatcacctgaggtcaggatttctagaccagcctggccaacatggtgaaaccccgtctctaccaaaagtagaaaaattagctgggtgtggtagtgcacgcctgtaatcccagctactcaggaggctgaggcagaagagtcccttgaacccaggaggtggagttttcagtgagtggagatcgcgccactgcattccagcctgggtgacagagcgagactccgtctcaagaaaacaaaacaaaacaaaacaaaaaattgaaagaaacaaataaatcaagaagcatctaaatgccacagaatatattagattgatgcaaaagtaattgtgatttttgccattgaaagtaatggcataaaaacacaatttcgttcacaccaacataatgcataacataaactaatgcttaacatatttcaagatgacattactgagtcattatgaatttttaattacattatgaagtttagttacttttgtacatagaagaataaggaaagaactgaagggctctgatatcttttgacagcactcttaaagatattaagtaaaacatttctcatttattttcttatctacatggatattaatatcctaaatttttaaaggatagtttcatgtccagagaatctaagccattgttcaagctcagaaatggcagcggtaaggtttgaaccctggacagcgcttgcactatgtcagtctatggaagtcaaaagggaggtcgtgttaactgcataggcttataggcaatcttcccttcagaaagcccttctggttggaaatctgacagacagttctgctagggcaaaggaaatagcattttaactctgttcttaccttaattctaaagtacatgaataacactttgctcttaaggaaggccttttatctgagtctttcaaacactgaacaaaaccaattattacccaccctccttcatggttcaaagagaagattttaatccctaatttgctgacagagagacagaagccggcaggaatgaagtgatttactgagggtaacacagtctatgaaagcgttcaagaataaccctgagggcttgtgacaaaagagcaattgccttatgcaattagcagtgaattcctctgtcctaatcactgcatcttactgtttcccatgcaaagtttaagggaactaaacttctcctctttcctttcccaccataaatcggacgtagtgctttttatgtaaatgtactttgcaaaaatgtagatccctataattttaccttccatctgtttcatctgtttttaaagatcttactgcagaatttcccaaacactttgaatggggtggaaaagccccatacaagaactcagatgtcctgctggttcctttggctacaacatcaaaactcttgcagaaatgaaacaaaaaaaaagtatgcttctgttcttcatgaaattgcccaaggagggtgtctggataataagccaaacatggagggtggggattaactgcatttgagatgtgactgcagagcacattaagctgctttgctctacaggtgttgctgcttcctcacaagctccactgtgatggatacaacctatgtgacccccagtgagtcacacctttttaaatctcctcatcttgagtgctgagatgtgcagtgtaaggtcccctgagcaggctgcaccatggtcaagccatcatgacccctgtgacccacatgtacacatccagaagtctcaaattctgggagccagaaagtctgggacaacaggaaaaccactaaagaagaaaaatggctagtacctgtcttagctgattaggtaaccctgcgacattctaccattctagcatgctctaccctaactgatcaatcaacctagtgacactgtgctctatgacccctcccaccttgtgataatgcaccttgcaaccttcttcccctgcccacaataaatggcccctaactgtaactttccactgcttaccctaatctatgaaattagctccaatcccaccaccctctgctgactccctttttggactcagcccgctcacatccaggtgaatagacagtcttgttgctcacacttagcctgttcaggttgtctcttcaattagatgcgcacataacacagaggtgatgggatgagatgccacacccatgactgtactacccattagaggactagagagaccctccgttgttggctttgaagaatccagctgccatattacaagggagcttgcaagaggaccaggtggaaacggactgcaagtagcctctaggggctgcgtggccctacattgacagccagcaagaggggaatttcatatgtgcaaccacaaagaattgaattctgccaacaaccacaggagcttagaaaaggatccacgatccagaaagaaatgcagcccaatcatgattctaactgtggcctcatgaaactccaaccagagcacttagctatgtcatttctgaactcctgatccttgggacagtatattatgaatgaatgttttctaaatccatttagtatttggcaaattgttacacggcaacagaaaatgaatgtaaacatctttctattttagataaaaaaagatagtaacataacatttaatgtcaaaaggacattagcaggtattaaagtgatgccttaatgatatatttgattttaatggataattttacctattataatccagagcaaagaaagaaaaggaagcaggggaagattccatagaagaaggaaccagctgtctgaagcatagaggtctaactatttgcaactcatcctgtgccttaaaaatgggaagactaggttatatattattaattaatgacagaaaaagccaaagcagcattggcatcactatattaaaacttagtgccccactatatcatttacaaccacctaaaattgaactgaagctataactggtttcgaaagagtgcagcaaagcaagattatgaaacatatatattgatatttgtgtgaccttttgaccattggttctcaaatgaggctttctgttcactgtctgttataatgtaaaatatttttaatagattaaggacttcagattaaaaaaaagaagaattcctaaacatcatcccagttaactgaataaaaatcctcaaaaataagacctcttacctctctccaacccctacacacacatacgcgcacacacaacacacacacaccaaagacttcatgcgattccaatgtagctagcctagtcattggtatttgtcatgatagagctcatcactaataggtcatttctttttgtgctagaagcaccttgtatatgttatatatctagttcaatggttctcaatcttgcctacacaatataattacttgaagagctttataaatcctaatgctgaagctttttcccagagcaattacatcagaatcaccaagcatagtagccactatttttaatttgtaaagctccccagatggttgcaacgtgcatttaattttgagactgctgatctgtagataatagtttgcattttctgcatccttcctaatatataattatgtagtccaaaacccaaacactgcctgggaagtatgtaggccaaccacgactgtcccactttgatggaacatacaactgaggttgaccatttggggccatactataataactcctttttattgaacttcatgtttattatatttatttctttaaaaaagtgcaatctagttatcattatcccagtttatagacaaagacacatcgtctcctgagtcagagggaactgcccaaatgagtaacatgacctgaggctgagtgacaccgaagcttatgataactgcacaaaaccagtgattctcaaagtgtgggctccagaccagcagcatcagcatcaccttggaacttgtaaaaaagaaaatgcaaattctatgacccaatcccacctctactaagtcataatctttcaagatggggcccaggaatctgtgtcttgacaagcccttcaggtgattctgaggctccttataggtggacagtgtactgtattctgtctctatcagctgctcacttttgagactcagaatctggcaagagacctaaaaatgtgtgggagcctcagtgagtaagcctgtgtgagggaggagatatttctctcactatcttcccttcctctcatttccaatctatattaacaatctatgttgaaaatgctaggggatgtatcagagataccatatgggaaaaaattggtggagttatgctggtcatatttacttgcaggggtgcctggctatgttgagctactttcacacaagtgtgaccattttaatatgttgacgaatggtttatcctttgaatcacagtatggagagttttaatagtttcattaaaaatgaatatcccaactgtttccagggaaatgagtttgtgatcttaagggctttgaggtaattggtgtttagggaaccaaggcagttggtttgctttcttggatggaagctgcttcagcttactaccatgctgtaaaacccaagtgctgctgacctgcttagtgtatttcggctatgcttagggttcatttattagaattgtacatttgactagggggaaataaaaattaaaaggccacttgtgtttgatttatgagagatgtcgattaatattttctgagcaaactgtgaagtcctttcttttaaagaagtatataaaataggcctttggcatattcaggtctgatggaaatttgtctcatggggcagggtgagatgggagaaagagaaatcaataaagatagagaagagaaaaaaatagaggaagaggaggatggggaagagctgaaaggagacaataattcacaaggggaagagacagaagaggtgaaaaaaaggaaagcaaggaggagtgaagaaataagaggtggggtcagaaggattaaaaaaggggaaagaaaagagtttgggaaaatgggggaaggagagaaaaggaagaagagaaggacatatgggcaacaaaaaaaaacataaaataaaaaaaaataaagcaatgaatgcagactttggagcctagcaatttattgtgaagtgccacttgtattagacatgctgcagagatgctggctccaaagattaatgatggcagtaatcatgattccaatttatagcaaatgcaatgaaaggcagccagaccccaaacagagaaaccctacggggatggcattggaataataacatagcagcagtcgaggaatacagggatgctgagagattggattcagttctcctgtgttcaacaaacattctgtatctgatgtacaatccaatgttaaaaagaaaaaaaaagtctgcttattactagatctctgaattatagcaaagaagtttaggtgttcacatgaacacatttgaagttttattctgtgattcacctcctctgagcactgacttttggcccagattggtcttttacacctcctttcctttctgtccttgctgctcagtgtttttctgctgccagtggtcaataccactgtttcattgcaaatacctgctgtctctgaagcctggaaccactgcagaataggcataactactcatcctctttcctggttgtcaaaacccttttccctttatgcatgtttatttgtatgtattgtcttgatatattacctatcagattcctttaatcagtggtctgtgtgtgtggtgagcactcatctccattataatctcctctgcccccacctattgccacgaagtcctaggtctttgcagatgatcaaattttggagaagaaacaaatttactctgcataatagagggagaaaaacttagaaagcccagggcaaggagaaggggctgaggagcagaaatgggagaaagacagactccattcattcagacagatggtggaaacttgtgtgcaatgcgcatgcagaaaccctataaaaatattctgcagtgtcaactaccggtatgaattctctgagtaaattgctgttgtggattccaaagaagaggtagagattcatatctagtctgcataaggttggacaaaggcagcagttgtggtggtcagatgtgaagaggatggcattagaagaaatccttggacatcacagacttctacacgcactggaactggggttcttaggggctgggtttcaaaaggatcaaagcaatttaatttggatctccaggggtgcctgtagctactttggtttccatatgtataagaacaaactatatgttgggatgtgtatgctatttgatacataaacatttgatgcctttaaggatgaactgttttcagatagattcatgacagcaagttttctctccctattcagaccataagctccttaaggatagaagtgtatcttctctggcttttgaataacctgcagcatctagtttaacccttagcacatacaaagtatttggtaagagactgtgtctcatagtcagcctggatccactcactttctctcaccccaccctctggggttttctgggctctcattcccttttgaagatggttcacccaggagggagggtcatctgcacacctggattgcagagaaccaggtacagtgatgacctacagacacctgtggtttacagacattggcagcatggttttttaaactataaaagttacagtaattatcctccaattccaggaatggaatcccttgataggcctcaatctacattcaagattcaagtcaagcaccagcctgtatttaaaaactaaggaaacaatggaagtttaatgaaattatgtcattatagttgatgaagagaaaatatttcaaccaagaactgaattgaataaaactttctcagaaactctttgtttaatgggcaatcacagtatgccagcatgggtgtgccacagagaatcaaagtccacagatactgattatattcctatctgggaaggatcagtatgaaatatacatatgatggggctctcatagaatgggatattttcccccttttcctctcatttctcaatgctcctctgggaattgtgtgaaggtaaagtcaaaaagaaagttcttacattcttaaatcctctgtaaaggatctgaagctctttcttggtaaatttgctctgggcttccagaagctcaagggcttcaggccgatgcctgacggtggccatctccagttcatcttccacgctgtc

SEQ ID NO: 361 - DNA, 154095 bp, Homo sapiens
aacattttattttgcttttattttttctttttgaaatacaaaatgtgcacattgagtttacacaaacacgtgatggcaaatttcagtgtacatgtattgtactactcttaatttctacactggtgatagcagggcagctttcaacatcctatctctacaccagaatagatacctgatttattgttgcaaagacagttgcaaatttcctccttctgtagcctcttggtctttgtgatatttctacaaaacagggacgatgtgtgtggctttagtaatgtggcaactttacagttttggctaagatgattaaaaataatctgaattatgatgagctaaatcatactgtaatctggattagttgttgagcacttattttctactaaatcttggtagtagttgtcaatgtaatggaaccactggtgctttcaaagtgaattttgcttgctaattttgcttgctgtttgttcttagtagacagtggggtagtcaaggtttctttctttgtccctgaatggcttgtaatataaataaacatgctgtaaggaagtcaggggaaagaggacagatttggcctttaatgctgttaggattacttgttattaagcattactatatactggaggatagatatcctgaccctttgcatatgtctgtaaacatccttgttttgtttgatgccttcttcaacttccacttaatgattgatactaatgattgatacaatagaaaacagcctgtaagaaagattgaacaaatccaaaattattatataggccttggctgtaacatattatggaaaattaaatgcttattaaaataagttttattaggcatatgctgatatctgataataaactaatttttaaatgtttaataatttttaaatgtttaaaaatgccagataaaactaatttctaacagaaggtgggaaggccatagaaactggaactatgtgtttttttaattgttgtaatcttgtttccttaaagtatataaatggaatttaaatggaattacagcattcaaacatgaaaattaatttaatttctggaaattaaatgcagatgtcactatattagaaaaccattcaaaatcctaggactgaatacatacaaatgagtagcaaaaaacactgatattttaaaatcactgatatgtgaaagcctcaataatcccatggctaaggaaccaataaaactatatgccagattctattacttttgaatattcacagagtatgaaatgagttagaccatcccctgaactcagtggcattatgaaaaggatgcaaatttataactgaaagctcaaatcttttggggattgctttatattaaaacaaagcttgtttgcataatatgcttcagtgtcaagctgagcaatctatgctaaaagtggtagctccaactttaagggtggtagaatagttcacatttgtctgttggattcaggatctatttgacaagttaaatcacattttcaaagagctgcatggagcgcattatgttttcatcctgtaagggagaaacacagagcgattaaattcagcatatctgcaaggaaaagtacactattttgcccctgagtattgcctcctcccatcaaccacctcaaccacctatgccaaaagctcaaatattaagtgtttgcaaatgtaaatgccattctattctatccattttccacatagatgactatgaaggacccattttatattttgtggagtctattgaccaggcattaaaccactttatttaaatctttacttggtattaatagaggatatttctcaaatcataatgccaaaatggaaactacagaggtgcagaggtgtgtcaaagcaaatgagaattttggcattctatgtagatcacaggccaaatcacacagacttttatacaggtacaaggaaaatttgtgtgtatgagccagcagttcatgaagattggaggctggcgcataggaggcagggtggtggattaagaggtaacatgtttgcagtaatcatctctctttctgtctgctagttatggctaaagctgcatggcctgaaggagcctttaaaaatgaatggtctctcaattacagagaaagaattggggagcagaaaccactgctcagtggctgtgttcagtttagcatattctttagaaatgagttaggggacagactttgggcattattggagcacttgtcagttgcatgtgaatagcacttactgagctgtttatggtagtggtaaatggtggctgaaccaataatggcttccactgctagaaaccaagtaacatcaccgtcaagcagcttaatgtcaccaaattaattctctcaaagaccactgcatggaaatccaagttgagagacaagcagacatccagaaaagtaagaacaacaatttaaaaataaagagaaaaactaaagaaacaacggatttctttgttttcaggattatttgaaaaattctttttttctttttttagttttgaggcagagtctatttctgttgcccatcattctggagtgcagtggcacaatcatggctcaacagggatcaagtgatcttcctgcctcagcctcccaagtagctgagacttcagccacgtgccaccgtgcccagctaacttaatttttttttgtagagatagatagggtcttgctatgttgcccacattggactcaaaatcctggccttaagttatcttcccgcctcagcctcccatagtgctgggattacagttgtgagctactgtaccaggccttaacaatttttaactgtggttctgcccacacatcaagtcaaataattctaagtaagctaacactggtttctttgataacaggctactacctggagttctcttcagagaaaattttccactgtttattttttgtgactgaagaccattagtgagttcagtcaaagagccatttcttgtccacatacactaaaacaatgacttttctcttagaaatcagatagaagcttggcctgttgtgatgccatacttggctatctaggaattctaatgctgtggagatatgatagataatatatgagtgatgctaagttttggcaaagagcaattcaaatctcatgtatgttttatcctccatgaatactctctaaggaatttgggaatcaacacagtacatgtacaacttttgtatccccagggtttcctccatagcctgactcagtgggcactctaaatgttgattatgtaattggtgcttgttttcagagtggtaggcttatgctgcatgttgtagaagtggtaaacttaggcatatgatctctatatttcgcccagttcatggtagctagctgctaatactcagtttagctgttatgatagctgaattgatagttattacactttcattacttactttttggcagctttcaatgaactcatctatggtaacaaccccatctttatttttgtccattttctgttcaggaagaaaacaaaaattgtatttagacttatcccttaataccctcacacctggaccaaatgagctgaagctgataaaaagaaaacctagctgcttatttatttcacgtggaggaactgtttcagagcaggaaccagcagttttttagagataaaaatgatagggccaaatgcttctggcttttcccttttcaatataatgtggtgaagatgtagagtcactctgtcctaggtaaaatcccaccttctagatgtgacagagcttgcgcaatttgctgaaactttcagagcttgctttttgtctcatctgtaaaatgagattaatgaggatttataggattcttgtaaaaactgaatgaaaacaaaacttgtgaaacatgagaactgtttagtgttgtatcttggatttagtgaatgttcaataaatgcagttatcagcattgtaaattcaaaaccaaagctattaaattaataggatgctaaatactgttttgtttcagtaaaaattattttcctttgctctcttttgaatcatcgtggtgcatggcaaacatcaggaaattttctcctaacttcatgccctcttgacttctgttttaattcctacctgaaaaaatgtttcaacgtgttgtctgggagcatcttctttgaggacaggatatgtacatttacccatcatatcgtatattgctttcattatatcaagcatttcctgaaaaataaaaggcactcacgtgaggctgcacacatgtatgaagaaaccagtctaagaagctctgacagatttttcctactcaattttaaatttttgactttttgtttgttggattctttgttagacgactgttggttgtcccaaaggaaaaggcaacaaacagctttctgccttaagagcagaagaatcagaatttaagaatgaattctgatctcttggtttcaaaaggaagcaaatttccatgtatctaccatagtcaggaaaagaatatgctggcttaatgtttggatttctatagactttaagtagactatgtttatttaattgcattatatatcttatgtgttgatcatcagtttccatctattgagaatcaaatatacggcacatcgtatattgagaaaaaacaccatttagaattagtgaaattaattggtaagtcttaaggttcattagggtttttgttgtatttttcctactgtggctttaacttaagtcacatgtgaagactagtcaaaaaattttgaccctgggaaacacctttaaattttgttattaactttttctctaaaacagtctaatttttgccttaccactttcattcttatgagagtaaaaataatctctaataacttaaacatttagatttattgttgcacatttgtttcacgtgaaagatctctcaattaggttaatacagagcgaatatatatttacttttaagagtattcaattataaatgatagagtaatttgtaaacaggtgaaaccttttaagatgttttaagcatagataagtagcaagtagtttgttagacacaggcagaattcttgagatgtgttaaacacagaggtaagaattgaagaacaagagatatttaaggtatcctaagtatctgggtaataaatattcatgatataaaaatatacaagaagcactatttaggatatgctccatatacatgaacacaatagccataaggtcttaatttggcacccactagtgatacctattctggccccaggtgtcctctgtgcaagaaacacaaatgaaacccattactacttatcaggctatactcgtgacctggcacacttgcacctgtgtctctccagtagcgcaagttcatgtcatttgctgttggccctgggcaccttttgtctgtggggcctcttgctcaaaactcaattctggggaagtctcgtgaggcaaagagagacaggacataggcacactgagaatgcccaggatttagggagtggtctttcaaccccatttgcagcctgtcctgcgtggttaacttactccatccctttctttacttctcgctgtgttttaaattggtttaataaactgtgtaatacgagtatcttaatttggtctgtgaaccttgtttcctggatagtctgcctcaacgtgcatttggagaccccaccattgcgtcaggtcattccacaatccccatgattgtaaaatttcatttccttatggatcacatgctgtggggaaaagaaaggcttcaggctaaatgttgaaacatgggttggatacattttctttctatctgattccaaccatgatctttattccattcacagtatttattaagatgccagcaggaaacaagggtgtaatctttatgtgttatatatttactttggagcttcaccataaactacttctatcccaagtttttaattgtacatctttcttccactacataaaatattttggaatttcctcaaaaaaacttttcaaattaataattgcaattaatattttaaagttaagaaatgaaaatggtccaaattactgtgatgttggtgaggcatcccttacctctttagtgatgtagccatctttatttatgtcatacagattaaatgcccaattgagtttttcttgtactgtcccccggagcaaaatggaaagacctttgatgaaatcctgaaaagaaataaaaattcaattttatatgacatttttaaaaaaacaaaaacaaaaaaaacaaatgatgtaagtaagggctacaaccctctggatcttgaacatttagcaaaatgattgatgtgttattggttgtctagttttcagacttctctgtgggcataaatcactccttagtcttaacattttcatattctaattggaaactgagttaaatcaatggtcatactggaaattgtaccagtgcgtacccacacagctagaggcttgagtataagtggtattggctttccactgcaagtgcacatgatttactaaaagaatctaataatagttttttcaaaaaaatacaagtgcacacataacacacttcaatgaaaaaccgtttgctaataagaaatgtggctgtccataaaagataaaccaattgtggtctttaattagaaatccagttataatttacatgtggacagtgggtaagagcatggaactggaaaggacagactgcctggattcaccctccagctatattactggatggctttgtgtcttcaggcaacttaacatccctttgcctcaattttcgtatctgtaaaatggagctaataatagtatctacctcttcacaattttatgaggattaaaaaagaggctgcttataacagtccttggcaatgacattggctatgtaagtttttgttaagtaaatggagccctcagtttgtatcctggttagattgcattgcagactggccagattaacttgattaaattcatttagtgtttttttttttgtttttttttttttttttgagatggaatctcgcactgttgcccaggctggagtgcagtggcacaatcttggctcactgcaacttccacctcccacctcccaggttcaagccattcttctgcctcagcctcccgagtagctgggactacaggcacccgccaccatgcctgactaatttttgtatttttggtagagatggggtttcaccatgttggccaggttggtgtcgaactcctgaccttgtgatctgcccaccgccgcctctcaaagtgctgggattacaggcgtgagccaccacgcctggccagatttcttgttgttatgtacagcagggttaacgttacaatgtgctgtattcagtttataatccacttttaggtaggaatgaaagcagaggggaaatccaaaagtcttctgggtgaatttgcattatatctccctttctcacattccttccttttatagctgtatttctatctgaatttctcaaaatgttttttcttttttaaataagtaacatccatatagttcaacatttaaaaattgtgtaagctgcctggtgaaaaatctttcttcccttcctggacccagccacctgttcctttcactcatagactactggcataaatagtttgtatttacttccaaggaatttttgtgcatacacaagtataagatatatttgttttactagctaacagacttctatacttttttttccacttaagcataaatcagggaaacaatttgagtttccattgtatatgtaaatacatcgtagtttatttaaccaaattgttcttttacattttttctcatcattatttctaggtattttaatatttctgttgctgttgtaaatgagatatttttttctatcatatattctaaactagttgtttgtatgtatgaaagccattgatttctgtatgataattttataccctgtcaatttgctgacatacgttggttttcttctgggttttcatgtgtgcaatattagctgcaaatggaattaattttacctttttttctaatttttatatgtttacttttttctaattatatggcctaatatatatagaacagtgttacataatgaaaatgataatagatattcttagttttttcttgaacttgagaatatttcaattcgcttttaagcatgatacttacttttatcatggtaaagaattatacaacccttccacttaagcaaatttatcaagaatggccacagaccttttttagcaaaaatgaaaaagacaaaaacagaaataattgtcaaattcatattgcaagggaccctgaatagcccagtcaattttaagaaagaaaaacaaacttggaggactcacactgcccaatatcaaaacttagtacaaagttacattaatcaaaacagtgtggtactggcataaagacagatatatagaacagtagaatagaattgagtctagatataaaccagctgtctgtggccaattgattttcgataatggtgccaagaccattcaatagctatggaaagaataatctcaatatatggtgctgtggcaactggatcaccatacttagtttgcttcccattggcatgaagggtagaatgtcaagtgagagaaaaacaagattccagagaaagccacaaggaattccaatatttggcaggtacagagaggagaagctggcaaagcatcttgaaaagaagttgctaaagaagtgagtcaggagaacagagcatttccctaggaaaggattgttcattttgctccaaggttggaaaaatgttcactggaccagcaacatggaggtcaccagcaagtgatagggaacggtccagtggagtaggagtgaagagtaatttttaatgaggagcactttgaatactgaagagaagaatctaaaaagagtaagagtcagaaatgggctgtgctcttgagaaggtggggaggatccagaacatgggtagatgggccgatctgagaagggagttgatacatgagacagaagaacatggtgtggatgccagcagctgctttgcaggtgggaagatgactgtgtttctgtccgatagctttagtgagtgtgagctgtttgagagtgaggagcctggtagaagaggtaagaatctgaggtttgaggagagaggcagaagctctgatactaagcagtaagatgacatgcaaattagagaaagggagacctccctcaaattatttccctgccatattttagaaaattatttatgacatagaatgtagtttagttaaaaggtaatgacagcccttggaggtatgagtgtacatcttgcacaaccagcaggctggggatcatggctcatgcctgtaatcccagcactttgggtggtggaggtgggaaggttgtttgagtccaagagtttgcaagcagcctgagcaacgcagccagatccaaattaacagcaagaaaaacaaattaactgggtatggtggtgcacacctgttgtcccagctacctgggaggctgagatgggaatcacttgagcccagaaggtcgaggctacagtgaactatgattgcaccactgtgcttcagcctggatgacagaccaagactctgtctcaaaaaaaaaaaaaaaatccttagctttttcagaaggcataaaatatacattgcagaacatagagccttattcaaggaagattgctgagcagttttgaaaggctagatgagattgattgttatcaatgtaaacgatatttttaaaaattcacagcgtagtaataatatgtcattaattgtaaggggagctggccacagggtctttgaaaacatgcttagagtattggttctcaaaatataatgtgcaacacagtcacctggggagtgtgccaaaagatttatgggacctactccaagaattatgattcattaggttgaagtgggaccccaaaatttacatgtctgacacattccaaggggaagcctgtactgcttccagggatcacactttgagaatcactggcctacagcactcatcactggcattgacctcaccaccacacaaaacagcagagaaacaatgaaagatttaaagatagcacttttggggaatccccccaagatggctacataggaacagctccagtctacagctcccagcatgagcaacgcagaagatgggtgatttctgcatttccaactgaggtaccaggttcatctaaactgggacttgttggacagtggatgcagcccacagagtgtgagccgaagcagggtggggcatcgcctcacccaggaagcgcaaggggttggggaattccctttcctagccaagggaagctgtgacagatggtacctggagaatcaggacacttcctgccaatattgtgcttttccaacagtcttagcaaacggcacaccaggagattatatactgcacctggctcagagtggcccacacccacagagccttgctcactgctatcacagaagtccgagatcgaactgcaaggcaacagtgaggctgagggaggggcgtccaccattgctgagacttgactaggtaaagcagccaggaagctcaaactaggtggagcccactgcagctcaaggaggcctgcctgcctctgtagatgccacctctgggggcaggtcatagctgaacaaaaggcagcagaaacttctgcagacttaaacatccctgtctgacagctttgaagagagtagttctcccagcatggagtttgagatctgagaacagacagactgcctcctcaagtgggtccctgacccccgagtagcataactgggaaacacctcctagtaggggcagactgacacctcatacagccaggtgcccctctaagacaaagcttccagaggaaggatcaggcagcaacatgtgctgttctgtagcctctgctggtgataaccaggcaaacagggtctggagtggacctccagcaaactccaacagacctgcagctgagggtcctgactgttagaaggaaaactgacaaacagaagggaatagcatcaacatcaacaaaaaggacatccacaccaaaaccccatctttaggtcaccatcatcaaagaccaaaggtagataaaaccagaaagatggagagaaaccagagcagaaaagctgaaaagtgtaaaaatcagagaacctcttctccaaaggaacgcacctcctcgccagcaatggaacaaagctggatggagaatgactttgatgagctgacagaagtaggcttcaaaagatcagtaataacaaacttctccgaactaaaggaagatgttcgaacccatcacaaagaagctaaaaaccttgagaaaagattagacgaatggctgactagaataaacagcgtagagaagaccttaaatgacctgacggagctgaaaaccatggcacaagaactatctgatgcattcacaagcttcagtagccattttgatcaagtggaagaaagggtatcagtgattgaagatcaagtgaatgaaatgaagcgagaagagaagtatagagaaaaatgagttaaacaaagcctccaggaaatatgggactatgtgaaaaggccaaatctacgtctgattggtgtacctgaaagtgacggggagaattgaaccaagttggaaaacacccttcaggatattatccaggagaacttgcgcaacctagcaagtcaggccaacattcaaattcaggaaatacagagaatgccaccaagatactccttaagagcaattccaagacacataaattgtcagattcaccaaagttgaaatgaaggaaagaaagttaagggcagccagggaggtcgggttacccacaaagggaagcccatcagactaacagcggaactctcggcagaaactttacaagccagaagagagtgggggccaatattcaacactcttacagaattttcaacccagaatttcataaccagccaaactaagcttcataagtgaaggagaaataaaatcctttacagacaagcaaatgctgagagattttgtcaccgccaggcctgccttacaagagcttctgaaggaagcactaaacatagaaaggaacaactgataccagccactgcaaaaacatgccaaattgtaaagaccatcaaggctaggaagaaactgcatcaactaatgagcaaaataaccagctaacatcataatgacaggatcaaattcacacataacaatattaaccttaaatgtaaatgggctaaacgcaccaattaaaagacacaaactggcaaataggattgtcaagatccatcagtgtgctgtattcaggagacccatctcgcctgcagagacaaacataggctcaaaataaagggatggaggaagatctaccaagcaaatggaaaacaaaaaaaaagcaggggttgcaatcctagtctctgataaaacagacattaaaccaacaaagatcaaaacagacaaagaaggctattacataatggtaaagggatcaattcaacaagaagagctaactatcctaaatatatatgcaccaatacaggagcacccagattcataaaacaagtccttagagatctacaaagagacttagactcccacacaataataatgggaggctttaacaccccactgtcagcattacacagatcaatgagacagaaagttaacaaggatatccaggacttgaactcagctctgcagcaagcggacctaatagacatctacagaactctccaccccaaatcaacagaatatagattcttctcagcactacgtcacacttattccaaaattgaccacatagttggaagtaaagcactcctcagcaaatgtaaaagaacagaaattataacaaactgtctctcagactacaatgcaatcaaattaaaactcaagattgaaactcactcaaaactgcacaactacttggaaactgaacaacctgctcctgaatgaccactgggtagataatgaaatgaaggcagaaataaagatgttctttgaaaccaatgagaacaaagacacaacgtaccagaatctctgggacacatttaaagcagtgtgtagagggaaatttatagcactcaaagcccacaagagaaagcaggaaagatctaaaatcaacaccctaacatcacaattaaaagaagtagagaagcaagagcaaacacattcaaaagctagcagaaggcaagaaataactaagagcagagcagaactgaaggagacagagacacaaaaaacccttcaaaaaatcaatgaatccaggagctggtgttttgaaaagatcaacaaaattgatagactgctagcaaggctaataaagaagaaaagagagaagaatcaaatagatgcaataaaaaatgataaaggggatatcaccactgatcccacagaaatacaaactaccatcagagaatacgatgaacacctctatgcgaataaactagaaaatctagaagaatggataaattcctggacacatacaccctcccaagactaaaccaggaagaagttgaatccctgaatagaccaataacaggctctgaaattgaggcaataattaatagcctgccaaccaaaaaaaagtccaggaccagatggattcacagctgaattctaccagaggtacaaagaggagctggtaccatttcttctgaaaatattccaatcaacagaaaaagagggaatcctccctaactcattttatgaggccagcatcatcctgataccaaagcctagcagagatacaacaaaaaagaattttagaccaatatccctgctgaacatcgatgcaaaaatcctcaataaaatattagcaaaccgaatccagcagcacatcaaaaagcttatccaccactatcattttggcttcatccctgggatgcaaggctggttcaacatacacaaatcaataaatgtaatccatcatataaacaaaaccaaagacaaaaaccacatgattatctcaacagacacagaagaggcctttgacaatattcagcagcccttcatgctaaaaactctcaataaactaggtattaatgggacgtatctcaaaataagagctatttatggcaaacccacagccaatatcatactgaatgggcaaaaactggactcattccctttgaaaactggcacaagacagggatgccctctctcaccactcctattcaacatagtgttggaagttctggccagggcaatcaggcaggagaaggaaataaagggtattcaattagggaaagaagaagtcaaattttccctgtttgcggatgacatgattgtatatttagaaaaccctgtcgtctcagcccaaaatctccttaaactgataagcaacttaagcgaagtctcagggtacaaaaatcaatgtgcaaaaatcacaggcattcctatacaccaataatagacaaacagagccaaatcatgagtgaactcccattcacaattgcttcaaagataataaaatacctaggaatccaacttatatgggatgtgaaggacccttataagggtgtgaaggacccttataagggtgtgaaggacccttataagttcacccttatgtgaactacgaaccactgctcaatgaaataaaagaggacacaaacaaatggaagaacattccatgttcatggataggaagaatccatatcgtgaacatggccatactgcccaaggtgtaatttatagattcagtgccatccccatcaagctaccaatgactttcttcacaaaattggaaaaaactactttaaagttcatatggaaccaaaacagagcccacattgccaagtcaatcctaagccaaaagaacaaagctggagacatcatgctgcctgacttcaaactatactacaaggctacagtaaccaaaacagcatggtactggtaccaaaacagagatatagaccaatggaacagaacagagccctcggaaataataccacacatctacaaccatctgatctttgacaaacctgacagaaacaagcaatggggaaaggattccctatttaataaatggtgctgggaaaactggctagccatatgtagaaagctgaaactggatcccttccttacactttatacaaaaattaattcaagatggattaaagacttaaacattagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaggaacttctgcacagcaaaagaaactaccatcagagtgaacaggcaacctacaaaatgggagaaaattttcgcaacctactcatctgacaaagggctaatatccagaatctacaaagaaattaaatttacaagaaaaaaaaaaacccttcaaaaagtgggcaaaggatatgaacagactcttctcaaaagaagacatttatgcagccaccagacacatgaaaaaatgctcatcatcactggccatcagagaaatgcaaatcaaaaccacaatgagataccatctcacaccagttagaatgacaatcattaagaagtcaggaaacaacagatgctggagaggatgtggagaaataggaacacttttgcactgttggtgggactgtaaactagttcaaccattgtggaagactggtgactcctcaaggagctagaactagaaataccatttgacccagcaatcccattactgggtatacacccaaaggattataaatcatgctgctttaaagacacatgcacatgtatgtttattgcggcactattcacagtagcaaagacttggtaccaacccaaatgtccatcaatgatagactggattaagaaaatgtggcacatatactggattaagaaaatatggcactatacagccataaaaaggatgagttcatgtcctttgtagggacatggatgaagctggaaaccatcactctcagcaaactatcgcaaggacagaaaaccaaacaccgcatgttctcactcataggtgggaattgaaaaatgagaacacttggacataggatggagaacatcacacacgggggcctgatgaggggtcagggggatgggggagggatagcattaggagaaataaataatgtaaatgacgtgttaatgggtgcagcacaccaacatggcacatgtatacatatgtaacaaacctgcacattttgcacatgtaccctagaacttaaagaataataataataaaaatataaaataaaaataaagatagcacgtttaagtcaagtgtggacttgtgttgtttgcctccctagccctagtaggtcccaaatttccatttggtgctccatgatgttctgtggaagttcacttcatctctgagtctagtgatagagccatgacctgggcgaagtcaggaagcacattttatccctttggccggacaactggatttgtggttgccatttgactaaacctagtccaggtctaagaatgactccccagactcagactcttgctaggaatggtaggacagagatgtgcttctttccttgctcaacaggagcaatgaatcatggagccaaggagctttggcctcttcttgcagccctacagggtcccacccttaggttgtagccagccccatctctggcctttttgttgctgtgaaccaatgaaattaccatttttttttgtcacttggtgtatccttttctagtatttgtgaacaaaagtatcctgattcacatggtgacatctaattcacatcttcttgaatactgtatatcctgaaacaatttacattaaaagatagctatggtcttagagcacctctctctttttatcctgtgggatgatatcagtaaagagttactcaaaacaggaatgatatcttttcgtgcaaaagaaaaatgagaaacttaatgtggcttataagacttttgctccgtgcttttctgagttgtaattgaagtctcaagtaggaagtgacaaacttaacaacaactctcaatgagtactttgcacaattactttacttgtaaatgtgaaaggaggttatatctgttccctaaagtacaaaaaatgataaaggggtggagaggtctgtaccgaattctggtttccattctcttattatcaaggcaaaaggagaaagacatagagatttgactttataatagcctagacttgttcagttgtggattctgttcatctgccaaacctttaatgagtgcctcagtgctggccactatgctggggacaatcctcctgactcccctgactccctgccaatcaaagactgctatggcttagaatgatgcatttgcatgtagttgccttactgggtaatgagatgaccaatgtcattattaactggctttgttagaaaaattcccccaactagtgtaaattagttcaaccattgtggaagactgtggcgattcctcaaggatctagaactagaaataccatttgacacagccatcccattactgggtatatacctaaaggattataaatcattctactataaagacacatacacatgtatatgtattgcagcactattcacaatagcaaagacttggaaccaacccaaatgtccatcaataatacactggataaagaaaacgtggcacatatacaccatggaatactatgcagccataaaaaaggatgagttcatgtcctttgtggggaatgaagctggaaaccgtcattctcagcaaactatcatgagaacagtaaaccaaacattgcatgttctcactcatagctgggaattgaacaatgagaacacacggacataggaaggggaacatcacacaccagggcatgtcggagggtggggggctaggggagggataatattagcagaaatacctaatgtaggtgatgagttgatgggtgcagcaaaccaccatggcacgtgtatacctatgtgacaaaaatgcacactctgcacatgtatcccagaacttaaagtataattaaaaaaaaaatcccccaactgataactgctatagttaacatctaataactactgagcacatatttggtgccagacacagagccaagccctttactgacattatgactttttcatttttacattatcttattaagtagctttgattgctgatgttttagcagtatgaatgctaaggttaagaaggttaagtactcagcctagggtctcagagccgctgggtggcaaaatggagattagatcccatcataccaaatccagggcccctcctatcatatttcttctgcctttcaggtttaagcaaattaagtggaaaactcccattaccctttatcgtagaatcagatggtctctctactgtacctctcagtatgctattgctattattcaaaatgtgttcattccctaaccatttctattttctagagatttcccaggtagctaatcaatttagaaaagtaactgcaacagcctagttttaaatttgattttcattcaaactttattaatttagccattagttttcatttaaaaggaaaggcattttaccaacatgcatatcatatataatcattacaactaatttcccaaattataatcaacgttcattgcaattactggtattttacataaatattataaaagcaatgttatgcatggttccatatcattaacaccatactaaatttacatataaaattggatataatgtgccctaggaaattggtggtatatttctgacacataagtaatttcaagtaatggagtcactaatagtttttgccttactcatcctctggaagccagctataaaagtttatattaggtgaactatattaggtaaaacctttggcttctatattatagataaattaagactgtgctggaattaaacttgtttctaaagtgaagcaaacacaaacacaacattatcatgaaatgaccaaagttactatcatggagtgacctaagctgccattagcaaaagaaacattgtggagactggtacccaggatagtcttcccccaaccatctcctctccctccactaactgcttctacacccaggataaacctgcctgccccatcttgacttagttcattccctcaccttagttcattccttctccactctcagcttttatttttctcttctcagtgctatttctcacttaagttatgggagatgaccttttgggattcctggcccagaatcttcgcagttgtggtacccagtctgcatgagcatggagtatgtgtgaggaggctcttgcctgccctgttcatcctgcccctgtggtgactggctggatgacattgcagaaagctgcaccctatttttttcatcttgactccacaaagccatttcacccagatagctgcctacgcccatatgaacttttcttttaaacatgacagttctgttggaatacaattctaccaattttgttttaatttcttttgaatttgtttcatgcttcacctccaatacctttactggagttcaggcttttatcagaccctgtctgcactcttgcaatacttagctgctaattacactccatgtttccaggaatatagctctgataaattcacatccctgccaaaaattctacaaaggctcctcatctcctacaagatagtccaatctcctgcctaagacatgtcaacttctggcctctatctccttccccaaccttcgctcttggctctccaattgtgtattctatcttcttgatgatttacacgtttcccttggttcccaggcctgatatactctgtccagcctctgccccactctccattgcttcccatcccattccaagcctttgttctcttaaggagctcctgactgtcctttagacagtccatcagttgcactgagcaggcttccctgctacagccccttttgtgccagtaccatttccttgctggcctcattcatcatctgcttccctttatcagagctctcatcaaaatttctgctcatatttaagatgcatccttcctcacttccaaaaataaatgcaccttccaaattttatatatatatatatatatatatatatatatatatatatatatattccataagtaaatataaatgtatatatggaaaagagaaactggaatcacaaagcaaaatatgtataatgctacttctgagaccaagcacaacccaatcagaatgtaacaaataaatgaggtatacatttctcacatattttccctaacaaaaataaaagccttcacagctgatcagagttcatgttgggtttattctcctaatgtttaaatcaatatactacaatttatgatctgctatttaccatttgaatcatatgaattacgtgtgtgtgtgtatgtgtgtgtgtgtatatatatatatatatatatatgaaatacatatataagctatgtaaatatctaggacattttattttactaggtgtttatacacagtagttcatgaaggaaattaaatactttctagctgggcgtggtggcacgggcctgtaatcccagctactcaggaggctgagacaggagaatcacttgaacctgggaggcagaggttgcagtgagctgagattgtgccactgcactccagcctttatgacagagcgagactctttcaaaaaaaaaaaaaaaaatacgttctctacagatcacttaaagtttgtaatttaaaaagagatttcctcgtagaattgtcaggctggtgaatgtagtctttttctacatttaatttcttgcctgtgtgccccacttactgagacttccataacaggacttttgactttatcatctttgtatttccaaggtctaccacagcaactggcccataaggaggtgtcagtaactgttagttaactcatttgccttccaggacttttcacatgtaattgaagaagtggactctccttgtatgagccgatataaagcattagaaaataaactgaatgtggcttgcaatttgtacatcttttgaaagataatttttggcaattacatgagagaaagggagtgtccttgggctttctttcccctgagcaaaaataatcatcaccaaactcacattttccccctaaaaagactaaactctaaatagtcaaatgatatgaaaataatccagagcttacctcgaaactcacagctccattgtggtctgtatcaaatgcattgaacagaaaatgtgcatatgttgtagagtctgaaatggtaaaaagggagtatcattaagtcagtgtttccatatcctacataagacttggatagcagtccaagcttcctttgatccagaagaattaactctgcctcctttagtttgtgctttcttcacaactgcttaccctctttctgtagaggactagagtttgagattcacaggaagaagcaacctacatagaggccattggtgacaaacattctctatgagtttctggctggcaatgctgtagtcttgggtgatgagattaacactgggacaagaaatggtcccataggtggatgtgaagattgagacttgtctggaatttgcttagtgtttggaagagaccatctctagaagtaaagtactaaaaatactaccaatgagacagagatgagttgctattattagtgtctctgtcattattagaactttcatcattgttacaactcagaaaatgatattgggaattagagaaggtgaaaaacatacccaaagtcacacagtgaagaaggagtaaatctgggacatgaacttaggtctttctgactctgagaaccaggctagccctcagccagtaccaggctagcccacaggcagtaaagttggctgatggattggggtcattggtgacttgggaagtttctgtggctgtgttggaaggggactgggtggtcctacatgttcctagttgtatgaagttgcatgaagtagggagcccctactctgtctgggtcctgggtgggattcaaggatctgggtaatgatggacaggtatgtcttctgaagtctaacaggtgttcttagtttgcttctattgggtattcttcccctctcatttttccttccttcctttcctgtttctccgttgtctccttaatctctgggctttctgccatttcatttaaaagtctgtattttttccttattgttttctgttctgagtgcctagctttcattccttagggtttctttgcttgacccttgataaaatttacattattattttcagtgttgcatctcatgggctttagccttttatcttaaccttttttgtcttttcaaaataaaatggtaaccttttagctcattggctctagccttttatcttctgttttaaatctcatctatttctattttataacttttaacctttattgggttttaacttatcattgatttaatttttactttatgaattgctttttataggctgtcaagaagctaagtcatagtaacaggagtacagaattgccctctgaggaggccatctaaatttctctcctggctctcagggctcacggcctccttacaggttgtttttcccgaatgcttcagtgtagtaattaacactactgaaggctatacatttcatgaggtagactgtacactcaatttctcaaaatgacagtggcatcttcgctcatctctcacctttttaatatgctatgaagaactacttatctttgaacacaggaattaccagcaccgttttcagtgaactaaccaagaaccaaaattgggtctaaataacatgtaacactgtgacatctagagtggatatccatccagtattgatacattgcaggaagaaattcttttgcatatggagccaggagtttaattaccataaacttagttctgttgttgggaagctccattatagagttatcaagaattggcagcctatttcaacttgcaaagttgttttactctcagcagtactttttcatgtacttcttgaactatatagtgccctctggagatgtgaattgatcgatggtgtgttgaactgattttcagaggaggaaaaaaaaaagagattttgcatattttataatgagcttcattaagcaagtctctagttaccctgttttcacaatcagagtaaatgcctttaccttagcaagcagtactcaccataaataatggctcaaaacaacgatgtttgctatttttttaatcaaaaagaaaaaagataacatgggtatatgataattactattcttctcaaatggagtttttctagcttaaagcttgatatgtgggaattatgctttcaaggtttacactaatgtggtacagaggacatcctgttcttctaaatgtgcctctgcagttcttttagaagttacagcggcttcccagtctagacaatctatgcacagaggttttgataatagcatagtggagtcagactgcctgaatttcaatctcagcttcaccagagattaactgcatgacctcaagcaagttgttttacctttgtgtggctcagtttcctcatctacaaaatgataacaatatcagtatgtacttcatagagttttttttttttttttttttgagacaaagtactgctcttgtcccccaggctggagtgcaatggcacgatctcgggtcactgcagcctccacctcctgggttcaagcgattctcctgcctcagcctcctgagtagctgggattacaggcacctgccaccatgcccggcgaatttttgtatgtttagtagagacagggtttcatcacgttggccagactggtctcgaactcctgacagcaggtgatcagcctgcctcagcctcccaaagtgctgggattacaggtgtgagccaccatgcccagccttcatagagatcttactaagtttaaatgagacactatttgcaaagtgtttagaaataatcctatatacttattaaaatttcagtaaatattagctattattatttcctaggcaagccacttttatttcaactaccttaaacacatgtgatcaaatcttttacaaacgtaacatcttttcaccttaaataacttgctgtttttgtaggatttctgttgtgtgtctaggtgacgagttctaatttaatgcaattttctgctcaataaaagacaagataattatgtcctaaaaatcaatggtccttctgatggagtttggatttcttctggcaagcacttgaagacagtggaaagttttaaagaagaggagtgaagccactggctttgactgggtgagagaaagaagcaaaggcaaaggaatgtccagctaggcagaaaactggataaaatgacgaaaagagaaactgtctacaaaagcatctatggttctggttttactcaactgtgttcttaagcactcaataaatatttgttaaaagagtgattaactgacttcttggaatctagatttcagtacagtccagggcttaaaagatataacaatgatctcccttctccgtctatgacctcttcgtgatcacattcctttacataacaaaaatagttactgagtttgttaagctgggattgcctcagtttcttataattttacttgtgaagctgaaaaataaatgttgagattttatagttgagcaacaaaatttacagattcttagggtgggaagacattttggatactatttagcattgtatttacattgaacaaaggtaaaaatagggacttgtagtgacatactgaggtcacctagttagttcatggtaaagttggcaatggaatcaagatattcctataccatctcttagaaatcgaggatactagagtagaaaaaacccctaggattcctttggtgtgactcctgcattttatagaggaacaacttgaggctaagaaaagtaaactactcgaggttacataccttggtggtggcagtctatccacaaactctgaacttagtccaaagttcttaacccaattatatcgagaacacagtgaatatagcaagtaaccctagagttcgttcttcatagtatttgaacaaacacacttgattatcatgccccaggtttgtagaatgaaatcaatctggtttatttctttttcctttcccacacccctactcccattgaattcaagcacgaggaatagaatcaccttcatgtatttgaatatacaattcatgacatcgttactatggtaagacaagttcatatgtgtgaatagtagcttctgtcaataagccctctgtaaatcaccctgaaaattgttagaaatactgtcctaggacaagaaggatactcagtgggtgaagtcttttttaaattttattttaatctttatgtctacagaactcatctgactcaagtgacttgcatacagcggctgcttaaaaaatgtttattgacagattattctgacttgagctcatttgttcattcattcattcattcattcattcattcaacaactgtttattatatgcctagtgtagacaacataagtgcattcctacaacatgagcaggaatagcccaggaaactatgatttttatgggctttaaaaatgtttagtgaactaaaagcttacacactaaagcttctgttgtatgtggagtttaagaagtttttgtgtaaccatataggcaatagcaccaacaaaccgtttcctctctgcttgccttacagtaggcatactttatcccctgccaacaagaggcttttgttcaatccagttttttctgacatccagctcaccaaacaagttgggtttgataaactgtttcacaaagcaatagagaaagctaacagcctgacacaatacaaattgcagagagttctgtagataagacaaagcactttcctggaggaaatggtgagatgttgtgatttatggacccatcaatgttactgttcataatgagaaaaactgttgcattcagaccatcatcctgaataaaggatgactccgtggaagtgtaaggatggccatcacatgaattcgcctgccatcagagatcacattcttccttaggacatttttccttttctggccttatgtaagaaacaatttgtatgtatgatattaatttttaaaaatgcaaagcaaatcataattctttaaaatatttcatttccttcagcgatgcctcatgtggtcagatttctgcattcaattaacatgaataatgaaataattgttaagagtgtaacagtaattttttctcaaatccctaatccctttggattttgtgataggaatcctttgcaaaatagatgtgctctgtttaagaagatgttctctaatgcagaaatgttatttttcaaataaagatataattttaatgtggagctctatccaagttttagtatgtaataacttgatttgaaatgattgaaaaataacttaaagattttcatctgcattggtgctttgatattaatgcctattaagatgttggtaggcactcagatagtaaatataatttttctttaaaaaatccatgggttttaaacaatttagaaaaacatgaggtagttaattaattccccaaattaatctctcattaatgcagacagtgaactcattataatcctggcatcaggtactattaccaatacctgtctgtggtttgttagaagggccctcccctctgcactgtagtaatgagatggggtgggagagttgtcatccaaagtatatccaaattcacttaataacagtcttcctgtgttttcttagaattctaatttaattcttttaaaagtccaccgaaaacaaaaatttgttttgacatgttaggcacaaaattgttttaaatccactaaactagctaaaaccaaatggattaaaaccccaaaggaaatctgacttttgtatgaaacaactaatacttaagtgctgtacacttttcaaagagccttttacagatattattccactgtacagtgatagccagccaccatgtgaggtgggtgtcattcattcattcatgcaaaaagcatttatcaagtgctattacttgtcagccactgtcccatgacctgtggatacaacagtaaacaaagtggagaaatcctctgttcccctggagctgacattctagtggagagaaagaaacaacaatggtacaagtgaaatatatattattggattgtctcgagtgccgaaaagagacataaagcaggggaaggggatggggaatgtttaaggtgttgcaatttaagatagagtggtcagggcaagtctcactgagaaggtggcattggcgtaaatgcaaaggtgatgagatattgagatagatatttgggagaagataatttcaggcagagggaacagcaggttcaaaggcccaggagcagcatcatggctggtgtgctggtgggatggcaagggggccactgtggctgggtggggtaagttgggtgggagaatggtagaggataaggcagagaagggacaagagacagtagccaccatttgtaggccactctgtaggttgtggcttatgttctatggaatggtatggtttcgaacaggcagtaacatgatttgcttgcattttaacgggatcactctgactcattttaagagtagaccatggttaggggaggggtcatcagaatcagagaagtcagtttggagactactgtgtttattttggcaggagataacggtggctcctttaagtggaaagtagtaaaaaaaaaaaaagtgttggcaaggtcaatggcaaagtcaactctggccataataacagagagaaacagttgtcccctatattgagtagatgtcaaagttgaaaggaagtactagatggttccctcttgtcttgagataaaaccttcttcctgaactcccgattcatggactccactatcccatcgcatcactatctttttcctccaattctgaatcctatttatctcttttcttttctatcctaaagctattaacatctccttctttaccagtcttccctgtgtataaacaatgtccagtcttttctacattaaaagataaagtcttccactggtatctacccagcactatgatcagtttcctcatcacttcactcttccagcaaagctttttgtaagtgctgtctctattggttgtcgctgttttcttctcatcgtccttttcaccctctgcaatttggcttctgcttgtgcgctccactccctagtagttcatccagggcacttgggctgtcctgatcatgcccaacaatgactcccatgttgccacatcccaaagagaccttctgatccttaccttactggacttcatcatttcatttctgaactatctatctctcttgtgtttatttccataaactgttcattctctgtctcctttgttgatcccttttccttatggttcttgacatgtgttctggagtttcatgctggcctcatggagcttgcaaccttttataattcccccagtaacctcatctacatcatggatttaaccactacttcttgattaataattctcaaatctctatctctttctctgacttgtcctctgagcctcacatttgtgccaacttcttgttgagtctaaatccccacaggcacctcagatgtaatttgtccaaaactgagatcattatcgccctattcctcctgtaaagagtcacctggtgtccatgatggaatcctggaaggtatcacaaactcctctcttcatctctttatgccacaaaaagttagttcatcactaaattcttccatttttgtcatctaaatatgtctgtaatctgtccccacttctcattttctcctatgcatatacttatttaaagaccttattgttttgcctcctacagcagtaatcttctaattagtctccctgcctgcagtattgctgacctcaagttaatcttccactgacctatcagtgaaatgtatcccaaacacaaatcaaatctgactgtaaaagatcccacttaaacttatcagtggctttgcatcacctcaaggataaagtcccatttcttcatatggcatccttgactctctaggacatttcaccctccattgtacactctctaccctagccacacccaaatcctggcaatttcctgcaaatgcccatcttcagttctatgctctgaccctttgtttacaccccatttgcctaaaatgtcatgtccctactgccttttaaagcgggaagacatcatactcagaagtgaacttctcctgagaggtataatgggagagcgaaagactatacactttggaaatggatcaaactctctgcaccttagtttccacgtgtgtatctttaaaaaaatgaggattataggtagggttgttggatggtgaggcatgccagggacaggcacatattagatgctttctgaatggcaacaacttcagctcaggttcaactcatctggagagtctctttttatgtcctctctgtcctgcagctaatttaatcatgccagcactgtgctctcagaatattattttttaactcccataatcacagttatacttgagtttgacattgtccatctgctacactaggtataacattcttttgggcagagattacatcctattcctcttaattccccctacgtgatcagcacctcatgcatggctaggcacaccataggctgtgggacaaatataagttgggcatctgttaggtaattgaaagaaaaactataaggtccaatggcaagaatatcttttcactcatctctaacatgcatgtattatcattacgctatccttgtgttttctttccaattaaaataatatctaggatggttttaattttctcagatgagggagcacagtaaagaattactgaaagaaagaggaacagcagaaaatatacaaggggaggctgcagaaaatctaggttataacccagatctgccactgagtcaatatgtggccctgagcaaaccatttaccttctccaatccccagatttcatatctataaattgaggataattacatttttcctaattttcagagttgggagaatcaagtgagacctacaatgcatgtgaatgagctttgtggcatttttgagcaccctcataatagtcagaaaacattgtgcatttgagagccacagtactgggcacacagtaatagttgtattaaactaaagagcagcctcttggatatttgataatttctaagtcgctggcttttatggtacattaaaaattatatacacttgcatgctgtgcattaattcttttacataacgattaaaaatgtagcatcatgctatgaaaaattaaactcaacactgcaagcataattgtaactctgatagtatgttaacaagtccacatttgtacttacctccctgtggaaagaactgcgagtaaatctctttgaaggtttcttcattaacaacaccactggggcattcctagggaaagtggcagagaagcaatatgagcaaagtgttcataaaactgaattttttttgcacattttgaaacagaactgtctaccatgcaaagctgcaccaagaaaattaaccattcatccattattacaaagggaataaaagcacactataaacttatgtttgttccagttctcacaagaaaaaaaaacgtagatgtaaatatctttgcatattgagtatcaaagtaggtgtaatgtattcagaaacacagtgctgcttttaagaacacatatgtttattataaagtaaaaggaaattgcattatttttcacacagcaagcatgttgcaagatgtttataatatagtctttggtgaatcttggttttgtcctttcaaggttttctgaactcacataatcttcgattcaatggcagaattactctattggcatctctagtggctcaagaagcttcaaccagtaatagatactaatgcttgttaacaggatgtctaggcatacccaagacatggttttgtaacaagtgaccttgggtgagatagaaccccatatttttgaacttccggaaaggagagtctgcaaagaaatggcctggcctgggcttaatagatccccacctttgtccctgggtcaacttgtcaaagaatgatggacattgatcttgggaactacacccatgttggacaactgacctggaggggccacagggcaaggttagccctctgagagtggttttggcatttttgctaataaaaaaaagaaaaaaagaaactttaaagtgtcagaagggggctgccttggtgcagaatataaggtttgagcaagcaaattgtcccccaatctctggaaattcctccattttttggagttataagaaccagtgtggttaagaatttaggcgtagaggccccttgagtggtggagactgacaatcacatgatagcccagaattgaatcatgtgagatattaactgtatggtgatcccttgttatccttggggcattgcttccaggaccaccgcggataccaaaatccatgcacattcaagtcccacacttggcactgcagaacctgcagataagagaagttggtccttcctatcctgtatctttgatctgcatttggcagtggatgctgaagctgcaaattcagaggggcgactatatttattgacaaaaatccacatataagtggacccacacacttccaactagtgttgttcaagagtcaactgcacattgtaagtggagaagtggtaagttctgtttagtctcttttagtagattctcatgaacagtcccatgtgatcagagctcccctgactctagttgtcacagcactcccacgccacctaacgtccacccaggactaagttcactggggaaggatgaatggtgtgctaactccccaacagacctgactttagacatgaatattctgtgtactctaaatttgatactgtttccagcatctttatcaatcacctatggtagtatttaaaacatcacttaacccttaaaatcattgttccctcactaataaacttactttctttattccagtgagtcagttactcaactgtaatgtgcttcacctgcagaattttctattttctcatttgttgttttgaaaggtaggacctttgatacataaacagtgttaacagtttcaatgtgaatttgtgtttacagagcttctcgatatggttttatcccatttgttaatgatgagcttaggtaggcaaaatagctgcattcacagaggcagaactggaggtgctgagtggcaaagcactttgttacacactaagccagtggggaagctggaatgtgggcttggaactctccaggtcatgacaaggtttcgtattagatgacccctgtggaaataatgatgacctcaaggacctaagagaattggagtaaagaaaaaaacaaccaaaaacaaatgagcaagcaagcaagcaagtgaactgtgatggttgattttatgtgtttaacttctctgggccatagtgtccaagtgtttggtcaagcattattctggatagttctgtaagggtgtttttgagatttattacattgatgcaaaattgcggcttttgctattactttcaatacatttaagctggtagactttaagtaaagcagattgccctccacaatgtgagggggcctcattgaatcagtttaaggcctgaacagaacaaagacggaccttcccagagaaagagtgttcttcagacatcatctgtaatattggcttcccttgttcaccagcaccctgcctttggacttgaactgtaactgttttctgaggctccagcttgccagaccccttcattagatatcaagctggccaaggctccacaaagtgtgaaccaatatcttaataagtctctttatactcacacatcctattagttccatttctctgaaggaccctaatacataaatgaattaacaaccaatagctacaactccaaaggtggtatgtatacagctaatctctcaaacattttgactatctatctagctgacaccaatggacccattttaagactaaacactttgcagttagaccctctcacacatggaaattgtgatttattggctatttaatgctaagccagttgcttgggatagtaaggagagagtaaatacctggctctctgccatcaggtggcaagcttgtgcaaagttagagctggaaagttgcctgggagttaaaagttgatgctgataaaggaagaggacttcaagcaaagggacctctgcatcaacaaatttgttagctgccttcagtctctagatatatttgatagatataatgtgaaatgaatttgtaaactgactatctgatatgcatgtgttttatgtttaatcacatatctgtgtcagaggaaaccttttctctgccaaatgaaaactactggccaagtttcagggtggaaagtctcaccagataaatttgtttttatccaccttatattcattacattagtttacatctctacaaacacatactgtatgcctattattccaggagtcttctaggaactgggactgctacaataaaccagtcaaaggtcttcccatcatggaacctctatccaactagaagaataaagactgtctttgttcaggctcctttaacaaaatgccatagactaggcagcttataaacaatagaaatttatttctcatagtactggaggctaggaagtctaagaccataggattagcagattcagtgcttgatgaggccacattcctggttcatagatggcatcttctagctgtgttcccacatagtggaaggggcgagctagctctgtggggtcttttataaaaggacacttatctaattcatgaagtctctgtccacctgatctaatcatctcccaaaggccccacctcctaatactatcacattgggggttaggatttcaacatatgagttctaaagggacacaaacattcagaccatagcaaagaccaataactaaatattaaaaaatcaaatccaagaatgatgatcttttatttattcccagagattttttattgaaactagtgcatttttttaaaccttcaggtgagaaaaagatgctagtgatttacaagatggtatacattctgtaactttttcttcacctcttctgtgcagtgatctctccataaaagtggtctctctacttctctatcaagaatgaatttggccaggctgcatgtgcagcaaagtgtaaaacataaacaatgtgctgtattagttaactcttgctgctgtaaaattaggccttcaaatgtcccttaatcaaaatgcttgggaacagaagtgtcttggattttagattttttgggatttggaatattcacattacactcagcagttgtgttagttcatttccacactgctataaagaactgcccaagtctgggtaatttataaaggaaagaggttaattgactcacaggtcagcatccctgggaaggcctcaggaaacttacaatcatggtggaaggcaaaggagaaggaaggcaccttcttcacaaggcagcaagaaaggagaagtgctgagtgaaaggcaggagccccttataaaaccatcataactcatgagaactcacccacttatcacgagaacagcatgggggaactgcctccatgattcaattactccacctgctctctcccttgacacctggggattatggggattacaattcaagatgagatttgggtagggcacaaagcataaccacatcaccagttgaacatacctaacctgaaaatctgaaatactccaatgagcatttactttgaatgccattttgtctctcaaaaagttttggattttacagtattttgcttttttggatgagggatagtcaacctgtataacacagttaaaaaccacgtagtatatttcttattcacataacaatcttgggtgagtgtacagatcagctgatggttcttctagggacagaggctaatgaagatttggtgactttaacatatggcgccaacagtctctgtgactgtgtcatccagaaggaggaaaagaacgctgaaaagagtacatggaaactttttatgggccaggtcttaaagtggtatacatcatttctattctcattttttttgttgttagagatcacttaatgtgtctaccccaaacaaaataagaagtctggtatggccagaaagaagacaagaatgcagatttgtaaagagtttggaatatctatccctgtggcatgtttgaaagatactccaagtgtctgtgttctgaaacagttctcccactgatgctttatttattgatttttattttgtatttttgtaaagatgggatctcactatgttgcccaggctggatttgaattccctgccacaagcaatcctgccttggcctgccaaagtgctgggattacaggtgtgagcccagcctcccactgatgttgtaacatgaagattatcaagtcatttagcagtataaattgtctccatttcccaggtgtcatttttaaagactgtttacttgcttcaagtaaacaagtacaatgaagcttaaatgtttgagcatgaattttttcattagatttttctaaggatccaagaagcagtagggttcctgggtttagggatagtaagaaatgcctcactcatccatcttctgagaatttgctgcaagcttctactaacccttatggttctgtattctattttctaatgaaattttgtctgattattagcaaatgattattccatgaaaatatgccctctatagaaaaaaattaaagaaaatgaaaatcacccataatctgactactgtaagagtatattggtcatttatataagcatatataccgtagaaataaagttttaataagacaaaattatagcattttatgttctttaactttaggaaatatcctgaacattttttacatcatgatttttagtgactgcataataatgcatccattgaacttaccatactgttgcatattgaggcgattttggcatttttgcactacataggaataatgatgtaattaatattctatgcatccttctgtgactgcacttgtggtttcttctttatgactaatcccagaaggagaatcgtaagaccaaccagtttaaaccattgaaagctctttctatgcacagtcatggtgctttccagaaacgctgcatccattcgtgctgccaccgcagctttatgagaaagtctcacaccgagaggagctaccgactagaatcacatgggaattggacacacacacacacacacacacacacaaccccatgaacaaacagcaataatttgcttccctcatgaatccaatcgtcattctgaaaattaccagtggacattgaggcgtttggacaggtccctccgaggcataaagcaatttgcctgtttttcacacagacagggtcgctgtgatggcactcagccggaccacatcaccacaatcacagcggtttattgaggataaaataaacaactccattccttcttatgcagaccattacttttaacactttcatcaaccctgaaaggtgggtattatttagacatgaggacaatgagcttggagagatgaagtcacttgtttgagtcacacaggttttgacagagacatctttttgctcatttattcaataagtagttatttaatgccttctaagtgtcagcaaatagttcatatgccttttactattctgggcactggagatacaggaatgagtttttaaaattccatttcttttttgctcttgtggaatataacatttagtggaatcagactcataactctgactccatgaattgcaatgctatcttgccttctggattattactttttcttctattaggactgaaaacatagtctcctggagagtcatctgtggaaatccttcttctgggaagatgtacacggtgtatttgtacccagaggcacccatcacagctgcgttggagagaggcatgtgcaaagggaagccatttcaatcaaaattgggatcaccgattaaaatttattgtgcattgtagcttgagagatttgaggaaagcaatctttttctttttagaaatctttggttttagtgtaacaagaacctccccaccttcctgtgtgccacatactctttactgtcattgtaaatggctagatagtaatgggctgaggaaaatgttctggtttttaggaccagtcaaatgaactgctccatccagtatttaggagctggaggtctctggttctgctggctggtatacttatctatgatgaccattgcatttctttcattgcctgtgaaacccttcactgtgatatgatcacaacacaataaaagtagaatgaggttttctttgcaatataactgccatagatttgtctgttggtgaagaaacagtcgccttttggggccttactgctgtgttccctgatgagccttttcagtcctctcaggccatgtggggacacatgtgagggtcaagattagttgtagatatgcaatgaatactatgctagtactaatatcaattttaataaggcagtattactattgtaataatcagcataaagtaatactttattggtattgatattttataattattaatgtgatgatgacaatgatgatactgatgatattaagctaatacacatgagcactttttatgttccaacccttgcattaaatgttttacatggattatctcgtgggaatagaaagatgttagtattaactccattttacaaatgaatgaactgtcttagagaggggccactgcattcccaaattagaaaatagcagatctaatctatagatcacagaatcaggaaacttgagagtttaaagcaactttagaggccaggcacggtgggtcatgcctgtaatcccagtactttgggaggccaaggtgggtggatcacctgaaatcagttcgagaccagcttggacaacatggtgaaaccctgtctgtactaaaaatacaaaaattagccaggcgtggtggcacatgcctataatctgaactacccagcaggctgaggcaggagactcacttgaatctgggagatggaggttgcagtgagccgagatcacgccactatactccagcctgggtgacagagcaaaactccatctcaaacaaacaaacaaacaaacaaacataaagcaactttagagacaattcaattcaatgtcctcattttgaaggtgaggggatagagattaaggaggttataggaactgaccatagatacacagggggctgctaagcctgacctcatgtctaggtttcctgaggtctaggactaagctttgatactgcaaatgtcttcgtgtccatacaatagctggtaatttttgtcaggtactatttagaggaatctagtgcagtgcttatattcttgggctctggagttaaatagaaggcctgggttgaacccctactctgccacttgggagctgtgtagcttcaggcaaactgtttaatctaagtctcattgctctcctctgtgaaacggggacaggaattgacctcagagagctgctataagaatgaataagatacacatattatgctattatcctagccctctaccttacacatcatatttggtcatttaatattagctgttagtaccatggtaatagtttaggatttggtaagcagaactccatcacgcaatgagtcactgtaacatcaatgccgatagaccaaggataaatcatatttatcaacgtggttgaatctagaataacacaggtctgaaatgcaatcagcttatgaagtatatatgaattacgctttctattctagtgttataagttgaatcactctatctaatatcatcagaatttaccctaaaagaaaggaatattgtaattgtaaatgatagcagaggagaataaaggccaccatcatggaaataaatgtcagtagaaacccaggagcctcttatttattaatttaaagttttccccagcgatgcttacatggtatgtttgaaatcatcatggaaagtgttgggaagggtgctttggagaaagatccatgtatgcataggaaattgctaagaaacatattttgtgagtgcttcaagagttcttatactttcaccttataaggaaacctttcagcatttcctggaaggttttcagagctctgttgaaatgcatgagaaatagctgcagtggtatgcaaatcacaggtataataacatcatataattataatattgtccactccaataatctttgcccactctattagctgaaatcttctcttcccctaaatcattctgttctgatatgtgtcttctcctcaggatcagaattgttattaaacatttagagacttcttcaggattaaaaaaaagaattacagtaagacatttcataggaaaaaaaaactaaaagtgcttgtgaaatagttatttggggatcctttcatgatacctgtaatgccacatctcttaggcatctgtatatttcaccaactctcacacccatctctggtgctaaggagaacatacaaggtagtctgctcggtctatcagttaaaatagtatttagcatgtagtatgacaattcagagattctctggcattctataattgcaggagaattttcaaaatttaaatgacacaatcctacaacctgtgctgctgatatcaccagattctgtggacttctctgctctctttagagttagtaaatacaaggcagggactaacctttacgatgtttagaatagggaatactaaaaatatttatgctgaatgaataaatcttcagtcagttcttagcttttaataaattagaaaatgaatttgctctgataatgtccttcaaaacttgggcctacatttttagaactcctaagaccaagaccaagatagtcatgggggttccgatatccccatgattgcccacaatgactatgatcgcagaaattaaggggagatggctaggatcaagaaaaacacttcttatttcaacataaaaagcttaacatagtcaaaaattggattctaaaaagctcatttaaaaattataggattaacctttcagttttcaaagcagaaaagctgatcattaagaactagagctggctataaatttctgttctaatatgcccaggtgtttgaactcctagcaactcatttattccttcttagtctaaatgttctcatctgatataacaggtaagtaatactaacatcacaggtaagcaaaagaaatgcaaactaaaatagacaatggatgaaagaaacccaaccaattttaaaaactgaatatactcaacatgttggatattttcttgtttccaaaatctgcattaactgcctcttccatttcctgaacacacttctggggtcaaagtggttaaataggcactgcagattaaaaaaagaaacagccaatggtgggaaaaggctgacctagatactatccttggaaaaggaatgagagctgggtgaccaagattcaattcagctgcaaggatgtgggcacattctgagccccacgagttctcagggtcacccaggatgaagcagaaatccaaggtactaggcaaaggttctctccccttcagttctgccctctaaccatatggaagaaggaaatcacatgagatttacagccaaaaaaaaaaaaaaaaactggctcaagtttcagctctactactaatgaagaaataattgaaaagttctgctttgagtcttagtctttaaaaatgcaggaaacaatagcatcttatagtaaagaaatgagaactaattggcattatgtatataaagattctagcataatactaaacattctacaaattgtacttatttttactattatctcttcaagtaacttaagttggttctgcaaaaagagattttccaaattttgtaggaaaaggcttcctgggattgggcccaattcctgaatctttagtggaatgcatgtagaattgtttgatttacggagacttttaaaaggattttcccaactttatccagaagacagtgtccattttgtcagggtcttttaaaaattatgatgtagtgaaattctataggcacccaaaaccatttagtggaaaaaaaagacaatggtgccctgggacaaagcctatgtatcagttttctattgctgcataaaaaatgaccataaacttagtaactctaaacaacacaaatgtatcatctcacacttctgtgggataaaagagtctgacatggcttagctgtgtgctctgctcagtctcccacttaaactggctatggttctcatctgggccttgcagtcctcttccaagctcactgaggttgttggtagaattcagcttctgtggttgtagggcccaggtccctgtaaccttttggctgtttactgggggcttctctctcagcttcattccatcttcaaaccagcaaagcaaaggcctgttgagtccttctcacactctgattctctctgacttcccctttggtaaaggactcgtgtgattagatcaagcccacaaagatcatctctgtatcttaaggtcaactgccctgagactttaattatatctgcaaaatctcatcacagtagtaccttgcttagtatttgattggataaccaagagacagggatcttgagtggctgcatttagatatctattaatacctcccacagcctgcttcttctgaacatcagttcattttggttttcatagcagtttttgtttaacaacagtcttttttttacaattatactcacaagtgtatccaccacaactcgcaactatatttcttggcacctgccatagtttaatgcgatttgaaaagactatattctgtcaaggctttagaatcagcagtgtaaagaccagctgtgaggccaaaattcaatattttttatgagtgctaagaatagtatcccatatgctgagtgttccccgtctagagtatgtctgcctatatccagagcagaaataaatttttttagattttactaattgattagatcactttcaagttggcatgatatcagcctaataatattgaccaaaaaaaaaaataccgagtaaagaattctacttaaaagaaacacgcagtgtttcaatcagaaagaataaaataaaatacagcaggtactccatatcgcagctgcagcatgcacagattcaactaactgtggcttgagaatacttgaaaaaataaaaattaaaaataaataaaaaataaggcaggtgcagtggctcgcgcctgtaatcccagaactttgggaggctgaagtgggcggatcacctgaggtcaggagttggagaccatcctggccaacatggtgaaaccccgtctgtactaaaaatacaaaaaattagccctgcatggtggtgcatgcctgtagtcctggctactccggaggctgagacagaagaattgcttgagcccgggaggcagaggttgcagtgagccgagatcatgccattgcactccagcctgggagacagagcgagactccatctcaataaataaataaataaacaaacaatatgaatgaaaaacaatataacaactatttacacagcatttccatgtattagttattataagtaatctagagatgatttaaagtacatgggaggatgtataggttatatgtaaatactacaccatttcatataacgagacttaagtatccccagattttggtatccatgggggagggttctgaacccagtccctcaagaatacagagagatgactgcatggagatgatggtatacacatatgttcatatatatatacatggttgtataaagcctttttattccctgaagatttaaaaaaatctattctctcccagtctgatttctgtcacctactaaattggctagattctggccccttgataacttcatttagactatgatttctggactccttatgtgagattacacattttcctcatgtgtaagccattttttattgatcttttttgttacttatagtcaaaagcattctaacataagctacaaccttcttgtccttgtattacacctttctacagaaagagaaaataaaaatgagttgagtttacaggttgctgacaagtttggtgaaatgtctgctggagaaagaggtgtcgtctatagattacggtggtgggtgcgcatatgcaggtccagatttttggagaacgtcttttaaagtctatccaaagacactttgagaaagcataggaattgggggtgaataaaactcactttttttttttttgagacagaatctcgctctgccgcccaggctggagtgcagtgctgcgatctcggctcactgcaagctccacctcctgggttcaagtgattctcccgccttggccttcctagtagctgggactacaggcacccgccaccaagctcagctaatttttttgtatttttagtagagacggggtttcaccgtgttagccaggatggtctcgatctcctgacctcgtgatccagccagcttggcctcccaaagtgctgggattacaggtgtgagccactgtgcccagctgaataaaactaaatttaatgatcattcgtggtctgctgggcactgagccatgtggtgtaggagatacatgttctcattaaatccctgagaagtagaaaaggtagatgttttaccacacaatgtttaagaaatgagcacagggaggtttaaagaactttcccaaggtcagtgggactgggatttgaacttgagtttgactgcaaatctttcacatcttcctaagcttgaaaggtgagtgcacctgcggggggaaaagttaactaaggggtaacttttatcccaatgtctttcaatcctattaatcactaaaacacaaagtattcgttatttgttcaacacgtattcatataccaagcacttgactacgcacaggagcgtaacggttaatcaacaagcatggccctcatccaaaggagcttactacggaggaagcagtcagtattcaaatactgacatcaataaatatattgaaaccctcagggcaaagcagcatgaaaacttgaattgttttttacaaataaattgaaatgtcccaggtgaggggttggaggataggacctcaagttgtctggtcatctgctttggtgaggcaggttcaggacaggtcagattcagctctaaatacattttatacattttattatacattttgttccctttctctctctctttctttcttcttttttttttcttccgagtttcgctcttgtctcccaggctggaatacaatggcacaatctcggctcactgcaacctccatctcctaggttcaagcgattcttcagcctcagcctcctgaatagctgggattacaggcgcccgccacgacgcccggctaattttttgtatttttagtggagacgaggtttcaccatgctaatctcgaactcctgacctcaggtgatccgtccacttcagcctctcaaagtgctggcattacaggcgtcagccaccacacccggcccctttccctttcttattgccattctgagaaaatactagtttgtccctcttgcacaagtttttccctcagtgagctaccatttccaggagcagccctgagtctctgaagttaaagaaaaaaaaaaaaagtttagtctgcttaattaagttcttgttgcaaaactttcttagttattactctcagttgtagcttttggaatctaacagcccctcgcttatgagccactcatatcacttactagcctggaactttgaataagttactaaacttcttcaagctggattttatcatcactcatttatgcaggacgtatttttgaaattgttgcaattgttgcaaatacttgagaagtttccaccctcctttgccttctcctagtgcttcttcagaggctatgaagggaacaattatcaagggtcacggtagctgcctaaaaggaacctgtgtctagtacttcagtgcttccgagctctcaggtgggacagtaaagcctctgtctcctctccatgccaggcaaaatgacccaaaaggaaactcccgggcctgttgactctgagcaagctggggcagaacgcttccgagggctctctggagctcagacggcgctcagcgtgagttggaccaaacattcttagggttgtatcatcataatgaggcacaagggggcagtagtgtcctccatgatagctagaaaagcgatttccagttctttttcttaagggattgttcttttcctaagcttggtgcctgtctgggtaaatttctttcaagaaggctatttcctttttatgaacggtgacagcctcattcctacattagataatttaaaaaattaactatttctgggaatggggcccagagactctgatctccattttggatattacatttggtgtacgtcagtctgaattcacaatcacttttttggcagttgggccacctttaatttagtcaccaaaaacttgtagatcttagaaaacaaataagcaagacaacgccactaaagttccaaagcttgagtctgaaaaccttctgaaattgttaagtgtatgtgggctctggagtcaaagctgcttgagcctgctttgctgtttaacaggggaacattttaaacctttaagatgaaaataatgatactaccctatctggaggttattatgaggcttaaataaagataacccatgcacaatgtctagcgtcgtgcctggatgtataaacacccagtacacattccccatggaggaaattatttctacaatgatgctcgttctgaacctgttagcttttgtcatgttttcatgtaatatgggatattatgtttatccttgttaaataccatctgcttatttaatttcagaggattttcagaatatcacaccagtgttccacttccttagttattactctcagttttgtagcttttagaatctaacagccccttccttatgagccactcatatcacttactagcctggaactttgaataagttactaaacttcttcaagctggattttatcataattaattaatgcaggacatgtttttgaaagcatattatatgtcagagagtgtaagaagaaatggagctaaaacaatcaagacagatgaagtccctcctggagtttgatgactatcagagaagtcacacataaaacaaagttctgtgtaaataaccattcagttacagttgcgataagtgctacaaaccaagtatggaaggtctaatttatagggaagacttccctgaggatgtgacatttaaagagggacctgaaggataagtaaaaactagcaggagatattgctggggaagaggcaaaggaaccctgtgtacaaaaacctgtgatgtgatcaatgactaaagagatggcaaatgtgcctggggagtgtggtctgagacaaggttggttaatttggggcctgctagttacattaagaatcaaggtctttgccattcacaagataggtatcatatacctgtttttcagagctctggagagaattaagagatgatttacatcaagtgcccagcacaatcccaatcgcattctaaacactcagcatccctctcttttctgtttactctaccagagttgaatttttacctctggtttattatttattcaatacgtaattatttagcgtctactgtgtatcaggctctctgttataaactgaacaaacaaaaggggaaaagcagacatggtcttgcctttatagaatctctccactgatgagctattatgttctttgtgcatatgaatttatttcaagggaacaatagtttcaacatatatggcgattaaaatcttgtgctcctatctccaaaaattaaaagtaaataaaagcaagcaagcaagcacacagaataaactcacattgccatggattgcaatgtaaataactcaagattatgaacttgtatgtaggagttacttctgcatgtttctttgcttttgctaatgattaataataacgagtccaggccagacacagtggttcatgcctgtaatcccagcactttggaaaaacaaggcaggaggattgcttgaggccaggagtccaaggccatcctgggcaatatagtgagactcagtttcttaaaaaaaaaaaaaaaaaaaaaagttagccaggagtggtggcatacaccttttgtcctagctactcaggaggctgaggtgggaggattgcttgagcccaagagtttgaggctgcagtgagctatgattgctgctgcactctagcctgggcaacagagagagactgtcttcaaaataaataattaaaaagaataatgatgattgtttttacagtatattcttgcacatggtacagatggttagaataaatctctgtactactgaaagtgctaataagtctccattatattatcttaggggctaagtatccttcaggagggcagaaagactcccagctattaggtgtatctaaaccccacatggctatgtttaccctgaaactgaggcagtctaactcttattcctttctgtttacctgttttaatatattgcatatttatctatttaatatatacaaatgttgtcttctgataaaggtccagaaattccaggcatataaaagagcttcaaatcccaacaattctaccacattcacttttcatttccatctgcacatttttcatttttagagctcatggatagtctagacatttatttgcaaatattatgaaggtattatttcaatcagcaagggattctcttcaaaacttatatgagcttatggtaacaattcttattctctctagtgaggcataaagctaaaagttttatgtttttgccccgtaaggaaggaaaaacaatgcatgtttttgtttttttctagtatctcacagatattttcatttcctggtttaccagttgttaaccttaatgcatcccagaaggagattaatatttggatttaaataataggagctctactttcggtttcttgttatctttgctgggagatgagaagtctggggtggtttattctctgtacaacctctcaaaattgtactatagaccaacatactgaggaagataaggagcaatccctccagtacttacaatgctcatatgaaaatagatgattttctgaaagaattagaatgctatattttattaattgtttctagttagactttaattccaacaactaatatctccttctttaagaatgatttccctaattctaccgttaggaaattatttaattctaccataattatgttttatttttttccattttatgccactgtgccaggcactgtccattttatgacatatttgtgtcagcttaacaaatctagctcatcagttcagaatcaacaatgaaccaaatattactgtagattatatgttaatacataggagcacagttattacatgtataactatttctccattttgtgaccattatagggtaattatgaatagatgaaggcatgattactttagatcaaaacacaggcaaaaaaaatggatcttctttggggaaatgttttatgctatagactgaaagtgtgtgtggcctccaaattcatatgttgaaacctaatctccattatgatcatattgggaggcggggtctttgggaggtgtgttagttcattctcaggctgctataaagaactgttcaagaatgggtaatttataaagaaaagaggtttaattgactcatagttccacagggctatagacgcctcagaaaacttagggcagaaagggaagaaaacatgtccttcttcacatggcagcagaaaggagaagtgccaggtgaagggggaaagccccttataaaaccatcagctcttgtgagaactcactcactatcatgagaatagcatgggggcaactgcccccatgattcaattacctcccactggatccttcccagaacacatggggattatgggaactacaattcaagatgagatttgggaagggacagaaagcctaactgtatcaggaggtgattaggtcataagacttaagtttttaatgaataggattaatgttcttataaaagaggcccaaagagctgctgtgcctcctccgccaagccctagtgacataatggaaatatggtcttccatgaaccaggaagagggactttaccagtaaccaaatctgtcagcacctcgatcctggacttcccatcctccagaaatgtaagaaataaatttctgttgtctataagccacccagtttatggtaatttgtgacagtggaggttgtagattacagagaaaaagtggaggttgtagattgcagagatgaattagtgtagtttatgaaaccatgaagtttgacgttcctgagggatatcccagagaagttgggaaaccagtaattagaaaggagtttggaactcaggtcagaggtcaaagcttacagctatcagtttgtgctcctttagcacataggtatagagatctcccaaggaaaatacctaatgaagaaaaccagggagctgaatgcacagccttggtgggaagctacatttaaaaaacaggaatgggataagcagtccatgaagaccaggataaagtagacagagaggtacaaggagaagccgtagattatatcaaaggaaccaaggaagaagaggcattcaagtaactcaaggcctccactcccaaactcagcagagacttcagttaggtccagagaagtcacaggagaaagtgttagtagcatagactctgaaacaggctgtgtaggcttgcatctagtctccactactcacactagctgtgtttcttaaattctttgtgccagtttattaatttacttgtgcctcacttgccttatctgtaaaatgggactaatagtatacttaccccatagagttaatacaaccataacattgaccaatatttgtagaaccttaaattcttaactcatagttagaattaaatatatttattgaatttaaatcaagcaattcatagatgtcaagattggaaactattcagtggatttgcaaatgaaatgtagttttgacacacacacaaatcagtacaaggaaaactggggaaatctgaataagatcagtggattacatcaatgtgagtaacctgatttaatattgtactgcagctttacaagatgatactactgggggaaatggtacctggtgacctccttggactatttcttactattgcatggcaacctattgttatctcaaaataacaagtttaatttaaaaatattggtagccatggaaaataaaggtggtcttgacctatgaaagaacaatttaaatgacatggtagaggcagaagccaagagttaagaaataaatgcagatgaggggttatatagactgaacttagacagctgttttaggaattttatgtaagagtataagaatgagacttgccaatagttagagagagctgtgtgtgcatgtaaaagttgttgttattgctgatttggaatgagtatgtcttctaatgcattttttaagggtgaatgagacttgactagcattacaatatgtaaggaggcagctaggaaaagaggaagagacagggaggaggaggaagggagggaggcagataaattataaagaggaatcaagatatcataggaagtgggattgaaaacactagggaaatggaacattcttttcttttatacaggaagaataagtcagcaaataaataccaaacaggtgccagctatacactggacttccttctaggagttaattaagcactgtggttttgattgaataatacagatcaaattcctctgtcccgtgagaaaatgagacagttctgtaggtacatttactgctggaatcagaagagctgtaaggatgtataggcatgttactgtaaatagatgaggagacactagatcatgaaaaagagacaagattatcaagctgagtgtaaaaattgctaattagtagtgactctcatatctggatttttgtttggttttccccagcaagtaatagagaagtggaagacaaatcattctctgaccctagagttcggtgaccccagagccatataggtatgtgacaggttggaaactggcttctcaaaatatattgataacctaatctctggaacctaccttacaagtcccccctgccccacaaccccccccccccacacaaaaaagaaatgaaaacaaaaaaaatttcaggtataattagtttaaggatctctataaggagagattatcctggattatccaagtgggccttttaggctatcccaattgtccttacaggagagaggcagagagatgtgacatacatacagaggaggaagggatatgatgatggaccagagagacatttgaagatgttgaccttgaaaattacagtggtgcagccacaagccaaggaatggtgacagctgccagaagaggaaggaaaagattctcccccagaatttctcaagggagcatggccctgctaacaccttgattttggctcagtgatattaatttcagactttcgacctctagacagtaagagagtaaatttttgttgttttaagcctttcagtttgtagtatgttgctacagctgcattaggaaactaatacatgcatgattgtaggacatggataaggaagtagggatgttcaagggtatttcaggaaatcaaccatatagtgcagattagtatggaacttgtgagactaagaagggctggtgatcccaaaggtcttgcttgcagaatcaatgagcagaatgtagtgagattgagggcttaagacagttgaatggatataaggttgtggtcaaaagggtgagaccatcatttaggatgtcaggaattaagtagtttcaggtaataataaagtccaagtgatatccatcagagtgaaaagtggaatggaaaagaaaataatggcatttaaagagtcaaaaaacactgaagctcaggtgagtggctggtaggcaggtcaactccatggatattactgtcaagccaatgaacaaagattttaaagtcagcgatcaaagtctggaatgagtatgatacagaaactctcccagtaataacatgagacgccctgattctggttctctgtgactcagctctgttagacaattttcttacttcaggaactgccaataccccatttaacatgatgctggtgaggcttttaatcccatttccatgggccacagggctaggtcaaatgatgcaggcttttccaggaacagttctccatcccccaggccaaaatgattggttcagtgtcatgtgactaaaactagttcctgccttgctggagttattagcacggagaaaaggtgagtaaaagagacagcatcctgatacactgttggagccttgatccagccatgcctgatgctgtaagtattcctatcttagatatgtgagtcaataaacctttaacttaagatactttgaatgggtttttgttacatgtactcaaaaatatcctaatttataccagaatagtattattttcttgctctttgttctttacagggtggctacaaaggaatcaatgtagcctcgtagtttctctggatggtatttcagtgctttgggagataaccaccacataaatgagagagttcctatttttctttgttattgttttactatctaaccccagctacaagaaaggatatattggtttattttacaaactttatcttcacaatcagaaggatgtgagctgtagagcattattttaaagaccagtcggaagatgaaatggtgcaaaaaataaaaaaagaagaaaaccaaattaatctgcaaacacattagaattttcaagatttaatttcactgttatttttgcccatttgaagcaaatctattcactagatctctattaaatccctactgtaagccaggtacaaataaatgagatgaacaatttgaactgatttcaagttgcaaagtaacaattatatgatgaatttctttgagaagcaaatgttggtatatcagtccattttcccgctgctgataaagacatacccaagactgggaagaaaaagaggtttaattggacgtacagttccacatggctggggaggcctcagaatcatggcaggaggcagaaggcacttcttacatggtggcagcaagagaaaatgaggaagatgaaagaatgaaacctgataaaaccatcagatctcatgagacttattcgctaccacaagaacagtatggggaaaaccaccccatgattcaaattatctcccattgggtccctcctacaacatgtgcaaattatgggagtataattcaagatgagatttgggtggggacacagagccaaaccatatcattcaatccctggcccctccaaatctcatgtcctcacatttcaaaaccaatcatgccttcctaacagtcccccaaagttttaattcatttcagaattaatccgaaagtccacagtccaaagtctcatctgaggaaaggcaagtcccttctgcctatgagcctgtaaaatcacaagcaagctagttacttcctagatacaatgggagtacaggtattaggtaaatatagccattccaaatgggagaaattggccaaaacaaaggggtcacagggcccttgcaagtccaaaatccagcagggcagtcaaattttaaagctccaaaatgatgtccttttattccaggtgtcacatccaggtcatgctgatgcaagaggtgggtttccatggtcttgggaagctctgcccctgtggctttgcagggtacagcctctctccaggctgctttcacaggctggcactgagtgtctgcagcctttccaggtacatggtgccagctgtaggtggatctacctacagctggggtctggaggatggtggccctcttctcacagctccactaagtggtgtcccagtagggactctgtgtaggggctccaaccccacatatcccttctgcactgccctagtagatgttctccatgagagccctgcctctgcagcaaacttctgcctggacatccaggcatttccatacatcttctgaaatctagacagaggttcccaaacccaaattcttgtcttctgtgcaggctcaacaccacatggaagctgccagggcttagggcttgcaccctctgaagccttggcccaagctctacattggccctttcagccacagctggagcagctgggatgcagggcaccaagtccctagactacacacagcatggggaccctgggctcttcccaacgaaaccatttttttcctcctatacctctgagtctgtgatgggagaggctgctgcaaaggtctctgacacaccctggagacactttccccattgtcttgggaattaacattcagctcctcattacttatgcaaatatatgcagctgacttgaatttctgctcagaaaatgggattttctttcctacagcattgtcaggctgcaaattttccaaacttttatgctctgcttcccttttaaaatggaatgcttttaacagcacccaagtcacctcttgaatgcattgcttcttagaaatttcttctgccagataccctaaatcatctctctcaagctcaaagttccacaaatctctgcagcagaagcaaaatgccacaagtctctttgttaaaacataacaagagtcacctttgctctagttcccaacaagttcctcatctccttctgagaacacctcagactggaccttattgtccatatcactattagcattttgggcaaagccattcaacaagtctctagggatctccaaacttttccacattttcctgtcatcttctgagccctccaagctgttccaacctctgcctgttacccagttcctacgtcacttccacattttcaggtatcttttcagcaacatcccacttctggtaccaatttactgtattagtcagttttcacactactgataaagacatacctgagactgggaagaaaaagaggtttagttggacttaacagttccacatggctggggaggcctcagaatcatggtgggaggtgaaagtcacttcttacatggcagcagcaagagaaaatgaggaagatgcaaaagtagaaacccctgataaaactgtcagatcttgtgagacttattcactaccatgagaactatatggggaaccacacccattatttaaattagctcccactgggtcgctcccacaacacatggaaattatcggagtacaattcaagatgagatttgggtggagacacagagccatagaatatcagttggtaacacactgaactagggctctaccattaagtaagcacacagaaatacaaagttcaaataaggataaacagggaatataaaaactattctgcttaataggaattcagatacctcttaattttttatattatctagtaattaagagtgagtgatattattgggaaaccataaaggatccatttcatcagcactgttttttgtttggttggttggttgttttgagcccttacatatatctggcactgggtaggctctgagaatacaatggaaaaatggcaggcctggttcctgcccctaccctttggttcctgtcagggtattctctgaggcatcacagggtttatccagttcactatttagtaaatgataaaactcacattcaaacactagtgtcctaaaacaatataagtctgtctctcctaaatgagctcattatttttgttttagccacctgagagtagagtttctaattcctatctagcttgctgttcaaataactgataattaatcccagaacattagtttgcttgaattgaaaaggcacatcacgttcaagtgcctcgtttttaatataaggcaaactgaggcaaagaatgttaaatgttcttcacagaacaagaggagaggccacttttcaccctcagcctagtgtttatctgactaaaccacaccgtgaaagataacagtctatgaagacaaaaattacaaggtttagaatcctctttccttctccctcagacaactgggaaataatattctttaataaagttgtggttattggactagcacagtagccaaatttaggatgacttatttattcttaaaggttgggactttcattctggaagtacttttaactgttaaagattcctctttccctttccttcttctttccttgcctccctcatttttcctacattccctccttttttttcttgtattatttcattacacaaatgatcatttattccatacaaagttatggaatgtgtagggtgggtatgctggatgcaagggatataaaattggcacagcatctttcttgctgtcagttggctcacaatcgagtggaaagcaaagatgcattcagtgaatcattacaaaacactgtgatgtgtgcattacggttcatcacagaaggagttttggacccttactgggaagaggagaattaagagctgggtgactgcgaaagatttgcaggggagaaaatggctggagagattttgaaataagggaagggcattcccccattccagcatgcagaactaccacttgcaaaggcaaatacgattttctgcagatcctcccctaaccccaccccagaaactggggatatatatcattgggaagagatacagtttaatagagaggaaacactgttggaccactctcccaacacctgtttctcaaatgtgaggcagggctagccaagcatcccacatcaagagaagattaggatgggggaagaggtagaagtcaggcaggaagaatgtgaaagacaagtaccagtctatgaggctggactggtaggtaggaccaatacttaattttctaaatgcatgccactttccctacagatcaatgactgctagcacttccctacttgcttttctttggatttttttttctttttttttttttttgctactgcatgcttctttgactactgctgccaaccttgggaatggattgatgacccacttgcttctcaaacagctctgcagataccacttaggaagctggtgttcgtgttctcagactgaggaggagcagtgtccaaaatcaattacctgggatggtgtgtgctgatccacctagcaatgaactcagatctttggagcttgtttataacacgtacattgctcaacataccctggttctaagatcagtgatgctatttcagagcacaatggggataatacattttacatttatttaatgtgaattttggaaaaatttgattaaaaatgccacctttggcttttttaaataaagaaaatcacaataaaggatagaaagtaattaatgatttttaaaactggttaaccatatacaaaaatcaactcaagatgtattaaagactgacattgtaagtccccaatctataaaactcctaagaccttggtggaaggatctccatttcttggtgggaatgtaacttggtgcagccactgtggagagcaacatggagatttctcaaaggactaaaaatagaattacaatttgacccaggaataccattactgggtatatacccagaggaaaataaattgttctactaaaaagacacatgcactcatacgtttatcacagcactattcacaatagcaaagacgtggaatcaacctaggtacccatcaatggtgaattgggtaaagaaaatgtacatatacagcatgcaatattcacagccataaaaaggaatggaatcatatcctttgcagcaacgtggatgcagctggaggacattaccctacgtaaactcacacaggaacagaaaaccaaatactgcatgtactcacttatacatgagagttaaggcttgggaacacatggacataaagatgagaacaagagacactaggaactccaaaagaaggagggagaaaagaggacaaggactgaaagactttctattgggtactatgctcagtgtctaggtgttgggatcaatagaagcctaaacctcagcaacacgcaattatacccttgcaacaaacctgcacatgtaccccctgaatctaaaataaaaataaaagccaaagaggcaagttattttagtgattttaaattttctttattatagtcttctatatttttccatatttctataatgagcatagtgttgtagttagcaatagatggaaactttatcagaaaaagaagaaaatcatcacaaccatcaacaaacttacctgggtaatttctgtcctgttctcttacgaaagttgcaaaaataaaaaagacaatttcttgctcatttagaatgtacactgtgctttataatacatatggccactaccaatttcttgcaagtgttttttttagactctgggaatatagtggatgggttgagagaaaaggtaccatttgttaaagagaaaacagtattagactagaaattggggtaggatacagttctttatctttatcaatgatatagccttgaacaactcccttaacatcatagcatgtgttttgttaacgtaagacgggcccgataaagtatctcccatctgccagacaggatgactggaaagaagtataaatattttgtaagctgtaaggtgctctatctatgtaagttgtttttgaggcgattattcttagtaataaataaaatactgcttagaaactcaacgtggacagtcttggtctagggacctacttattgtgcaattggcaaaggggcccttctgagatgatgcataggcagacagtttagatacaaataactagaaatggtcaaactgtaatatctgtcctttcccaccttttacatctcaaaaagcagttttcatgtttcatagtaataagggcttttacatctataaattccctttcaaacgcctacatctctcaacaaatttgctaccaccgcaatttattttttaggtggttttattcagatgaaaatagtttatttgagcactttggagttgctgtttgagaatgctatatgagtattaaatactgtattatatttctgatgctctttaaagattttcttttctgtctgcaatttaattttgtttttagaggttttttctcctcctcttctcatattgattttatttttggcgctattaaaaagtgctcaatgaacaacctttttggaatgaatgtaaataagtctgtatctctatgtatatgaatatttttaagtgcattaacttttagtataagacttatgtaatgattaatttgctcctcaaattctaattcttattcaatcaataaccattgttcacaattttaaatacattttattgatttttgaacatttaggtcattagtagtaagatcaatgttagccataattcacctttaaatttccaatgttcaggttattaaaaatcatttgcttttatttccagcataatttatttttaattgaaattcttccttgtgataatttttctttttaaagcaaccatgtcttctttataactgtctgagtgtccaattacattttcttacttatgaaggtttttaatatctaatcatatcttatgtaatcagtgggctattgtgtaaagtaatagttctttttctcccttatttatagggattttactacacacttccttcctccctatttttttctttcctgaacacctttcacctggtattgtgatagttcatttacttgtatgtattgctcactagatggtaaactctgcggggaaaggaatttttttgcatgtcatgttcgctacatcattcctgcatttagcatatgcctaacaaatagtagtctagcaagtattttaaatggattaattaaggaactctaaactacaagacaccaaggaacagatgttcagataaatacataaagatataatctacatgacaatgaaaaggttatgttaaaagtaaaaccctgaagtgcattagaataaatatttaaaaatactatccaggacatataacagttgctatttttctatttaatgaggtatattttggatcccagtcagcaaacaactctctctaccaaaagtagctgactatagcccagcctgtctttgcagttcatggcagaagaagagcagagaacacacagggctcaggtccagagttagctcagagaaaacagaaaatccaatctcagcacagtaaacatgtaggaattcagcatctcatagaggttactgaaagcaaagaatcaaaaataataaatggttataaatagtccatgctctcagagaactttgagtgcataaacaaaacctataaatcttcagcaaatgaaaataaggctctggttaataaaacaaaacaaaacagaaatggcctagtgtaattgttaagaagaggagaaaaacataccccaaagaattcagtatgtagttggtgaattcagagcaaacaaaaatggaaaattacaccttctcagccacacaaaagaaaagacttctaaggatttaaattaagagtatcacagtgaggaggaaggaggagttgattattgggcaaaatattttgcctctatcaaggcttgagctcatgagtaaaaggtgtgcgaggcctccttccatagtgtgcattcagtccttctcaaagaatccattcatttccacattaaattctcaagtaaagaaatcaatcaaacaaaaaaactcccacatgtgttattatagtttctacctggactatgtggacatgtcctgtctgtctatagcagttgcaatgctattgcccagagtggaaaaaaagaaaaagaaaaggagcttcccataaggtttatttctacatgttaaaaactctattgctaaaaccctaccacactagcttaggaatcacatttttagtaaatgtcaccaacattttaaaaatttggggccatttttatcctctaagaaatctcgaagagatccagaattcatgtatttaaaatttgtctcatataacaaataaaagaaaaataaagacaatgaacagcttcacagacaaaaaaagaaagatactccaggtaaagccaaaacaatacaactttctaaaaataatatagaaaaacagctttatgacttgaaaataacactagccattagttattagtattagattgcaaaaatagctacaaatgtctctccttcctgaatctatgcccttgggcagtccacttccatatctatgctgggcttggccctgtgcctgtctttgaccaatcacaaattgctgcaatcaaaggcctcgaaagcactaggtcattgaggtttgccctcttttgctgctctcaggacatcatcttaccactgccatatgaaaaagcacaggttagttttcctggctgccaacctgccaactattagatatttatgagacatcatcctagatcatccaggctccagctgatgtagctcagatattagctgagccatcaaaagcagaactgtaaatcatgagctgaatcaatgtttgttgtatttagttcctatatatgggaagggtttgttatacagcaaaagctaactttgtagaaattggtacctagaaacggggtgctattataactaaacttaaaacacagtcatgtatcacttaatgatggagatactttctgagaaataggtcattaggtgacttccattttgtgcaaatataagaaagtatacttacacaaacctagatggtacaccctagtacacatctaggctatatggtataaacttttgcttctagactgcaaacttgtactgcatgtaactgtaactgaacactataggtagttgtcacaaaatggtaagtatttgtgtatttatacgtatctaaacataggaaaagtacaataaaaatgtgatataaacaataaaaaatggtatccttgcacttaccatgaatgggaattgctctgggtgaatcaacaaatgaatagtgagtgaatgtgaaggcctaggacattgctgtacactactgtagaatttataagtaggctaccctaaatttatttaaaaaatatatatcttcaataacaaatttaactttaggttactgtgacttttcaaactttacaaacattttaatttttaaaagcatttaaactcttgtaataacacagcttaaaacacattgtacagttgtacaaaaatattttctttcctcaattttataagctttcttaatttttaattttttttttttactttttaaacttttttgttaaaaaccataacataaacaccctcattggcctaggcctacacagaatcaggatccctattatgactgtcttccacttccacatcttgtcccactggaagaccttctagggaaataacttattcaaaagaagttgacaaagccataagaaaactgatttagctggctggaaaaagggaaaaatggtcacctgcagtaagttggagaatagacaacatgtcaaatgaacctacagaccttgacaagttggtttgtaggcagaattttccaagtgccatttggattattttgttgcctaagataaaggaagaaaagagagagagagagattagccaaagaaagatggcttattttgcaagtagaattcagaaagaataaggagggacaagaacttgctaggttggaaaataaatctattgctcatccccaatcttctgtttctaaaatattctaaaataaagtatgttctggggccagatgaaaagacatgttacatatacaaggcaaactataaagatgacagtagttttttcatcataaataatgcaagttagaagacaatagaacaaaatctttccaaatactgaaagaataaaaatatcaaactaaaattccttatccagtaaagatatatttcaaaaacaaagacaaaatagacatttttagatgtcaacagctgaaagacataacttactacaagaaatgttgaaaaaagtcattcaagcagcagaaaactgatgtcagtagaagcctagttctacacaaagaatgaagagcaatgaaagtagtaatcacatgagtaaataaaatatttgtctttattatttaaatatccttaagagataaccaattatttaaagcaaaaataatgatgatttgagtttttatcatatataaacataaaatgtatgaaaccaatcatacaaaaaccaggaacaaagaaatggaagtacactcttgtaagatattttttttgcacatgaagaaatataatatcatttaatgacagactgtgaaaagttaaagatgtttgctataaaccctaaagcaaacgctaaaataaaacaatcaaactttataattaatgtgatgcttaagtttatatgttaagtttatatgttaacttggctgggacataatatctagatatttggtcatactctattctagctgttctctgaaggtattcttgaatgggattaacatctaaatctttgagtaaagtagactgccttccataatatgagagttcatccaatcaattgaaagccttaagaaacagattgacctctcctgagagagaagaaattctgccataaactgtctttggatgtgaaccacaacaattgccaccccaccagtctaccctgcccatattggacctactaacctcacagacatgtaaatcagttccttaaaataaacttctatatatacatctatacacgttattgattgtttctctggagaaggctgactaatactactaataaaaatcaagatagaggctgggtgcaatggctcacgcctataatcccagcactttgagaagctgaggcaggcggatcatctgaagtcaggagtttgagaccagcctggccaacatggtgaaactctgtctctactaaaaatacaaaaattagctgagtgtggtggagggcacctgtaatcccagctacttgggaggctgaggcaggagaattgcttgaacccgggggcagaggttgcagtgaaccgagattgcactccagcctgggcaacagaacgagactccatctcaaaaaaacaaaaacaaaacaaaacccaaagcaaacaacaacaacaaaaacaaatagcaatgcaacatatgtaaacccaaccatatcaataattatctcatatgccaatgggataaatgccacaaataaaaggcaatgattgtcagactgataaaaagcaagagctaattatatgctaccaacctactttaaatatagagataaaaatatgttaaaaggctgaaaacattaaaccactctgtgttagtcaaaagacagttgaagtggcaaacattagacaaaatagatttcaaagcaaaaatattgtccataatgaagatatttcttaataaattcaagagcacagaataatcttaaatatttatagatctaataatatagattaaacatatatgaagcaaaatatgataaaattacaaagagaaatagatgcatcaaaatagagtcagaaatttcaacttccttatcacaatgtttgatagaattttagaaataaattcagtggtttataggacacttgagcagtactatccaccaacttgaatgaaataacccaaatgttgttgaggatgtaaacaaactaaaactttcatgtacatctaatgaaaagaaaaactagtagaagtatctcatagaatagttggcaatatcttaaaaagttaaaaaatataccaaccctgtgatttagacattgaaaatatacacatttacccaggggaaaagatagtaagtatttatacaaaaacctgtacatgaatgttaacagcagcattatttgtaacatctttaaactagaatcgtcctaaatgtccatttacaggtgaatggataaacaaattgttgtatatacctataatggaatagtactcagcaacacaaagaaatgaacaacagtgatacataaaacaacatgaatgaatctcaaaggattaagactaagtgaaacattcatattcttattttataaaattttagaaactgcaaattagtcatgctgagacaatgtagatcaatggctgtctgtgaatgagattggcaaggaagggaactaaggaaagattagaaacacaagggaatatttaacagtgatggatgttttattattttgattgtattgatgatttcatgaatgggtatattcatatgtaaaaactttcaaggtgtatactttaaagatgtgtggtttactgcagcagtccccaacctttgtggcaccagggaccagttttgtggaagacactttttccacggatggggtgggatgcttttgggatgattcaaccacattacatttatggtgtacttgatttctcttattattacattgtaatatataatgaaataattacacaactcaccataatgtagaatcagtgggagccctgagcttgttttcctgcaactagatgatcccatctgagggtgatgggagatagtgacagatcatcaggtactagattctcataaggagcacacaacctagatccctcatgatatggtttggctgtgtccccacccaaatctcatcttgaactgtaactcccacaattcccatgtgttgtgggagggacccagtgggaggtaattgagtcatgggagtgaatctttctcatgttgttctcataatagtgaataagtctcatgagatctgatggttttaaaaagtagatttcccctgcacaaagtctctctctttgcctgttgtcatccatgtaagacgtaacttgctcctccttgccttctgccatgattgtgaggcctccccacccatgtggaagtgtgagcccattaaacctctttttcttcccagtctcgggtatatctttatcagcaatgtgaagatggactgatacacctcacatgagcagttcacagtagggttcatgctcctatgagaatctaatgctgctgctgatttgataggagtcggagctcaggcagtaatgtgagcaattggaagtggctataaatacagctgaagctttgcttgcttgctggccactcacctcctgctgggtggcctggttcccagcaagctgtagaccagtatcagtcagttgtggcccaggagttggggacccctggcttactgtatgttaattatacctcaataaacttaataaaattatgtactctataattccacttatataaaagtaaatacagccaatagtaaactatattgtttatggatgcaaactttggatattgaactgtaaatcaaagcaaagtagggataaccttgaaagttaggatactgaataactctaagatggatggaaagatttatcattgggaataacatctggattctagtgaagttctatttctcgatctctgtgtgggttatgcgatatttgcctaacaaaaaattgtttaagctgcacctgtattcatgttgcataggcatataagtgtggcttagggcattcagagcagtctttacatgatctaacaacacaacactgacctgcacattctctaagtgggacatctgagtttcatttctttgaaatgttctttaaaatttttgagaaaaaggtgttaacaattctgccacaaagattaagactggatttggttaatcttcaggaaagcagaaacttgtttgtaactacttgaaaatccctttctggtatttgagctttgtgggacttttgcagtaatttacagcttgattttaaccgggttgaactttaatttaaccagttgattgtggcaagttatgataaacagcatgaaaaagaaaaaacaatttctttcataactgataatgtacacatgctgaggagaaagtgggactctgaattcttttggtgatcagccattaaatcataaagaagaggtgtcttctttatgggaagatagaatagaagcaagatcttcttaggtatgtgatcctgggcagatgactttattatacttctgtgaaatggtgcctcagcaaccacttatattttggctgtgaaaatcaagtggctataaatgtattaaaatacatccgaagcctatagccctaaataatgtagcaactctcaagttgcttttattaatatcagttttcatagttttcattctaatttgtcatagttttcattctaatttgtttgctgatttcttatcattattctcagtaatgcagtctttctctgaatcatagttagtattcttgacccagtgactcaagtcagcatgtctaatttcttaaatctgaattgtctgcaagatttcatcttgattctatcttttgggttgcgctcaagccagtgtaccaatttcacaatatctgctaattggtacattgttgcctaccatctttaaaatagcctgctctataactctagtttttttaaggaaatcaaaacaatgccattattataaaagttaatgacatagcaataacagatctattgtcacagtgcttatccactgcaagtgtccaatatatcttactaatttttcagagtttagtatttccactgttgaagttctttttatttttcataagatggttcacaatggacacagggctcaacattacagaagaaattgtatcagtctttaacatcttatccataaataatggcattgtaaatacacacacacacgtcaattataattgatataccctcatgcaaaagcattattaaaatctacaatattgatataataataccacctacatcattgagttctgaaaattcaatgagtgcatacatgcagaaagtttaaaataaagactaggaaaatgtgtcggatgttttcttctttgatcttaaagacagagataaaatgtacatattttcttagtcgaaatctaacttagtatatatctattaagttaatatttactctgactctcaaacattctgaatctcttagtggccaatcacttgtctaatgccacccagttggaaggagctaaaattgcttttttgttttttatttgcttgtttgttttttgagacagggtctcactctgttgcccgggctggagtgcgctggtgtgatcacagaactggtttttaaccacgttttgggtaataatacttcacaagaatgctggatgattaaatgaagtagtgtgtgtaatgtgttggctcattggacagaacactgggtgctgagggatcatataggagtctgactctgcctaactcttcaccttgtttaataataacactctggaaagctcatttatctatacatgcctttaaaagcagacaaagcatttttattgcttttttttttttttttaccacttccatggcctaaaagaatcacttttgttttgaagactctaatttgcagagtaaacaaaaaagatggaaataactaagaaataaaacctccaaaagtttaggaccccaaataaaaatcatttgaaatgcataaaaatgcataaaataggtacaatgaatagtaatagatggaaaaaaacagattccatcataggtttgttacttgaatactaaactttttcaataattagctgttataatatccgtgttcaaaaacacagcactcagtgcagatcaaaattctaaaataaacaacagttactttccattttctcttgagtaagttatgagattacctctattgctctaatctagaagatatgaaaacaggccctccggccctaactgactctgtgttgtgtaataatatttcccttcaccaacctttacaatgaatataaaaattcaatttcagacctacaagctagaaagggctcaagtgtcaccagacttttctaaggggatattttctgtttttgtctacatttatatttgactcatttagtggagggaggtaataggatttttctatctgctatagaagctatttcagaagtacacagatataaggtcagaaaatatattttaaaatcacaaaagaaaacaaaatgatatgttggttttgaaccctagggtctttcaacattataatcaagcatgcctgagaatatctagctgtgacttcagagagaataatagtacacccttgagtctactgcaacagtcttccatggtatggtaggaaaagaatcctaggatagctcccaagacttacaagatacacacctcctggtgtgtatgccctgcataatctctgggaatgtgaatttaatggattttcctctgcgattaagtaaagctatgtacactatacagttgatcttaagacagagaatttatccaggtgggtgcgacttaatcacatgagacctttaaaagtagagcattttatctggctgactgaagaagaggaaaccagaaacggaaagcaggaaaagaatttgcatcactcttgttggtttaaaggtagaggggatagagagcaaggaaagtgtgcagtactccaggagctaagagcagtccctggctgtgggtcggcagggaattaggaaactcagtaatatagccacagtcaactgaaatttgccaggaagaatgatcttagacgtggattttcctccaaagtctgcagaaaagaactcagctttgcctatacctggattttggttttgcagtttctttggaagataacacagtgatggtgtgctggacttgacctacacaattgttagctagtaaatcagtgtttttagcctctaagttggtgataatttgctacgcagcaatagaaaacaaattcacatggcttggatcctacccaaatagtttttattatttcattaattcatttgttcatctctatatttatttctgaacacattcattaagtgcctatcatgtcccttctctaatcgttatgacgagtttttaacatacaagacaattttatgaccctcaccttaaagactatgttatcaggatactggaatgtaacattatttactgttcctaaacattatcaaatacacatactgcagatactctgaaagttgtgaaagctttaaataattcagtatgcagttttgtggctcatatagaaagcttgatgggccttgtgaaaagctgtaggcattgcccatgtctaaaggataaaagcggtagatgacagtactccatgtaattattttggctgtctcacaggcttattgaaatttccttggagtgacatcaacaagatggctatctagaagctcctagcatccttctttctaccacacacacacacacagacacacacatacacacacacacacagacacacaaaaaagctatgaataatcaagtactttttgaccaaaataactaaaggagagctctagagaatagcaaagaagcagcagaaatcctgtagagcatagaaacccaggatggctgcatagggaagggaaaaagatacctcgcctccgccactccatcccctcagttggaatcagctcagaaccagggaggactcctttctgcagggaaaaataaagacgaccccagcaattctgattgccactgcagacacctgcagcctttgttatcagagactcctacagtcctcacaagctctaaactcaactgagagagctccctagagtcacatgctgagctatattcagagaaggtgacaacactgtgccctggcctcacttctccccactgccccctgtcccctatcctattgcctgtactgctactgcactacaccattttggaaccagagacactactagagtgcatcctgctctgggggtgaaacccattgcaccaccctccattcctgagagtttgctgctattgcaacatgcacactccatagtgtgccatacctgagccaagctgctactgtgccctactccctagggccaatctactatatagctgctccatcctgcccattctagttgctggggcacctccacttaaggccaacatccagtgatggtctgccagcaggggatttcagatattctgcacaccagagctatcaactgcacctcaccttctagcaccacaggtgaggcagcttcctgaacctagagactctaataactctggcataccagactagttgtttgccccagcatcacagctgatacagtgccctgctccccaggcatctggcagccccactaacccacatagccatgctttctggagctgagaagacatagtacctgaagtcccaggaaatcacaggagctgtgccactaccatctccaggacaaagagccacagttcctgcatacctgtaactggactaacctccacccatctgagctggtgagatgtcccacctttccagggaatgaagtcattgctgtgctgctccaccaccctcaatcccaggcccaagccacagtggtgccttgccattcctgagtacttgctgttactgtacccaggctcacagagcctgggcttctgtcatgtcccaccatcccagggtccaaactccacactatgtgctatctcatccctcagatcctgagctgcttctatgtcctgttggttccaggatctgaattgtagctgtgcactgttccgtgaggatttagtctctggaaaatcccttcttctccagagctgcaccagtgctgtaccctgtttcccagggtcagaacatagctatattacagcctcctgggtttaagctgctagagtttgtctcaaagcaatagatcccagctttttgggagaactgcatccacttgtgcctgggaatgtgaacctgtgtctcaagtcccaggtgttacagtaatttcacaggacgccccactgtgggggaagataagaacagaatgattcccaaagttcttgccataataacatacatagccaccattattgccacaaattcctgtagcctagaccaccaaggtaccaaggtatgtcagtcatcactgacactgatcacaattgaagaagctgcatacagactgtatcactgggcccacacagaactacagccactgcactttgcccaaccagtaccctcaggcccaccttcggtgaaagcctacaaaagctactctgtaaagtttggaagaggtaactacacaatcagatgtgcagacatcaatgcaggaacacaagaaacacagaaaacaaggaaacatgacatcaccaaaggagcacaataattctccagtaactgaccccaatgaaatggaaatttacaaattgcctgaagaggaattcataataatattctttattattaacaagacacaagagaatacacataggcgattcaatgaaatcaggaatataattcattatctgaatgagaaattcaacagagagatataataaaaaagaacagaaatcttatagctagtgaatttaatcaataaaataaagtttaaaaatacaatagaaagcttcaatagcagactagagcaaacaaaggaaagattctgtgaacttgaagataggtcatttgtgacttggtctgacttagaggaaacaaaagaaaaaggaatgaaaaagagtgaagatattctttgggacttatgggatatcattaagcaaataaatatttgcattatgagattttcaggacaagagattaaaaaagggacaaaaatgcttatttaataaaatagtggctgacaatttcccattttgggagagatatggacattcagattcacttagctccaaggtccccaaacatatataacccaaagaggttctctcaaaggcacattatagtaaaactgtcaaaacttaaagacaaagaattttaaaagcagcaagagaaaacatcaagtcacatacaagggaatctccattagaatatatcagtagatttctcaacagaaactttgcagacaaggagacaattggatgatatattcaacatgctgaaagaaaaacctttcagctatggctgttatacccggcagagctatccctcagaaataaaagaggcataaaatattatccagacaagcaaaagctaaatccatcaccactagacccatcctaaaagaagtgcttaaggaagtttttcaaaaaaaaaaaaagaaaagaaaaaaggcattataattactgtcataagtatatatgcaactataaaactcactagtggaagaaaatgcatagtcaagttcagaatactccagtactataatggtggtatgtaaattatacatctgcttagtatgaagattaaaagtcaaaatggtcaaaataactacagcactacagctacaataagttgttaagaaatatacaatatgaaaagatgtgtgacatcaaaaacataagttatagggggtggagagtaaaagtctagagtttttgtatgtgatagaagttaagctgttatcagcttaaaatagctgattaaaactataagatgttttatgtaagcctcatggtaactgcaaaacaaaaaacatggcagatatacaaacaataaaaagaaaggaataaaagcttaatactacagaaaattataccacaatgatagacaacaagagaggaagaaaggatcgacagagctacaaaacaactggaaaagaaataataaaatgacagtaagtccttacctctaaatgataacctagaatgtaaatagattcaatcctttaataaaaagatggagtggctgaatggataaagatacaatccaattacatgccgcttgtaagagacccataaaagacacatgtaactaaaagagagcaagagtggctacagttatgtttgataaatcagacttcaattaaaaaaactatcagaagagacaaagaaggtaattatttaatgatatagtggtctgacaatcaagaagacttaaaaattgcatatacatattgcatatatatatgctatatatatgctatatatatgctatatatgctatatatatgctatatatatgctatatatgctatatatatgctatatatatgctatatatatatgctacatatatgctatacatatgctacatatatgctatatatatgctacatatatgctatatatatgctatatatatatgcaatatatatatgcaatatatatatatgcacacacacacacgtctccaacattggaacacctgaatacacaatgtaaatagttataaacctgaagagcaaaatagaaatacaataatagtagggaactttaatactcttttcagtaatgaatagatcaaccagatagaaaataaatgaggatataatggactcaaattgcacttttgaccaaatggaccaaacagacatatacaaaactgtccatctaatagctgcagaatacacaacttttttcacacatggaacattctccaagatagaccatattttaggccacaaaacaaggttttaaaaatttaagaatatcgaaatcatacctagtattgtttcagaccacagtagaaattagtaaccaagggaatcttgaaaaattaacaaaaaacgttgttgtggaaattaaacaacatgcttaaacaacaaatgggttgaagaataaatcaaaagagaaattttaaaaatatcttgaagccgagcgtggtggctcacgcctgtaatccggcagtttgggaggccgaggcgggcggaccacgaggtcaggaggatcaagaccaccctggctaacacagtgaaaccccgtctctactaaaaatacaaaaaatttgccgggcgtggtggcaggcacctgtagtcccagctgctcaggaggctgaggcaggagaatggcgtgaatctgggaggcgtagcatgcagtgagcagagatcgctccactgcactccagcctgggctacagagtgagactctgcctcaaaaaaaaaaaaaaaaaaaaaaaatcttgagataaatgacaatgaaattacaacataccaaaacctatgggatgcagccaaaccatttctaagaggaaaatttattgcaataaatgcctacattaaaaaaagaagaaagatctcaaatagatagtctaacattatacctaaaggaactagaaaaagaagaagctacaccaacgattagcagaaggaaaggaataataaaaatcagaagtgaaataaataaaatagccacgtgcagtggctcacacctattattgcagtgggtcatacctataattctagtactttgggaggctaaggtgggtggaatgccctgagctcaggagttcaagaccagcctggggaacatggcaaaacctcatctttaccaaaaaaaaaaaaaaaaaaaaaaaaaaaaaaaaaaaaattagctgggtgtggtgtcatgtgcctgtagtcccagctacttgggagattgaggttgggaggatcacttgagcctgggaggtggaggctgccgtaagctgagattgtgttgcttcactccagcctgggcaacagagtgggaccctatctcaatgaaagagaaagaaagagagaaagagagggagagagagagagaaagagagagagagagagagagagagaggaaggaaggaaggaaggaaggaaggaaagaaggaaggaaggacggaaaatagagaacagaaaaaccatagaaagaatcgagaatatatttttgaaaacaacaaattcaatatggaggccatttgatttatgagaaaaaggaggaaattctaggaccatgctgaatgggctctgatgttgagtctgccattttctagctgtgtgactctaagcaagttatttaatatctaagccttatctataaactaaggatagtgattacttaattcccaaagtagttgtgatgatcaaatgatataaattcagtaaaatattaaaagtgatggggtaggatagtaactcaagtgtaatagtgatagtgatactaacggtgactaatattagtgagcaaacatgatgttcccaagactgcacaaattattttccatgctttatctctcatttcctatggtaagtgcatcagataggtactgttattttacccattttgcagataaaaaccaaggcacacagtaatccagtaatttgctcatggtcatgtaaataaatttgaacccaatttcttgttagcactctcttctccttataatgttctttttatcccttcagtaaaaataagtaaaaatattaatgtgtatgttttaccacactgctgtactttagcatacagtagacattgtgaacattttaaggtcataggctgaatttccttcatagaaaagaaagattactttctttcatatatatattctatatagctctttttcttctaaaaccacatatctacaaccagcttggaatatccttacctaatatctttgtttctttttctcctccttctcaaaatctttttctctactagctctttcttcattgtttattaaacatttcttgcccttaagaaagcaccttttgttatactctctttctacttgattgggtgtgtattaatcagtacatactaggttgctagtgtcagaaacttaatgtaacttaggaaaagtagaaatgtatttatttacggaataaaacaattaacaagaagagcaggtctatagttggataacggaaacaactggatcaaaatatatgaaagtcatagggaatggaaacctcatctctacctttttctgatactcgatttaattttctctgattgcagaccagcttcctctgtgtggtggtaaatctaactgacacaattctagagcctcataaatgaacagtttcttctaatggcaggagcagagtcgtgattctggttccaaaatttcccaagaagggttctgattggtctgatttgggtctgtatcccacatgcttgctgacaagtaggtagtggtaggtcaggtaaaatccatttagctcctactaaaggcatgaggatggagaatgtaggcaaaaggaagttttcagacatcaggaaaatactaagcagaaaatatcatagatgcttccttttttttttttttttttttttttttttttaaagaggcagggtctttctgtgttgctcagactgctcttgaactcctggagtaaagagatcttcccacctgggattcccaaagtgctagtattacaggaataagccactgcacctttctgccttctcctcttaaagttgctgttccctttaatactcttcttctattgactaaattttgccaagctttgtaactgttctgagaaatttctttgaatattatacttgtcatctgttatctcttcaccagatatttttctgtctttttttcttatatagaatttgaggtttgggttggatatttgaatatagcaatatttgaccatatttatgagaaattacttgaaactttctgctacattcagcatagagaagagttggtttataaagcatctggcttattggagaaattttttccttcagtttctttcccaataaatgccatttctgctaactcttgattagactacaaactgatctctgtaatacacagacaagtcctataaatctgtctttaatggttctcattcaattaaagtcttttcattgcttaaatctttctttcctcagagtagtagaaaaatttcaaactgaacggatttcaatttcatctccttacctggttcaatagtggtattttgaggttggctggctgctcaaaagaaatttttgttcttgaagtcatgtaaatgtactagggtatgtttaatgttgaccatatgagtcagtttttcctaaggcatgctgtgctttgacaatatatagattcaaatcatctactatttcaagaatttgaaatactactatttctgaattatgtttttaaataataattctgttccattatttctagtttcctttgggggggctttctttaatatattctttgcctgttctacattttaattactttttccgtctaataactttttaaaaatgagtttctttattgtcactttgttttgttgccttttaagtcctctatgcaccttgctgtatttttccttccttatatgtcttctaattttgcctttaccttttttgagttttatttcttttacttttatttcctgagatctgctagtttccatttcatgcatattgctgtttcaccatctctcttgtgtgcttttttatttctgtactatgttcttgctttacagaggcaactacttcaatgcattttactcatttgttttaaaatttatcacaaaatatttgaccatagttttcatctattttgttgcaacttgttttcttttcaggatactttgccatttgaccttcttatttttttttaatttattttccattatattattatatagatcctgttcttccttgcttcttgttttactgcttattatcaaaggacatgaattttccccactagctatttgtaagcagtttatatagggtgggttgggaggtaaaacagaaccatgcttagggctaaaaattactcaatatgaactaaaaatctgaaaaacctgaaaatactcactataagaaaacaatttcaaaagatattaaatatctgtaaaaagttttcaaagatatctggtttggtgagttagtgtttccaattatgttagtaagcagcagaactgggttttgaaacaaggggtatggatgtggattctgcaatgtttacccaggtataagaccaaatgaaactagcaagttaaacataaacaaaatgacagagccaattgatatccaactagtaacattcatttaatctgataaattctgctgttttgctgaaatgaaattgcccttcataaggtgaatatagatgagaattctgctccatatggaataaactcacatcattgtgagtttatatggttctgtcatcactgtgggctgtgtgctgagttaattctctcaccattttttaaacaactgtgaaaccttcctttgtagagttgcctttatgacatttatgacatttggccaagtcatttagaccaagtatgtcatttacacttatactttggtcatttagaccaaatatgtcatttacacgtaatgttagtcttctttattttctcattagctcatgtcagtataaatggaactacttgacaccaacataaacattagtgcaaagacaagtgtgaagaccctgtaatcacatggcacttttcagaaatatgaggtcatccagtgattctacaagaggggttggcaaactgcagcttgtaggccacatccagtttacccctatttccataagacccatgagttgagaatagtttttacaattttaattgttaaaaaaaaagaatatgcctcagagacatgtgtacttctcaaagtctaaaatacttagtatctggccctttaaaagaaaaaggctgctgatccctgtcctagaatatacttatgtcatttttaaaaatggttattatgagatgaaagcacaaaatgaaaagcatcttttagaaagcttcaggatacttgggaatactttttcagaaagcagggaagaaaacacatttctacctactgaaaaatgtgctcagtaactcatccccaatatttgtgagttaaaagcacaaacagaccattacgtgggagaggcacaacaattcttggcactaagattaaatagaaatcactcccaggattgtcataaagaagacactatggaagataacgatgtcttcactggcgcacctacagtacatctaacaagtttcacagggcccttttaaaagacaatttaaaatatagcctgatgacaacattcctaaaaacaatgtagtgaaggcagttttagagaacttgagagtatgggtcagagattttcatttctattaatctgactccatgcaaggctagattgtagactctggacatatgaagaaactggaaacccttaggacaaatctcttttttggtaaaactgttgaatatatgagtagataccctgctacacaactaaaggtcagcttttctatgttgccagctgaattcatcatacccatttcacattatcattacagaagagcgtgacaatgcaaaattctggagataagatcaaacatatgaataacaacatttaaggatgccatgaaggctatttgagacaggtcctctgtccatgtgatgcaaaaatgacagaggacacatcagacataatttgtcacaacccaatgacattcatgtcagtaggtgctgagatgtaatctgtcatgttttagttagaggaaactgtatgtagctcttttgatggattgataagtagattcatccatccttatactttgaaagaacataattattcataattatttgcatgtagttatttataaacacaaccctttacattttatcagtaaatgtcaagagttgcctcactcggtgcactttatgctagtttagctaatttgcttaaattgggatgcccagagcccaagtatatcctcttgtgtcctgggaaacccacccttgccctttgttaaaggagtagcagttccatacgctggatggattgaggaatttcccattattgattaaaggtcaactatactctgggttctattaaataggtacacatgaaattaattaagatgaactagttaagacaggttcaccatttggagccactctcccccatctccacctcatcatgcaaatcttttttatggaagctctattcagcttagatatttaaatcagctctcagtaacttatctaccataaccgtttacttagttgtcctctctcactctcagcaaaatcaatgagctaaaaagattaggaaccatcattctttgtatttccagcacccagcccagtgatggtgtgaggacacatctgttactccacaccttctattctcagcacaccttaagctaaaacaacttgtgtttctggcacagctatcggagactttcagaggtgacaaactcatgctcatttatttagttgcctaatttctccagtgtcagtaataatctatattcttagcaaatcattgggaattggaaaccactctgacagattaaggccaggaaattttttaaagaagaaatgcaagaactggaaattacatatgtgaccttgtgccattcagcctgtgaatggtgtgtgggcttaaaaggttgttagggttgggatggtagaatatgtagagcttttggagaatgttttttgttactgttgtttgacctacttcattcccttcagactccgagaggtcataacacacgatataaagtgcaaggttaataatggagaatgtcgcattcaggagtttctctgcctagatgtggaattctggcttataggctatttctttctgtgtgtctctttctcttcactcttgaaataagttaagaaattctcaacgactggaatatatgttttccaccttttctggccatcaactgcgttatcaggatgaatgtcaattactgtcattctggaagtcatagggtgcattatcctgttttcctattataggggtatttgagtaataaacttactctcttgtaatatcatataaaattttattttaactgacatctaaaagcacgaaacctcttaaagtttggcttgccccatggaggtgaatgcagctgcagctcatctcaggagtctgcccttatatgaactgcttgttcttacctttctactcctcagcatgttgaaactcagaccacactcctaaatgagacatccaaaggctccggcctgctggagtgctgacaagcatgctgtttagggcaggtactcagaggcaaagtcagagaaacatgatctcttcagcagcacgtttttgcacatgaaacctgtgtaaactcagcatgactcactcaggccaaggtgagcactctgatgtctgtgaacgactgcagcaacttggcaactggggccagtgtgcttccctgtagcactcagcagagacagttcaggacttgaaacaattttcctcattgctgttgtcactggagaacaaaaactgcaaaagcgagccattgttcacactgaaagtcattttgtggagaaaatgagaggcttggaccagtctttttgtcctttattgtatcgtcccctctggcatccatttatgggtctgatttcatttctattttcattttgagacttttctctatgacctcaggtcagagacaatatcaaaggcaatatgttttagtgggtttatttgtctgagtcaacagaaaaagagagagggaagggaaatggaagagtacagggcaggggggaggaaggggggagagagagagagagacagagagagaccaactgagactaaagctatgtctgtatgaaaagatgactatagttggatctggaattctgaatttgcaactaacactgatgccatttacaatgtaacaatcagctttagtcttccatgtgaatgtagatattatatcatcatctcataacattttattccatatacatggtcaccaagatgaacagaaagagttagatctgggtggtgagaactgggagaaaaccagccatgagaataagatggattgtcttttgtcacagaaatagcaaatttttaagtgtatttgaaatgataaatacttttttttaaccttttgtaacatttcacaaaacttttaaatcaaatttcaactggaactttggtctgctttccttaaatgcagctgatttcttgctaaattccattgcatttgatgccttcagggatttgggaagttagcgtactgggacagaggcattgatgatacatatgacgtggacaaaggaaatgaactcagcatatgtgggaagtatagcaagtgttcacttgtggccagtgtcaccaaaaatgccaccaaggtaactcaacatagtcaaagtaatgaggcagaattgttcttcagttaacttgttaatagggaaactttttataagcctaactggtctagtgatatttggtccagttctcaaacctatcttagaggcttccctgtctcatttccatagggaaaaaactccctatccaattattaaatggataaataagtgcttaaaacgtgaaaaatagggaaattcatgctatttgaactagtttttgcttaagtatgatatggccatggcaccaaacttcagtgtgtatttaggatcaccttagatgcatgttgaaactatacacatacagcctaagctaatcctaatgaacctgcttaagttggtcttgagtgtggcctaggaatttcattgtaaacaagtatcccagatgattctgatgcacatagatgcattctgatgtgtgtgtgcatgtgtgtgtgtgtgtgtgtgtgtgcgcgcgcgcacgcgtgcacgccagaggggagataagggaaagatttcaagttaaaaatgggtttgggttactttgtgaaagaagttgaatggcatgctaaggagtttgtgtttttaaataaagaacaaacgtgatcatatctgtactttgagaagtataactctggtgacaggacggtttgaagagggaggggagaggagtcaagaagactagttaagaagtttttcaaaagatgagcacttccgccaaattcttcatcacacattgtacaggtaataaataagacatggttcctttcatgaagttgcttatgatcttgtaggaaaagattcaatgaatgaggcagagatggagaagtcagagaagtggcttggatgggcaggttggggctggacagattttgcagagctttaagaagcaaaggaagagcagattcccagaaaagaatataccctaagagacaggccactaaattaaatgacagtttgatggtgccacttttttcccccactggggtgtctggactctacagacttacataaatgagcagtgagaaaatgtaagtacagattattgattacttttggggacatgtttgcgtaaagaaagacagagctaaaatagcagcttgaagatatcaaaggctaaggaaaggcaatttttgtgttgttttgcttttgttgtgagtctgttgttctttataggggagattggaatatatttccaggaaaaagggaaagaaaatccaaaacctagagaagtgaatgttggtggggcaaagagaaagagagcaggaatgagaccaggagggcaggtgaggtgaagaattcggtattgggaaggaagagaccagaaagctgaagaggatggatggctacacgatacctttgagactgggaggaagcagcaggagaaagagataaagaacaatgagagatatgagttagacactgggatatgagttagacactagtcacatttcaccaagggaagagtccaagcttaaacatatttttcatgtcgcaatatgcttagggaaagctggcccctttccgaatcccggaggatgaacacgtgattgatctaaacacggcatagctatcccattctcttctattggagttcggtttggggatgggcaagtgaccaactttaggccaaatattaaggagatttcttctgagggtacttctgggaagtatttgcttcatgatatatacatttcctcccttgaacttgatagtataaaggcataatgcttgggatgagggaaccatcttggaaccatgaggtgcaaacttaaggacctaagttaaatactaaggataggggaggagaagaaatctgagtctaatgataaccttgagacagtgtggtatctctgggactgcgtacctccaatttcttgtttgtgtgtgagtgtgtgtgtgtgtgtgtgtaatcaaacaataaagaatatatgtatgttctttcttgtttaaatcacaactattttaattttgtgatatttctgttaaaagtatatgtaagtgatgttggaaaaattggtctccatctttttattaaagaggtagtcatgtgcccagaaggatggaggcccacctgtgatttagggttgggatgtgtggaaaatacctgaagctaccattgaagatactgagaatggcaggaagctaatgaaataaatcaaagaaaggcagcataaacagacctcaaataaagtaggactggatgtggacagaatgactttgcaacattgccaaacctcaacaaaggggcaaaaaaggatagagtccttgttgaggagggtttaaaattggataccagaacacagcatcaacccaaagtcaaaggcacaaaggtgtcattgaggggagcaagggcagatttaaatgttttatgaaggagcaaaatcaggattaggattggatagtgcttggacaactcatacaatatgtttttgcctcagttttgtcattgctaaaaagtaaaattaacagctagtgcttaggtttttgtgagggtaaaatgggataatgtataatttattttacatggtatctaacatatttttaagaactcaacaaatgtggtaataattagatcctgaacttctgtcaaagccaggcaggggggcactaaagaagctcacacaacagaaataatgtcaaatataagtgcgacatatatatttttaaaatcagcaagatgtataaacaattctcactattaatactagtaagtttcttcaaagttgaacttaggaaacaggaaaaaattggcacagaacatcctgtgtatcttaccaagataaattccaaataaattgcctgctggcagtacccattaattatttgccgacaatttttcagccagcacatgcttttttatttagctggtccagcaagtcactgcagttgtagttgttcatcttgtcacaggactgggtagaaagccaaatgcagaggtatgagctgccaagtaacccactatctgtgcagctgtggggaggaaccagaaaacctcaagacttcttgctgcttccattttcctagttttttttctctagaacctcatccacatcgtatggtgctgggaagggtcccacagcgtcagtgtcttctatgagtttgttaaaaatgcagactcccaggtcccatcccaggagaactgaaacagaatttgccttttgataagatgtccagatgatttgtttgcacattaatgtttgagaaccactgatatttaggacttatctgaagccacctcacaggataggcagagaatcgctgtttcacccaaaggccctctcatttccttgtcatcccttcatgatgctggatgtggggttcttaagtgagacctcatcttcactaaatctctcattgctgtgcccactgaagccagccttcagttaccagggagcattgccttagaccactttaaccagagagcaacaagctcaaggaaattgtatgaactcaggtgctagacgttcctgggtttattctaggctctgcctcatattagttgacctgggacaaattaactcaactctgtgattgcacctctccctccaagcaagagcctctgcagccctttttcgtaactgttgacccttttctgatggccatcacaggtgggaccaagggagtacactaggggatattagaggaggatccctaatacaagattggccaataagctttgcttcctaggacatctggatttggaaatcagaatccactagttgcctttctcagtgtttgagcaaagaagaattataggacgacctggagaaattatttctcagcaatgggctcagagatacagaaaaaaacaaagacaatatggctgtagaaatatcagtcttcatttctgatagttttctaattttggatcctgctgtctactgaagtctgcattctgcttctgggttccatccctttattcatctaataatttatctctctctctcgcccacactaaattaaattccttaaatccacacagtcctgacaaagcaataagctttaatgaatggtagttaaaatgattattattgctactactggctgatcaacttaatcattattattgtaatgcctcctatatcagctgttttttcattcaaacatagtcactgataattgatcctcaaaatggtaagaaaaccaatcatctgaatcactaggaaaaataaggaaatactattttcatatatgtttatgtattcactattgcattgatgttcaaataattaatttaaaatagaatgatgtctaccataattatagagcacagtggcagctgtcatttaagagcacattttaggcctgaacccctgcaccactgagggaaggaattgtctcagccttcaagcctatcgtgtcccatgttattactcagatatcacaggagacctaactgacatcaggaaggtaaactcagtgacccaggaaacaaaactgttaagttataaaatgatgttaagaatccttgattccacttgctgctgtgggtctcatataatatactcccctccaagcccacagagccttatctcagctggcagcgatctggaaacctacctgttacattaatcaaaacatcttactggaatgctaacttcttgcaaagttccagctcttttcatcaaaaccaattatgtatgaaatgttagacattgtccagtggaagatatatattatcaatattaatgataaaaatcacaactaacatttagacggtagcatgtatcacacccctttgaaaaacgcaacagtattttcagctagtcatcattttctacggttttgtagtgagacatgtgagacttttaagaggtcaaataactttctcaaggttcccagtttgcctgttgcaaattacacttctctgacacatatggatagctctgtccagtgaacactcttagaaacctttaagtaggctgggagtggtagctcatgtctgtaatcccagcacttttggaggccaaggtggatggatcatctgaggtcaggagttcaagaccagcctggccaacatggcgaaactccgtctctactaaaaaaaaatacaaaaattagtcaggcatggtggtgcacacctgtagtcccagctacttggggaggctgaggcaggagaatcacttgaacttgggaggcagaggttccagtgatccgagattgcacccctgcactccagcctgggcaacagagtaagactccatctcaaaaaaaaaaaaaaaaacctttaagtagaaggcagagcctttctcaacatgctacaccattaaaatgtcacatgttccttttttgagaggtagggagaacactttagggagaaattgtctcttcttcagagatgtggctggcaaaaaagcaaagggaagtcgggacactttccaaaaaagcaagctacgtagggcgcagactgcgggcaagacaaaagacctctccagccatcctgaaacattaaacccaatttccttatccccagcaggtatctggcacaactcgcatcattacaattttctagtgtactgagctggggaaatgtttccaaaggaaactgagtagttaccaaaggaagagttgaagacactttgccaattctcttttcttaaggacttagtaactcagactttttaaggtaggaaagattttgccttttgaaaataactagagtttttgctaccttgacaattttaagcaacactgaaagaaccgtggaggttgtataaaccatttgaatttttccgtcatagacctaataatcaggactctggaatggatttcatcttttcttatcaaaagggctgctctcatgctcaatcagctattctgtttcttttcaaaaccgattttgtgttagccatggggagtcaggcagtggattgtctaaatacttttatacagaaacaaaaattcatgcttgatgttcaggtcagttttacagagttgtaatttagaggcattcaagggagtttaatggagaaggaaaccagtcaatattttattcaatccaaacatgaaccaacattattaagtcgaggaatctttctgctgagaaaataatgtcacaaaggttcagtcaatctctgggagaggaaggagggttcataaaagactgcacagtttacatgtgttgtgggaatttaaattttagtaattcttgatgcagaattggacctgtggaattagtcccattttacctccataggaagtgttcaagccagctttctaagcagatttcaaattctgcgtttaattacatttcctaaaacccttagtttgcacacacagcccatgctactctggctccgatgtccttttcagttgctggttggcccttcttcatcaggagccctgttctcgactaaaacccagctccacgctgctcccatcctgctaggcatggtcatgatcatcccaatgcctgcaatgccccctctctgtccagggaatgctttctgatctttaaattcctgaatcaaatatcaccttcccccttttcgctcctcttatgctgcctaacaagcttaattattcttatttctctgttttacctttgctatcaccttattgccatttatcatggtggctcattttaccttttttttttcttttccttgattacaagctctttgaggatcttttttttttttctttcctgcctggtcagtgttcaatacttactgagtgactgaataaatatatatattagataatgcaattactatggattttaaaatctaagatcaaattattacatttgttgtataatcagatattttctttgaaaagttattctttctccaaccagtaactcctctgagcaagtggtgcaagcactgcctaacttcttgagcgtagagtatgaggagaaggagcagttgggtacccacaattgtcaggataccaataatctgaattgtgggtaaaaaaattattctttagagctatgcttttggattcatggcaagttgatgttcacagggttaactgaaaataaatgtctactgctgttgtgcactgtaaattgggtgcaagttatatggcctccactgttcaagatatatgatgagtcgatttctaatgattgcaatacctcatgagataccttacccactcagttttagagataggaaatttgaggttcagaggtgtcaaaatgatgtctccaataccaaatagctaagtaaatgttgaaactaaaaggggagccccctgccaaagacatcctatgagtagcaatagaatagccagaagggcagagtattggggtggtggtggtggtatcagttctcatgattttaacccaaaatgacagtctaagaaggaaagttagcatagaatattctggtagatatcatgaaactcccactccaacttatcagaagaaaagcagcccttttcagaagcagccgactctagcccttggtatgtcttgtcagtggactggctcagatctcataatagtgccatcccttgggggactttttggaagctgcaaacctcccgacagaagcgctgtctaatgagagcctcattcctccaagtgctaagggcaagagtctgggcagaaggatgtgtgtagtgctgttgtgagagaactggttggtactgacacctgaaaaatctccactagcttttctgcaaattataacattaatatgcttgagttcagccattgggaaattaaacctaatgtactatagataaaagattgtaggccttattcaaaataagattcagaattaaagaagactatgcatggtacctccagaaacactatgtataatattaagtattccagaataatcataagaatgcaactaacatttttggatatttacatgtgacaggcactatgctagtcattctatatatattatctcttttttttttttttttttttttgagatggagttgactcaccacaacctctgcctcctgagttcaagcgattctcctgcctcagccttctgagtagctggggttacaggcatgcaccaccacatacagctaattttgtatttttagtagagacagggtttctccatgttggtcaggctggttttgaactctcgacctcccaaagtgctgggattacaggcgtgagccacagcgcctggccttatgttatctcacttaatcctcacaaagaacttatgatatacacaaacactatcattatctcgttttacggatgagataacaaagttacactgttaataactaacagaactagcacacaaactatattatgctgatctactcattttccattcaaattaattgaggactgaagacccaaagatgaagggacacaacatctgctcccacagtatgatagggaaatgaataaaacaaaccaattgttcaatggaactatggcactatggcataagagagaggcagaaatggtctggtaggctaggggtgggcaggggggatttcggagctatctgagacttggaataataaaaggagtttctaaggtagaagaatcaaattataaaactggcaaaagaacatagcatatgctcagagaatgatgggttgttatagtttgaatggatgaggtccctccaaaattcatatgttggacctgaataatcaatgtgataatattaagagatgtggccttttgagaagtgattatgtcatgagtgcttcgcctcattaatgggattagtgctgttacatgagaggttgaaggaagcactctaggaccttcagctcttccaccccttctaccatgtgaggacacagcattcatcccttctggaggatgcacttccaaagtgccgccttggaagcagagagcaagcccttaccagacactgaatgtcagagccttgatcttggacttgccagcctccagaactgtgataaataaatttctattattgataagttacctagtctcaggcattttgttatagcaccaggaactgctggtaccaagcagtggggtgttgctgttaacaaatatataaaattgtggaacaagataatgcagagaggctggtagattttggaaccgaatgctagaaaaagtctctattcctgtgaataaagcattaaggcagttctggtgataactcaaaagagaacagctgtaggggaagccttaatcttacagactacttaagtggttgtgatcagaatgctgatacaaatatggatggtaaaggcaattctgatgaggccttagatggaaatgaggaacgagggattgtaaactggagaaaaagccatcctgtttataaagtggcaaataacttggctgaattgtctgtgtcttagtgcttagtcagaagctgtgagcaatgaactagagtatttggtggaagaaactgctaagcaaaatattgagggtatggaacagcttctcttgactgcgtatagaaaactgtgtgtgagagaaacaaattaaagatggaatttatactcaaaaggcaaaaagaactcaaaagatttggaaaattcccagcctggccagattgtaaagaataaaaaggtgtgttcaggagggaacaccagggtgtgatcaagtgatatttgataagattagtgtggatagaaggaagccagatgcaattcagcaagacaatggaagaatgaccctgaaggcatttcagagagctttgagggtgctcctcccatcacaggcccagaatgccagggccttgagagcagaatgggttcaaaggatgggggccaaggtccctgtgggactttgaggcttactacccagggccaactcaatttctgctccacccattccagtgcagtgctctttggctgctccagcatggctcaaacaggtacaggtttaatgcaggacactgctccagaaagcacaggcagtaaatcttggcagcacccacctggtgctaactgctggtgcacagagtgcccaagctgtggaggcatagctacctccacctaggtttcaaaggatgccttggagagcctcatagcccaagcagagaactgccacagtggtggggccacctcacagagcctctactagggtaatgcctgatagagctatggagtattccacccatgagagctgctgtgagggctgtgcccaactaagccatggacgggtcttccctgggttttgggtcccaacccccactcagtatgtcaagaaggcaggacatggagtcaaagaagattattatcacgcctcagaggtgaatgtcgtttgccttgtcgggtttaaatttacttgtgaattattacccctttcttctttcctatttctcccttttgtgatggaaatacctgccctgtgcttgttccacccttgtattttgtaagcatttaacttgctggatgtcacagattcacagctggacaacaatttgcttcagaatgaattgtaccttgagtctcatccatatccgagttagatcatatttacaggagactctggacattatttttattttttccttaaatagtgtttgaggtacaggtggttttttgttacatggataagctcttttgtggtgatttctgagattttggtgcacctgttacctgagcagtgtacactgtactcaatatgtagcctttgatctctcaccccctcccaccctttccccacaagcccccaaagtccattgtatcactcttgtgcctttgcctcctcatagcttagctcccatttataagtgagaacatacaatatttggtttgccatttctgagttactttacctagaaaaatggcctccaactccattcaaattgctgcaaaagacatttttcattccattttagggctgagtagtatttcatggtgtgtgtgtatgtgtgtgtgtgtgtgtatctatgtatctctctctctctctcacacacacacattttctttatccacttgtttgatgggcacttacggttccacatctttgcaactgcaaattgtgctgctataaacatgcgtgtgcatgtgtctttttcatagagaattcatgactaagacccccaaatcaaatgcaacaaaaataaaaataaataaatgggatctcattaaactaaaaagcttctacacagcaaaagaaattatcagcaaagtaaacagaaaacccacagagtgggagaaaatatttggaaactatacatccaataaaggactaatatccagaatctacaagaaactcaaacaaatcagcaagaaaaaaacaaataatcccatcaaaaagcaggccaaggacatgaatagacaattctcaaaagaaaatatacaaacaaatggccaacacacatatggaaacatattcaacatcactaattatcagggaaatgcagactaaaaccacaatgagataccaccttactcttgcaagaatggccataattaagaagtcaaaaaacaatagatgttggttggtgaggattggtgaaaagggaatacttttacacagctggtgggaatgtaaactagcataaccactgtggaaaacaatacgaagattccttagagaacttaaggtagaactaccattcaatccagcaatcccaccactgggtatctacccagaggaaaggagtcattttgtgataaaagagactctgaactttagaattttgagttgtcgctggaacaagttacaatctttgaggctactgggatacaaagaaacaatgcatttcgcatgtgagaaaaacatgaattttcacggggccaggggtggaatattattgtttgaatatatatgttcctccaaaatttatatgtcagaacctaatacccagtgtgttggtattaagaggtgggaccttttgagaagtgattaagtcatgagtggtccaccctcaggaatagggttactactctcataaaagaggttgaaaggagtgccctaggccctttttcccttctatgtcttctaccatgggatgacacataatttttcccctccggaggatgcagcaacaaggtaccttcttaaaaatagatagagagcagcgttcaccagacacttgatctgccagtgctttgatcttcaacttcccagcctctagaactgtatagtctgttcctgctgctataacaaaatactttagactgagtaatttataaacaatagaaataaattatggtttacccagtctaaagtattttgttatagcatcaggaacagactgaaaaatggatactatgtcctgtatgactggcgcatagaatgtgaaacagagagtgacagggcatcagagtggaatatgggaaaaggccaaatcctgaaggtccttgtatgtaatgcaaatgaaataaaattttatttaaataaaaggatagggagccattgaagaatgtaagtagagttggtatcaatagcgttgctatttatgatgatcatgttatggagtgaatgagtgtgtgtgtcccctaacagtcataggttgaaattctaacccccaatgtgctggggttatgaagtgggacctttgggaggtcattaggtcatgagggtgtagccctcatgaatgggattagtgcagttataaaaagacacaagaaagcttgctttctctctctgctcttcaccacatgaggctacaaggagaagcaaacaatctgaaccaggaagcaggttcttaccagacataggatctgctggaaacttgatcttggatttctcagcctccagaactatgatcaataaatttgttgtttaagccacccactccatagtattcttttatagcagtccaaacttacaaaaatatatcactttgatggagtgtagtgaatggactgataatggtgagactagaaataaggaagctaatggagatattgcaatagtcaaagccttaaaattgagtgggaggagtcggaatggaaagcaaataataaattccagagtatgggtagcatagaatagtggctaagaatatggcttctgggctggctacttaagcttgaaccccagcactgctacctcctagctatgtgttctttgggaacaccattagcttctgtgtttgagtttcctcatctataaaattcataataatggtatctacctcatagtgttgttgtgtatattaacatgacatttgaacatgttgctgaatattaccgtacagttatgcactttatgtgatgtgcctaagtgtctagcacaaagacagcattatgccagaggcatttgtgtctgtgtgtgtgtatgtgtgtatacaatctatatatactttttgctcatcacaatgggcaaaattatttttgttataaaattgtattctaaagtaaatttaatttacttaaaattatattcaggacaagtaggcacaaaaattagcctggtttagaatgacaaatatgtataaaaattaaaaatgtgattctttaggccaggcgtggtagctcatgcctgtaatcccagcactttgggaggctgaggcgggcagattatgaggtcgagaaatcaagaccatcctggccaacatggtgaaaccccatctctactaaaaatacaaaaattagccgggcgtggtggcatgtgcctgtagtctcagctatttaggaggctgaggcaggaaaatcgcttgaaccctggaggcagaggttgcagtgagccgagattgcacttctgcactccagactagcaacagagcgagactccatctcaaaaaaaatgtgattcttcgacatttatgtttttgaggtccttttaaagtcctatagttgcatggtataatgactttggagatagaatgtttcagaataggtaacattaaaggattgtcccatgtaactggattctcataattgcttttttctttttattactacttaatacatatcctagataacccagataacttggttttgaagaactactaaaacacaattaagtattatcttttaccctaaatgtggttagactctctgtttaaaattattgatttttggatcccatatgctctggaaattttagtgtgttttaaagcaaaatataagagaatgtgaaccgagggatattttactctttacagcatgttgaacccaaactctcactagtatctcatcgtatttcccaaaggtttgccaggataaacttcagaagcagacagggtgccttggctcaaggatttgagaaatttggtcttactgagagaaaatagagtgagtaaataattattttcaataaaggattgacctggtcaattttacgttttttttttttttttttttttttgtaagatctgatgttgggatgaggaatagattgatcagaagatagttgtatggagacaattagaacattcctaactacttcataagagagatgatgtaggcatgagttatggcatgtaggactggacttaagaggaagagaaagaactgagaaagtggtagaaaaaaatctcatagaacttgatggctgattgaatttgaatgactagggaaaagaaggagtcaagaatgatcccacatttctaggctgtgtaaccaggtagaggatcatgagccccaactgacagagaatgtggaagaaaatgtagctttggggtatggagaacagaacgtttagttttggacatactgaatttcaaaggtctatgccagagctaggcaggcatgaccagcagataatgggacacacagctccagtgagaggtgtgggctggagatactaatttgagatttattaccagaggtgggagatgagtcatgaacatgggtgtgctcttcttaggagaatgcaaattgcagagaataattggtcaagaacagaaccctaaggaacagaagtgcgtaaagaatttgtgtagaaatgaaacccttgaagatgaaagaattctggattagacatgtaggaagaacaccacggaaaccaagggagttgacaatagttttggggtagaagggatctattttatgttgtgaaatgtccaattagataaatactaaaaagtttccattacgtttttaaaatagcagactttttttttttttgaaaaccctcttattcagaacaggttcagtggaatgttaggggtagaagccatattgaagacagctgagaaactaatcctaggtaaagatgtggaaattgcaagacctcactttcaaaaagttttgaggagaagaggagaatggcaatactactgtagagcatactttgggaaactctgggaccacctgggtcatactttgggaccaggagaggcatgtgcctatttattggctgagaggaaggagcttatagaaagtgagcagtttaagataccatagagactccggccattgtggctcacgtctgtagtcccagcactttgggaggcaaaggtgcaaggattgcttgagcctaggagtttgagactagcctgggcagcatagtgagacccccatctctaaaattttttttttttttccaaaatttagccagacatggtggcacacacctgtagtcctagctactcgggaggttgaggtgggaggatgcttgtgtccaggaggtcaagtctgcagtgcgacatgatcatgccactgtactgcactccagcctggacaacagagtgagaccttgtctcaaaacaaacaaacaaacaaacaaacaaacaaaaatacaaaagagagagtgatggctaaaggaaaatgtatgggaatgaagaacattctagtactcaggtgccttaactttgacccagaagaaatttttttgtaatgagagcctggaagaaaagagcaaaagaagtaatggatactatcattgatagaactttcagcagagacgcagaaatttgtggcttataacattagatggcatcaatattccccctgagataggaaacaaggtcttctaaaagtgagaaggacagattatttaatacaggggctaaagagaagccccttcctcttgaataaagcctgtgatagatgatcttcaaagaggaccaccatcaacttcttcttcccctggaagcacacactgccacatcccacatcaagaggtgggatttgtttccccttctcttgaagctgggaagacgtgttattgcctttgatcaacagaatacagcagaaataatgttatgccagttccaggcctagctttctaagcatagtggagttccccttcttctctcttagaagccagctaccatgaataagaaattcaactactctgagatcaccaggctgtgagaaaagctaagctagctgaattaatttgctaggactgccatgacaaaataccacggactgggtggctgaaacaccaggaatttattttctcacagctctaagagcaaggcatggacgggattgcttttcactgaggtctctccccttgacttgcagatgactagcctcttgttgcctcttcacatgggaatgcacgtctctctgggaatgcacatccctggtgtctctttctcttcttatgaagacgcaagtcataccagattagatctcatcctaaaggccttatttaacttaaatgtctctttgaaaccatttttccaaacatggttacagtctgaggtactggatgttgggacttcaacatatgaattttgaggatgcagaattcagcatccaacactaaccatgtacagagatcatgagagagagggacaggacagatgggcaatgtggagattcattggtcagtattctgagcttatattttctcacataatcatccttcacataagtctctttaagcacatagagcaaagctgtatcaatttcatgctgcagttacacctttctatttagaattcacaaaacaaaattacccatccccctcaaaaaaaaaaaaaaacaaagaaaataacacatatacatcttctgatggaactaaatctgatatgtaaaatgactcaagaaaaatccccagctagtgagactgtgctactctctattagggtaataaaataacctgctaatatcactggcttctgatacaattgtgatgtgtaatatataggctgggagaccactgtggatatctatttttctctcatttttccttatataatttgggaagtggaaggaattggaaactacaatttcctcatgccttcataatagattctgtacatcctttggaaagtccacaaatctaaaactttaaaaagctacagggatcaggcgcggtggctcaagcctgtaatcccagcactttgggaggccgaggcgggtggatcccaaggtcaggagatcgagactatcctggccaacatggtgaaaccctgtctctactaaaaatacaaagattagctgggtgtggcagtgtgtgcctgtaatcccagctgctcaggagtctgaggcaggagaatcacgtgaaccagggagttggaggttgcagtgacccgagatcgtgccactgcactccagcctggcgacagagcaagactccgtctaaaacaaagaaacaaacaaaagctacgggaagtaaaatgttgtcagtttaattctatgagaaggtccatattgtgataagggaataatattaagtcatgtacagaaggctgatactcagatacaatagtgaccatctacattgcagggtggatttgaagctgtccatttcatcccatcctctgcaatggaatgggaactccaacaccttctccaaagctgagtcgctcactcattctctgttattctcttggttttctaagcagactgtgttccagtttccatttcattctgtattttcttatgcacattgtttgttgaatttttatatccacacagaaatgcacatccctacctccatacctacacacataaaagatttttgatgtatggatgctggatgcaaggactaaagaatcaaaagcccttggaataagagagtactgagagataggacaaacacattttttcaatgttcagacttgctggaaaggagaaaataccctaaagaaagtgtcagaaacccccctttaggcctcttttgttactctctctagcttttcaattggggacgtcagttttgctggtgatggcataggcagggcaaggcaaaattaatataaaattagagaagatacgctataaaccggcagaggtccatctttaaaccattgtgaacaggcaggggttcatctttaaaccattgtgaagtgtgtcttctctaagtttaagacgaaggtccagtcttctccagtggggccagaagcacaagtccttttattttttattttatttttttttttgagacggagtctcactctgtcgcccaggctggagtgcagtggtatgatctcagctcactgaaatctctgccacccgggttcatgccattctcttgcctcagtctcctgagtagctgggactataggcgcctgccaccatgcctggctaattttttgtatttttagtagagacagggtttcaccatgttagccaggatggtctcaatcttctgaccttgtgatctgcccgcctcagcctcccaaagtgttgggattacaggcgtgagccaccgcgcctggcccagaagcacacattgtaagagattctgccttctttgctttcaggccacaaaaataagaggtggggcctggtccttgtaggatttttttctataatatacttttagtttagctagtattatatttctgtgtacaatccatttctgttattaccatggttactactattgtttattatccttgataatcactagcttgaaccactgcgataagtttgaagctgatttaatagcctctactctcattcctctcactctgctctgtcagagtgatatttcttaaacatcaatgtgaccatatctgtggcttgtcctttcggtgatctcatccagtctcacggagataagtatgatatagatgttggtgtcatcagtatttatttcccagcctggacctctcctctgaactctagatttatatatatgcaactacttactccatagctctcttcggatgtctaagagacatcctaactctccaagcaagatgaggctcctgatcttcctctctaaatgtcatcctccctccctcagttctcctttcccatttcagaatgtcaatccattcttctgaatgctttagtcaaaaaggtcagagtcatctctgaataggaactgagatacataggctaaatgacatcatggcatcctcattacatgagtcagtaagtagcagcatcaggatatttactcggacagtgtaactccagagtctttgttctttacccctatgtttgactgcttctctaccttataaatccctttacaggtaatccaaaaacttcatatagaatctaaatgacaaatgccaactgctaacctcaaggcaagcttgctacatcaaagaactatgaattctggtctacctagctgtctgggaaaagagctgaaaattcccttggttgagggccaagatcttttgattcatttttctctctctttcttataccttctgcatgttcttatgggaatcctagattctgcatgttcttatgggaatcctaggctgtgattttgagatgggaattcagaagtttctgttataattctgtctcagctactaattagctatatggccttgggaagtttctaaactttttggtattttataattactctgccaaaaaatgacatgcatacactagatggcccagagtctatagcaataatacagaaaaaatgtatagagaaatagataaatcaaattacagggcctgtttgcttcttgagggaaagaatcacaagtttgtttactatccatctcccaagtgcttattgaagttacatcttcggcagaaactcagtaggtatgtgtgaattgctggttgaagattcatgatttgctatatggtacggacaagatgccttagaattccagaggcagtttggaatagtagaaacaaatctgaattgagaggcagacaacaggatctaatagcagagaaggcagagatgtgtaagttagttgacttcaggacaaacatctatcatatagtcaagacttttagtatttgcctctgtaaaatataaagagagtgggattggttgatctcaaagatatcttaagggagctgtgactgtataatttactttttccataaaacctaaaaagtgtaagcatgaaacatttttgtgtgtgtatctattccattggaagggctcagcaattgagcatcaggatctagcacatataatcatctgtttacatttcatttattttagaccccacaccaatactgtgaagtggataataatatctccatttatgcataaggaaattgaggtccagggaggcttttcaaggtaaaactcagtgtcagagctgggattgcaatccaggattaagtggctctcagtttcaattctctttgcattgaaccacacatcctccccaagtctctggcactagtgatgcacatcaggaggcaatgtaggggctcttcaggatataaagagggctcatgggtacaaacatacagtgaaaaggacatggccacacttcttgaaaaccaggttcatccaactctaacagaaagtgctatgattagccaaaaaatatattctagtcacacacacacaaaactaattaattagaaaaatctggtgattaactgcatgccttcattgttttcaataaatgtaacctgtccaataaatcagtaacatttattaatgataatacaaagtatattcagtaataggcttgccttccatgaggagactaatatggggttttatatggagtcccaaaagaaaccaaataaacattgttagcatttgcttcattgcacagattacatggtgccttgattctgctgctgacaagcagtaaattgctctgttgtgtgtggtgcttaaaacaggtttaatctgctattattaatagttccatgaagaatatgattgcctatccccatcccactttcaaccactgtggccaacatacgggaactcaggcaactaaaataattacagaccacaagctgtaacaataaaccacaaaaggactaatcatatcctttcttggaatttacttatttcaaatagtttgttactttttttttcatgaagagctccatattggaccacaattgtgatgagaagatctaacttggatttcagctgcagaaattatgctatttactttcttattacaggcactaaattgctgtttggattattattatttttttcctttctctagatagttcaacaaatagattttacggtctctttatgggacaaagcagagtatgatttcgaaaagtataaagactaaataactagataattgcctagagttgaagtggtgtattcaggaacttcactgggaggaactaaaaataatttaaaaataggagaaagtgtcattggcccatttatgcaaagccaatgcaaagaaaagctgaacacttgacttctgagaaattaaagacaaactgtggtgccaagttacagcaattcccttggcctaatttttggtaaatttaattttatcctttctcaatgttgtggaatctataatgtatattttattggtcatattatatgcatgtctcatgcaggtttccttcagaacttcttgaagatcaatagggaatatattaaaaatgaaaatagaaattaggttgaatattggcctacctacaatggttgaaaaatcactttagaaaaaagtggttttgcttatttccttgttgacctatttgaatgctttttatttaaaaaaaaaaaaaaaggtcctcagcatgaaggatttggtaggtgatgttttatctcactgtaaacatttctttttgctaatcaaggatctttgaatgacagaagggattttaaggaagacaacaagttagtcttctggagtaacattatctgctctagtgaactggtcctttggagttcggtggttttaaaggcatgctttcttttattatttggagattatattgtttaaagttttctgcatggtgaatagaggttgctaggggaacataaaactctacacagagacagaactatgactaggtccaggctctgtcaccaaatagcttgtgatgctgagtcagtctcacaaatgtgcagcctgttgtttcctcttccacaaaatgataatatttctcttcatgtggctttggcagtgatatgacctattacatgtgaaggcattttatgataacgtgcggtgcacattagacatcaaactttgttaacatattaataatatacctcatttggtgacattgttctttttcctttataatttttcaatgataattattaaaatctttgtcatcaacttagtgaaaccccgtctctactaaaaatacaaaaatcagctgggtgtggtggcacatgcctgtagtcccagctactcaggaggctgaggcaggagaatcacttaaacccgggaggcggagattgcagtgcgccgacattgtgccactgcactccagcctgggcaacagagtgagaccccatctcaataataataataataataatactttaaaaaaatctttacgggtcatatgtgccccctcccagttcaccaactttgccttctcactggatggttctcataacttaactctatttccacctacttttctaacacggtatttcataccatacaaattggtcctttacgcaaaataatttatatgttaatgacttggtcagatgggctcaatattaactttttcctcgaaggtgctagtttgttatcccacacacagtgcagttaatacactcataaatgtccttcaaaaatgtttctaagggccctgcagactgaattttagactccgtgctcatttttacttcagtaatttcattagtagtgtttattttataaatagtttgtaaagtgtttgaaggcagaaacatttttaaaatgtttatatatttttgttccaaagtattttgcagagaaacaaatccacagaagcacccctaaactgggagtgtggtgaagtggggaagagcccagcccagggctgcagatctcgggatccaagaatacatagcaggtagctcaagagggaatttagagtctaggcctgcatagaattcacctgaaaaggtggaacagagaccaggactgaaaccaggaccaaaacaaggaccaaacaaaccagatattccagagaagagtaagtggtttctattggtaagagttgggattagcagaaatttcctgaaacccagatgtagtcacagaagccctagagatcccatggccctgcctaagtgaaattagggagagggctcagtggggtgtcttgaatacatttacttgttcaggtgtcgaataatgcctattgagaagcaactatgtgccaggaaaagtacagggtactgggtatatgtgggtaagccagacagcagcaactctgccctcatttacctcccatctcagaaaacaataaacaaattcattaattattagagataatgataaatgctaagtaaggaacaaactggacacagcaggggtttcacctacatggagctgtgattaggggagatgatgtttaagatgacattggaagcatgagaaggaaccaaaaggtcctcagaccaggagaggccaaaagctcttctccatgagtgatttaaagtaaatgtacataaagagtagccagtggaggagatggttgttagcaccgtgatggaaaggtattgggaaatgctggaaaagcatggcataagggcaagaagggaaggtcacccaaaggcaaggttcttgtgggcttcccaaacctcctctgcttctctgcaggtgccagaatttggttatttctctgggaagaacttgtgtcatgaaattgaaagaagcccaagagagttgcgccatagagaatgaggagtgtttgtcagatatatagttgtcatttactgaatattgtggttctcatcttagtttactcccaagaaaatacctggaggctttcaggtgcttctctcttacgaggcctggtactaatgttttcattcaattctttgagcttccctagattcttttaggaacttcttttttttctcctgttagatcaagattctgttgcttaccatcaaagagcccaagctaatacagtcacctctctgtccttatcttgcttgtctgcttagcattcaatgcctgttttttgaaggactattgtctttgggtttatgtgataccacatcctcctggttttctttccatctctctggttgcttcttttcagtgtcctttgctatctcttccagctttactgatcctctaaatgctagagtccctcctgaccaggactaaatccttttgtctcttttaagtcattcttagtggtcaaaaaggtatgcacttaggtgctagggtaccttggttcaattcccagccttgccacttcctagctgtgacctcggagaggtcacttaacaattccttgcccatttcttttattattattattattttaaaaaaacctatttcgtagggctgctaagagaataaagagggttaatcatacctaaagtattttgggcagagctggttcattatatgcattcaatgcatgttatttttcttacaattgttagtaatcatcaattcccatggccttaaatgttacatatatgctggtgacccttaaatatgtattttcagccccaaacacccctcttagctctataaaattatgtatccaaccactagaatttatcaaactttagaagactaaattcaaattttgattactaattcttaacaccccccaatctcactcaacaatttccccccagttttctgcatcttagtaaatggtaagaatacctgcctagttgtttaagtcagaaaacttggaatcatctatattgttgctctttccctcctagccacattcaacctatttgtcaaattctgtcatttttatttataaaatatagattaaatactttcacttctttgtatctcaacaattaaaatttctaatccaatgtaccatcataacttggctagtttactgcaatatcttctttacccattctttatttttcctccatgaccaaatccattatttgccaaatagagttttgttttacaaacataaatttgtgtcattctcctacttaatcctttaatgattttgccctgtgcaatgagtcaaatccagtctgcaagactctgcttgacttgctgtatgtctacctggctggtctcatcttatatcaccttctccctcaatcatggtgatttggtcacatcaacctccatcagtttcttaaatccaataaaccctttcctgccttagggcttttgcgcttgctgtgtcttcaaccaggaataactttttccttgcttctttcattactggttttctcctgaggtctgccattaaaaaaccctcaacttcagaaaggcctgctacatcactcagatttctccagagaagagagatgattggatctatgtctatctatcatctatccatctgtggatttattttaaagaattggctaatgtgattatggggaatggcaagtccaaaatctgtagggcaggtgagcaggctggaaactcaggcaggatttcaacattatagtcaaggcagaatttctgcttctctgggaaacctcagtttttgctcttaaggccttcaactgattgagtgagccccactcacattatcaagggtaatctgatctacttaaagtcaactgattatagatgttaatcacatctacaaaatatcttcacagtaaaatatagattagtatttgaccaaacaactgggcaccctagtatagcttagttgacatataaaacttatcatcatactttccttaggtctcctgcatccacaggagtctctttcatagagttctctctttttttttttccattggatgtaccataatttacccttaagtaattctttgcttacttattaatttccccttcctccaccacactctaatgtctatcaggtgagaacgattcttttttgcatcaatatatatccaatactagcaaagtccttgggatatattaagcattcagtaagtagttggtgctcgatgcttaatatgtgtttgtgaaaacaattaacaaccacagggaacttgagatgaaaagttttgacccaatcttctaaaatttttatgggagttagaatatcagatgttaagcataatttactaaaatgtgaatagacaagaaaataactgattatttctcattttcttttgacacattctcctcccttgtattttcctgaaattaaattagtcaacacagatttaagaggacttagagtctcacacactcagcccaaatatagcattgaaaagacttccaaagctttggcaacatattttattttaataaagattcaaatgcctgcaggatcactggaataattgccagttacacttctattaatgaacacatttaaatggggattgtgaaaagcagaaaatgatctgattttatggagtacgtttactgccagcaatgtacagtgatgaatggtgccctagaatttaattttagttttagccacaaaacagccaaaattgcacagcagcctctttaacgaatatgtactgaacttgaaaaattatttattgagttctcagtgatatatatatatataaattatttattgagttgtcagtgctatatatatatatatatatatatatttttttttccttggagatggagtctcgctctgtcacccaggctggagtacagcagtgcaatcttgctcactgcaacctctgcctcccaggttcaagcaattctcatgcctcagcctcccgagtagctgggactacaggcatacatcactatgcccagcaaatttttttttttttgtatttttagtagagatggggttttgccatggtggccaggttggtcttgaacatgtgacctcaggtgatccacccatctcagcttctcaaagtgctggtaatacaggcatgagacaccacgcccggcctcagtgatatatttttgtgaaccaattagttacttcaaaaaataaagaagagtaatgctgttaaagttgatccacatagcagtcttattaccacccttgcatgggctctgtgctgtgaagactaggttctatgtgcaacaagttctattaacaagcctctttggatgaagctgcttttgaacttgatatgcattcagttctgatgtacagtgctaaaggaagtagaaaatctcaaagggttcataagacagagtcttagtactatttctaaatgctggttcttcaagtggtatttgagtttgaagtacatcagttcacactgctcccagactaaaacaaaaaaatgtcttagaaggattagctgaatctaaggaaactttttaggaatattaaccagaaaaattcaggagaagcaagttttgttgactttatcagaatgctgtttgttcccctaaatccaacttctccttttgcatttatatactgatatttagccagaaactacatttcccatcttcccctgtagctagatgatccctgtgactaagtttgagcccttaatgtgaataaaagtgatgtagagactcttcatgttatctttaaatccagactcacttgcccctggactatgactacctcactttccctcaggatctgaacatgacactgacccagtttataggatatagatggtagcaagggatagcaggacaatgtgttggaaggaacctgggtcgctgaatgacatcctgctagagcagagctgccacatcagcctggaccaaaccaactatgacttgaaagaaaatgggagctttcttataggattgttgcagatgaatcaatacagaaaatcttgaagtctttagaaagacttgtaatgaatttttatattatttagaggttacttttacataagttgtttttaaaaactacctacattttaatgttatgtctttaagacatcaaaaattatgctatctcttttgatttttgcaaaatcccagtgagggaatcattatgagaaagattatgttagcttctggaggaactcaagggacagaataaaagtaaccacaataaaggcactattttcagatttgtcctctgacaactctttgtagggctaagaacaaatctgtgttttctaactttttttagggaggtgactctcaaatctgtatgtgtgaatatatgtataatattaccattgcgataaaacttataaagtgatgtctaacaagtaagtcattagacatccagtgcttagcatgtacccaaattcaactatattccaatttgaataaagcatatatacatctatagagatatagatctatagatatagatatacatagttttcaaaaagcaaatatctacctatagacatctatctctatatatctatacacatagatataagaatatattagattcccctattttagattattcttcaaaaagcaagtagatatctatattgtataccatgtatatatctatattatatatatatatatagataggttatttttcaaaagcaaatttatatatatatatgtacataatgtgaatcaaagtttgagagggggaaaaagaaactttaagaaagaacttctagattatacaacacaattcagagtactggcatgataataatggtgctaatagtgataatgataatagcaataacaataatagcagctacattttgagtgttgtcatgagacagggtctgtgctttttgctttacattcattgtctttgcaaagcatctatgagatgttattcttcaattttgcaggtgacatatgaaacccagggagtatcttgcccaagggtaaccagaaccagaatctaattacattataaattttacctcaacatatatccatttttgcacagaaaagagttagcataacaggtgtgagatcactgtccttagaaaggcctgcttgcaaggctagccacttggatgttgggaaagtgtctaccattctttgaagcaaatggctcactgtgcttaaactgtgcaaacaatatggtttatgttgaacatctgctttgcttcttggagtctggaatttgggtacatactaagtactgaacgtctaatggcttccttgctagacaacattttataaatgctatcacaatgactcattgctgggagaattaagcacttcctgtgagacttcactcagaaagaactcttggaagcttgcctcaggtttcctccaaacattaccccatgtgccttttccctttgcagattttgctttgcattcttttgttgtaataaatcataaatgtgtgattgtatattgggtcttgtacatcccctagcaaatcttcaaaactagagacagtcttgggaacccctaacatatctatcttccatgtcattctctcatttggagaaaataaaattttattttctacctgagtacataggaagacgtatttctcagcctctcttgaaatcaagttggaccatatgactgagctctgatgggtggaatgtctgttagtccaaaataggcccatcaaatgccccacaccatccttctgctctcaactgaggaccagatgcagatgacccagtggaggaagctggcaccataggcaatagtggaaccacgagatggaaggagtgtcctcaataaatgagttgaacagaagtcccatcctgtccccaacggagtcacataggattaggaaatgaaagagaaacaaacatttttttgtcttaaaccactgagttactggagctgtgtgttacagcattgatccttctctgtctaatacatatggtgacgtgctggataccaacacccccatctccttccgctcaactttgaaatatgttgcaagagtgaaagggatttttaagccatagagatcccattactcatttgatagaataatatttgatgggcaaacacaggacacgaataatctaccagatggcgactcttgcaagggaatcaaaggaagttcttcattaccatttgagattgctcttaacatttttgagtagtacttgataaaacaaatagaaggtgttaaactactgggtgtagttcttttactaaaggagccatgctctttcactccccctattattagattatttttcaaaaaagcaaattaacagcacttcaattttactcagtagatgtggaaagaactaaaaagaagaaagtgagagaagataaaaattttattgggctggcctccaatctttttgtttggggtcattcatttgttcacatatatttattgattacctgtcatatactagacacagcctgaagggctgagaattttgtagtaaagaaggtgcagcacctgctgtcaggaagcttaaagaataggggaggagtccacaagcaaagaggaaacccaaaataagcactatgatgggagcacatagcagagtctccaaacctactttaggagatatcagagaaagcttttccacagacaagtctttcaaccccaaaactctcaagatagctgtgagtcctcctcagtttccctccccttttaatccaaaacatcacgacgtccactcagctcaacctccaccacatatccaagcccatcatttctctccttctctacttgctactaccctggtctatgccacatctcctttccgtcttaatctcttggaccagatttctagagggtccccaattttactctgatgtcttacactccattttgcttagagtagccctccagggccatcttaaaaaaaaaaaatcaatgctttgtttgtatctgaacttttaaaaactggtagttccccactatccttagaataaaatacaaatgacgttccaggttccagccactcttgctcactcttgcctcatgattttgggttgttctttatgcctagaaagtccttttttctaccttcccatggccgtgcccttcttgacattgcagatacaatgcaatgccacttccctttctctagccgccccatcgaaagaagctccctgctctagttctttgtaacaaatgtcatcctccttctactgccactagatattttcttatttaactatgtgtttgctttttgcccctcttttcactatcttcccccaatggaatacaaactctaaagaaaaattacctgtctttttttgtcagtgtatcctaaataccttttacagtgatgagcctgaactcagcactcagagaataagccatgaaaaaatatattgaaaggaagtctaagtatggatgtggagaaggtgtagctgttgtcctgatgaagaagggaattgtgggaagcagcatttctcgcaggagaaaaagtccaggtcaaggcccttcagaggggtgcacttcagctgcaggcagttccttctggctggagcagagtaaatagggatgagtgaggggtgagacgcgaaaagtcagcagaagatggttggtcaaggcctggctgatcgtgaactagttgggtcactgcagtatagacagcatctaacccaatatctgacttatagtagatgttcaagaaatatttgttggatgagcatgtaaggcaattgagtctctcttctaatggcaaaaaaaaaaaaaaaaaaaaaaaaaaaaagccagcaattggttttaagtaggaactgactggtttctatttgttctttagaaagaccttttcagctgcacagtggagaatggttcagaggaagacaggactgtaggcaaggagtctgggtcattgcagacatgcagatgagaggtgacagtgacagcagcgtgtgagaggcagggcagtggagagggaaaggcagaggcagatttgagagatacaaagactggagaattggctgagcttggagattaattagaaacaagaggttctgagggaagagcccagaaagacaactggatttacattttttttttttttttgagacacgatcttactgtcacccaggctggagtgcagaggcacaatcttggctcactgcaacctccacctcccaggctcaagggattcttgtgcctcagcctcccaagtagctgggatttcaggtggacaccaccatgcctggctaatttttgtatttttagtagatatggggtttcgccatgttggccaagctggtcttgaactccaggcctaaagtgatccagccgcctaggcttcccaaagtgctaggatttcaggaatgagccaccatgcccagcctggatttctaagtgactgcataaatgaaggtaacatttttgtcaaaataatctctccacacagatgtatgcacataaaatatacctatgagaataaaggagaaaactaacagtagttacctctagcaaggtgggatgagaagtttcctgtacctaggacacttcgatatttcaatttctaaacctctgtatgatttcaaatgtttagcatgacattttatgagtttaaaatttgaaagaaggccgggcatagtggctcatgcttgtaatcccagcactttgggaggtggaggcaggcggatcacctgaggtcaggatttctagaccagcctggccaacatggtgaaaccccgtctctaccaaaagtagaaaaattagctgggtgtggtagtgcacgcctgtaatcccagctactcaggaggctgaggcagaagagtcccttgaacccaggaggtggagttttcagtgagtggagatcgcgccactgcattccagcctgggtgacagagcgagactccgtctcaagaaaacaaaacaaaacaaaacaaaaaattgaaagaaacaaataaatcaagaagcatctaaatgccacagaatatattagattgatgcaaaagtaattgtgatttttgccattgaaagtaatggcataaaaacacaatttcgttcacaccaacataatgcataacataaactaatgcttaacatatttcaagatgacattactgagtcattatgaatttttaattacattatgaagtttagttacttttgtacatagaagaataaggaaagaactgaagggctctgatatcttttgacagcactcttaaagatattaagtaaaacatttctcatttattttcttatctacatggatattaatatcctaaatttttaaaggatagtttcatgtccagagaatctaagccattgttcaagctcagaaatggcagcggtaaggtttgaaccctggacagcgcttgcactatgtcagtctatggaagtcaaaagggaggtcgtgttaactgcataggcttataggcaatcttcccttcagaaagcccttctggttggaaatctgacagacagttctgctagggcaaaggaaatagcattttaactctgttcttaccttaattctaaagtacatgaataacactttgctcttaaggaaggccttttatctgagtctttcaaacactgaacaaaaccaattattacccaccctccttcatggttcaaagagaagattttaatccctaatttgctgacagagagacagaagccggcaggaatgaagtgatttactgagggtaacacagtctatgaaagcgttcaagaataaccctgagggcttgtgacaaaagagcaattgccttatgcaattagcagtgaattcctctgtcctaatcactgcatcttactgtttcccatgcaaagtttaagggaactaaacttctcctctttcctttcccaccataaatcggacgtagtgctttttatgtaaatgtactttgcaaaaatgtagatccctataattttaccttccatctgtttcatctgtttttaaagatcttactgcagaatttcccaaacactttgaatggggtggaaaagccccatacaagaactcagatgtcctgctggttcctttggctacaacatcaaaactcttgcagaaatgaaacaaaaaaaaagtatgcttctgttcttcatgaaattgcccaaggagggtgtctggataataagccaaacatggagggtggggattaactgcatttgagatgtgactgcagagcacattaagctgctttgctctacaggtgttgctgcttcctcacaagctccactgtgatggatacaacctatgtgacccccagtgagtcacacctttttaaatctcctcatcttgagtgctgagatgtgcagtgtaaggtcccctgagcaggctgcaccatggtcaagccatcatgacccctgtgacccacatgtacacatccagaagtctcaaattctgggagccagaaagtctgggacaacaggaaaaccactaaagaagaaaaatggctagtacctgtcttagctgattaggtaaccctgcgacattctaccattctagcatgctctaccctaactgatcaatcaacctagtgacactgtgctctatgacccctcccaccttgtgataatgcaccttgcaaccttcttcccctgcccacaataaatggcccctaactgtaactttccactgcttaccctaatctatgaaattagctccaatcccaccaccctctgctgactccctttttggactcagcccgctcacatccaggtgaatagacagtcttgttgctcacacttagcctgttcaggttgtctcttcaattagatgcgcacataacacagaggtgatgggatgagatgccacacccatgactgtactacccattagaggactagagagaccctccgttgttggctttgaagaatccagctgccatattacaagggagcttgcaagaggaccaggtggaaacggactgcaagtagcctctaggggctgcgtggccctacattgacagccagcaagaggggaatttcatatgtgcaaccacaaagaattgaattctgccaacaaccacaggagcttagaaaaggatccacgatccagaaagaaatgcagcccaatcatgattctaactgtggcctcatgaaactccaaccagagcacttagctatgtcatttctgaactcctgatccttgggacagtatattatgaatgaatgttttctaaatccatttagtatttggcaaattgttacacggcaacagaaaatgaatgtaaacatctttctattttagataaaaaaagatagtaacataacatttaatgtcaaaaggacattagcaggtattaaagtgatgccttaatgatatatttgattttaatggataattttacctattataatccagagcaaagaaagaaaaggaagcaggggaagattccatagaagaaggaaccagctgtctgaagcatagaggtctaactatttgcaactcatcctgtgccttaaaaatgggaagactaggttatatattattaattaatgacagaaaaagccaaagcagcattggcatcactatattaaaacttagtgccccactatatcatttacaaccacctaaaattgaactgaagctataactggtttcgaaagagtgcagcaaagcaagattatgaaacatatatattgatatttgtgtgaccttttgaccattggttctcaaatgaggctttctgttcactgtctgttataatgtaaaatatttttaatagattaaggacttcagattaaaaaaaagaagaattcctaaacatcatcccagttaactgaataaaaatcctcaaaaataagacctcttacctctctccaacccctacacacacatacgcgcacacacaacacacacacaccaaagacttcatgcgattccaatgtagctagcctagtcattggtatttgtcatgatagagctcatcactaataggtcatttctttttgtgctagaagcaccttgtatatgttatatatctagttcaatggttctcaatcttgcctacacaatataattacttgaagagctttataaatcctaatgctgaagctttttcccagagcaattacatcagaatcaccaagcatagtagccactatttttaatttgtaaagctccccagatggttgcaacgtgcatttaattttgagactgctgatctgtagataatagtttgcattttctgcatccttcctaatatataattatgtagtccaaaacccaaacactgcctgggaagtatgtaggccaaccacgactgtcccactttgatggaacatacaactgaggttgaccatttggggccatactataataactcctttttattgaacttcatgtttattatatttatttctttaaaaaagtgcaatctagttatcattatcccagtttatagacaaagacacatcgtctcctgagtcagagggaactgcccaaatgagtaacatgacctgaggctgagtgacaccgaagcttatgataactgcacaaaaccagtgattctcaaagtgtgggctccagaccagcagcatcagcatcaccttggaacttgtaaaaaagaaaatgcaaattctatgacccaatcccacctctactaagtcataatctttcaagatggggcccaggaatctgtgtcttgacaagcccttcaggtgattctgaggctccttataggtggacagtgtactgtattctgtctctatcagctgctcacttttgagactcagaatctggcaagagacctaaaaatgtgtgggagcctcagtgagtaagcctgtgtgagggaggagatatttctctcactatcttcccttcctctcatttccaatctatattaacaatctatgttgaaaatgctaggggatgtatcagagataccatatgggaaaaaattggtggagttatgctggtcatatttacttgcaggggtgcctggctatgttgagctactttcacacaagtgtgaccattttaatatgttgacgaatggtttatcctttgaatcacagtatggagagttttaatagtttcattaaaaatgaatatcccaactgtttccagggaaatgagtttgtgatcttaagggctttgaggtaattggtgtttagggaaccaaggcagttggtttgctttcttggatggaagctgcttcagcttactaccatgctgtaaaacccaagtgctgctgacctgcttagtgtatttcggctatgcttagggttcatttattagaattgtacatttgactagggggaaataaaaattaaaaggccacttgtgtttgatttatgagagatgtcgattaatattttctgagcaaactgtgaagtcctttcttttaaagaagtatataaaataggcctttggcatattcaggtctgatggaaatttgtctcatggggcagggtgagatgggagaaagagaaatcaataaagatagagaagagaaaaaaatagaggaagaggaggatggggaagagctgaaaggagacaataattcacaaggggaagagacagaagaggtgaaaaaaaggaaagcaaggaggagtgaagaaataagaggtggggtcagaaggattaaaaaaggggaaagaaaagagtttgggaaaatgggggaaggagagaaaaggaagaagagaaggacatatgggcaacaaaaaaaaacataaaataaaaaaaaataaagcaatgaatgcagactttggagcctagcaatttattgtgaagtgccacttgtattagacatgctgcagagatgctggctccaaagattaatgatggcagtaatcatgattccaatttatagcaaatgcaatgaaaggcagccagaccccaaacagagaaaccctacggggatggcattggaataataacatagcagcagtcgaggaatacagggatgctgagagattggattcagttctcctgtgttcaacaaacattctgtatctgatgtacaatccaatgttaaaaagaaaaaaaaagtctgcttattactagatctctgaattatagcaaagaagtttaggtgttcacatgaacacatttgaagttttattctgtgattcacctcctctgagcactgacttttggcccagattggtcttttacacctcctttcctttctgtccttgctgctcagtgtttttctgctgccagtggtcaataccactgtttcattgcaaatacctgctgtctctgaagcctggaaccactgcagaataggcataactactcatcctctttcctggttgtcaaaacccttttccctttatgcatgtttatttgtatgtattgtcttgatatattacctatcagattcctttaatcagtggtctgtgtgtgtggtgagcactcatctccattataatctcctctgcccccacctattgccacgaagtcctaggtctttgcagatgatcaaattttggagaagaaacaaatttactctgcataatagagggagaaaaacttagaaagcccagggcaaggagaaggggctgaggagcagaaatgggagaaagacagactccattcattcagacagatggtggaaacttgtgtgcaatgcgcatgcagaaaccctataaaaatattctgcagtgtcaactaccggtatgaattctctgagtaaattgctgttgtggattccaaagaagaggtagagattcatatctagtctgcataaggttggacaaaggcagcagttgtggtggtcagatgtgaagaggatggcattagaagaaatccttggacatcacagacttctacacgcactggaactggggttcttaggggctgggtttcaaaaggatcaaagcaatttaatttggatctccaggggtgcctgtagctactttggtttccatatgtataagaacaaactatatgttgggatgtgtatgctatttgatacataaacatttgatgcctttaaggatgaactgttttcagatagattcatgacagcaagttttctctccctattcagaccataagctccttaaggatagaagtgtatcttctctggcttttgaataacctgcagcatctagtttaacccttagcacatacaaagtatttggtaagagactgtgtctcatagtcagcctggatccactcactttctctcaccccaccctctggggttttctgggctctcattcccttttgaagatggttcacccaggagggagggtcatctgcacacctggattgcagagaaccaggtacagtgatgacctacagacacctgtggtttacagacattggcagcatggttttttaaactataaaagttacagtaattatcctccaattccaggaatggaatcccttgataggcctcaatctacattcaagattcaagtcaagcaccagcctgtatttaaaaactaaggaaacaatggaagtttaatgaaattatgtcattatagttgatgaagagaaaatatttcaaccaagaactgaattgaataaaactttctcagaaactctttgtttaatgggcaatcacagtatgccagcatgggtgtgccacagagaatcaaagtccacagatactgattatattcctatctgggaaggatcagtatgaaatatacatatgatggggctctcatagaatgggatattttcccccttttcctctcatttctcaatgctcctctgggaattgtgtgaaggtaaagtcaaaaagaaagttcttacattcttaaatcctctgtaaaggatctgaagctctttcttggtaaatttgctctgggcttccagaagctcaagggcttcaggccgatgcctgacggtggccatctccagttcatcttccacgctgtctgtggaggaaaacaagaaagagtcttaggaccagccactgctcaccgatgcttacacagagcaacaaaggaaaacggaagaacatgtctgctaatgtctgtgactgtccacagaggaaggaccctcacaatgcctataaggcctttacatttcccagtttaagcgtattaagctaaaacacttgtatatgatttttttgcatattcttgtcattaatgtagatattacaaccctagcattgttttaagacaacaaaaaagagcacaggaatttatttcagataatcagtggattatatgattacgtcaaacaaaaagtttaagtagcaatatatattactctataaatctaacagtaacatatatttcttttttccccaacgtttaagttcagaggtacatgtgcaggatgtgcaggtttgttacatgggtaaacatgtgccatggtggtttgctgcacagatcatcccatcgcccaggtatgaagcccagcatccattagctgttcttcctgatcctctccctcccccaacaggtgcccagcatgtgttgttccctggcagtgtccatgtgttctcatcaatcagctcccacttacaagtgagaacatgcagtgtttggttttctgttcctgcattagtttgctgtagagaatggcttccaactccatctatgtgcctgcaaataaaatgatctctgtcctttttatggctgcatagtattccatggtgtatatgtaccacattttctttatccagtctatcattggtgggcggttaggttgattctgtgactttcctattgtgaatagtgctgcaatgaacatatgcaggcatgtatctttataatagaatgaattatattcctttgggtatatacccggtaatgagattgctgggtcaaatggtatttctgcctctaggtctttgaggaatcaccacactaccttccacaatggttgaactaattcacactcccaccaacagtgtaaaagtttccctttttctctacaacctcaccagcatctctagcatttttaaggtatagttagaaaaacatagaagatcacaaatagtccaacctggaatttgtttctatataacaaccactagttataaacaatggaattgtcatttaataataatcagttttgtgccctatgtaaaatgcaactacaagatagcctctgataatgttcactaaggattccaatgaaatcagatattttgcacagctacttgggaggcggaggtgggaggactgcttgagcccaggaggctgaggctgcagtgagcagtgatggcaccactgcagtccagtttgggtgacagcatgagaccctgtctcaaacaaacaatcaaacaaacaaaaaaaatagaaccttagactctcagaatggaaggacatctgaagaaagatataaggagatagagaaagaaggaaacctccctaattcattctatgaagcatcaccctaataacaaaaccagcaaatgacataaccaaaagagaacactacagactgatatccttgatgaacatagatgttaaaatccttaacaaaatactcactagctgaatccaacaacatatcaaaaagataatccaccatgatcaagtgggtttcaaaccaggaatgcagggatggtttaacatacgcaagtcaataaatgtgatataccacataaacagaattaaaaacaaaaatcacacgatcatctcagtagatgctgaaaaccattcaacaaaatccaacattcctttatgattaaaactctcagcaaaattggcatacaaggcacataccttaatgtaataaaagccatctatgacacacccacagccaacataatattgagtggggaaaagttgaaagcattccctctgagaatggaaacaagataaggatgcccactctcaccactcctcttcaacatagtattagaaatcctagccagagcaatcagacaagagaaagaaaacaagggcatccaaattggtaaagaggaagtcaaactgtcattgtttgttgatgacatgattgtttaccttgaaaaccctaaggacttctccagaaagctcctagaactgataaaagaattcagtgaagtttctggacagaaaattaatgtacaaaaatcagtagctcttctatacactaacagtgaccaaacagagaatcaaatcaagaactcaacccctttacaatagctgcaaaaatataaaatacttaggaatatacctaacaaaggagtcaaaagacctctacaaggaaaactacaaaacactgttgaaagaaaccataagtgacacaaacaaatggaaacacatcccatgctgggtagaatcatggatgggtagaatcaatattgtgaaaatgaccatactgccaaaagcaatctacaaattcaacataatccccacagaataccatgattattcttcacagaattagagaaaacaattctaaaattcatgtggaaccaaaaaagagcccgcatggcctcatagaaaaagcaagactaagcaaaaagaacaaatctggaggcatcatactacctgatttcaaattatactataaagccatagtcaccaaaacagcgtggtactggtatgaaaattggcacatagaccagtggaacagaatagataatttggaaataaacccaaatacttacagccaactgatctttgacaaagcaaacaaaaacacagagtgggggaaaggacacccttttcaacaaatggtgctgggataattggctagcctcatgtaggagaatgaaactgggtcctcttctctcaccttatacaaaaatcaactcaagatggattaaggacttaaatctaagaccagatactgtaaaaattctagaagataacattggaaaaacccttttagacactggcttaggcaaggatctcatgaccaagaacccaaaagcaaaagcaaaagcaataaaaacaaagataaatagctgggacctcattaaactaaagagcttttgcatggcaaaaggaacagtcagcagagtaaacagacaacccacagagtgggagaaaatcttcataatctatacatctgacaaaggattaatatccagaaagtacaacgaactcaaatgagtaagaaaaaaaccaacaatcccatcaaaaagtaagctaaagacatgaatggacaattctcaaaagaagatatacaaatggctaacacacatgaaaaaatgctcaacatcactaatgatcagggaaatgcaaatcaaaaccacaatgcaatactgccttactcctccaacaatggccataatcaaaaaatcaaaaaacagatgttggtgtggatgcggtgaacagggaacacttctacattccttgtgggaatgtcaactagtacagccattatggaaaacaatgtggagattccttaaagaactaaaagtagaactaccatttgatctagcaatcctgctactgagcatccgcccaaaggaaaagaagtcattattcaaaaaagatacttgcacatgcacgtttacagcggcacaattcacaattgcaaaatcgtggaaccaacccaaatgcccatcaatcaatgagtggataaagagactgtgatatatttatataatggaatactactcagccacaaaaaggaaagaattaatggcatttggagtgacctgaatgagattggagactattattctaagtgatgtaactcaagaatggaaaaccaaacctcgtgtgttctcactgatttgtgtgagctaagctatgagaacgcaaaggcataagaatgatacaatggactctggggacttgcggggaagagtgggagacaggagagggataaaagactacaaatattgtgcagtgtatacgtgggtgatgggtacatcaaaatctcacaaatcaccactgaagaacttactcatgtaaccaaataccacctgtaccccaataatttatgaggaaaaaaagaattgaaggacatctgttcattttacaagtaaagtgaaaaaagaaatcagatattttgccttgggctacaaaataaaatgttcatattaggtgctgacaagggtaaagtaaccagcagccagttggtttcatgggtacatactggatggttgggggcctagaggatattctatttaggtccattttgtagtcaatagagtcaataggtatagagaagctttaaaatattgtactttgctttgtgaattatgtttacgctataatttctcaaagatgttttatgcaaaaaggaattttgtgcccatagatgtttggaaaatgctgtgaactttaatgtagttttgtcacaaaatattaaattatataggtttgcgaagacctgtaacaaggagtcttgtttaactttgcgtaacccaactgaccccaaaggtatttgtccatagaacctttcctggcccaagtaacatctggtaatatctgcacatttgccctagggtcatgtaagcacaagtctggaggatttggaaatatattagggttcaggtgcttgtgtctcaaatatcatccttcagtccagctcctttgaagtggggtcagatagtggcctataggaattctctctgttgtgtaaaccaatccacacctcagatgaggaacttagcaggaataaaaacatccaggctcagtatgaagccttggcttcccctttctatcctttcttcttgactacagattggagactcagagagaagggtctaaggataacagtcagctcctctcatcccagagccactaggaccccaatcccttgtcccatgggtcagttggaaatgtagtcctttttgccaaagtcgagccatttttgacactaatattgctgcctcttgctaacatctgttcctccttactactctgcctcactgagagcattgaggggccaaagctctcacttggcaaggaagagaaggtgagtggcaccctaatcttagcatatcttaattattgccctcaaggagtttacaaaaaaaaaattggtgatgaaacaaacacttggagtggctatatttgtgaaaatgagtaataggagatgaaaacaaacatttgctttgtactttttatattataataacttatctggaaagaatgaaatggaaaagcttcagaatagtgacggatgaataaaaataatagaaaaggacatggaaagatgagaaggctgacaaggataaaattgatgggataaaattgagctgacaaggataaaattgatgggaaagtaagtagttgtgctcctaaagtatgtgggaagagctcaaagtagctggaaaaaggcacctaggcattaacaaattgatctgggctttatggggaaaatcaaaaaagccaaaatccttcaattttctccttcattcatttgaacaaatgggttgattctattcaatgggtcctgagatagaaaagatgatggaaaatgttgcttttagactgctgttgatccaatgacttcaactatgttgtattattgtatttgccaatgcaggagtaaatagcatgcaatagacctcatgtaaatagataatatcgaatagaaagcctgtgctttcttgaacaatgtctgatgtaatcttcttttgaatcatttatagtgcaagttcttcaacctaaaatgttccactttccttttccacctgttaaaatgtatatatctttcatgatccaatttaaatataagtgtctcatttctgaagcctctctggattcccatactatgcaaaattggtgaccccctggtcatcgttcccacactctggttcttgtatagcatgtaaaacataacatcatgatctgctcatgtttgttttctccattgtgagttttttttgcagacaagatcaatatcttacatgtcttgtttatcctctgaacctaacaggaagtctgatactcctttgtcacttaagaataatctggtaaacaaaggatattcctgctcaactttctgatcctctccaatcccttgaatatttgctgccctatagggaaatatttttcagactgaaatttgtgggctgttggtggacctcaaatgtcttcttcagaatcactatgttctctatttattgtactgggaaatacagcaaaagtagaggggattttaattaaattttctgagcagtctttcagtcataacataaccttgtctagacctagtgaccctcacatgggacagaaccaaaacagcggattaaattctgggcctttgtatcgggcagcaatctgagctgtgctacaaatggagtttctttctctgcagatgcaaagtctgagacaaaagacacagggctggaggatcagtataattaagtgtgcgtgataggatgatcatcacatgcagtattaaaaaaaaaaaaaaaacgcccttgaagtgtctgcctgtgggctctcttgcttttccagctgtctggtaccttacttcttaatgactcctacctgccaaagggctgtttctatttctaggcgggtgacaggctctaaaaacataactgaaatcatcagcaatcaccagcatatgataagttaaaaaagcaacaccaccgaacccaatcaactctgattcttggaggcaaactatggggagcacggcatgatcccacgtaggactgcgaattctcattgtgactcagccaccttgtaagagcctgtattttgggtggttttaacccagtgcctaacatttattgagcccttgttgtatgccaggagatgggcaaggtgcttgattggcataatcctaatcctcacaataaccccagagtgaggtttaattgtttatttttcacatacatggagactgagtctcatggatgtgaagaaattcacaaccagaagtcaaatatgtgtttatatatacataaaaacataacatatatatctcctatgcatatatatgggtttccatatatatgcatagggacaagatttacacccaggtctttgatgccacagcttatgttcttcccacttcccactttgccacagtctcttttaataccagcagaaataatgatacaaataatgataacctctcctctcttattttgtcaaactcctcagaaaagttaactgtattcattagatccattttcttgctctctccttaatctactgcagtctgacttctggtcctatggtggactgaattgtgtccctcctcaaattcatatgttgaaggtctaaccctgtatttggaggtagggcctttaagaagatagttaagcataggccgggcgtggtggctcacacctgtaatcccagcactttgagaggccgacgtgggtggatcacctgaggtcagaattcgagaccagcctggccaacatggcaaaaccccccatctctactaaaaatacaaaaaattaggcgggtgttgtggtgggtgcctgtaatcccagctactcgggaggctgaggcagaagaattgcttgaacccaggaggcagaggttgcagtgagccgagatctcgctactgcactccagcttgggcaatgagagtgaaactccatctcaaaaaaaaaaaaaaaaaaaaaaaaaaaaaaagaggaagacacgaggaatgtgggcttacagaagaaaggccatgtgaagatggagtgggaagatggctcacagctggtaccttgaccttgaacttccagcctttagaattgtgagagaataaattcctgttgcttaagccacccagtctgtggcattgtgttatggcagccctagcaaactaatatatctacctatattcaaatgacacacaacactgataaaagcaggtcttgttatccacaaagtttgcacaatgagtgctgggcagtttgctagccaattatgtcatttaatcttcacaacatctttcaagagaaggattatcatccctattttataaatgagaaaattgaggcttggagagtctaagtaacttggccataacccaagcaactcttggccaaatggctacttagtaaacaagatgaagacaagtgtctccagcagcccaaagtccaggttactgagcactatgctgggaatgttaatagcaaccatcaccctatggagaacttttgctctaagcgtggttgtatattatcccattttaatacagacagaagttcagtgagatagctacattttacaagaagtcatgtagccctcattttacaaggagtaaattgggactcacatttcttaaataacttactcaaggtcatacagcttacaagtgacagggctgggatttaatccctggctttttaacaccaaagaccatgagcttagtcaatatgctactttaagagatggcaacaattaaattactttgttcaaaatcctaggggataaaagattttaaatcacaaactagctggctgctgagcctccaatgcctcaatttctttccagggaaaatatgccggggcaccttcaggagatcaccagaccagcagacaaagctgtgctgataagaaacacatggtagaataaggtacgaagtgatgggatctcagagctggaaggaacacaggaaactgtttgtttttctgcattttacccctgagaaatttagatttgggaaagatgaatgtttgtttgagacaaaaaccagaaccagatgggactctggcctctggagttatctccaggccatgcagacatatcatcactcaggtatcttgcagaagagccaattcaaatgcgcatttgcatcctgagataagcgaaatacaaatagtattttaattcatgtatcttctaacaaatttaattttaatcagacaacaaattcccaaacccagacaccattgagcttcctggctgtgtctttttgtcctttgttctttagatttcagtctctcagggctgagtttgtcctaagtctgactcaacagtcccctcaggccatgacacaattgggctagaaattggaattcaaatcatctaggaacaacagaatgcgttttaaaaatagtcatcgttctcctctttctcacaacttctcttaaaatacagtagaagcttggtacagctcaactcgtaattatgcaaatttgactctaagggcaaatcatgccatccagaacactactacggaacatcttgccttacgaacaaatatgagcgtgagtcctaccttttgacgacatgctttggaaacaagtcttctaatgcagaaaacaaataatattatgaagaataatgtcactttttgagaaagctgattcagaactcaggccatgtgtgcagagatgagtccttgcctataaagcatgaaacactgtgaggctgttgccttgttcttttatttaggtcctgccaaaatacgggaaggattatcttatttggcacactgaaggtgctccataagagaatgtgaaataaataactacttgaagcattccaagaatagtgagtgtatctacagcaggtcccatttcttttttttttcttctctttttttctttttttgagatggagtctcgctcttgttgcccaggttggagtgcagtggtgcaatcttgactcactgcaagctccgcctcccaggttaaagcgattctcctggctcagccttccaagtagctggaattacaggaacgccccaccacacctggctaatttttgtatttagtagagagggggtttcactgtgttgattaggctggtctcaaactcttaacctcaggtgatccatggacctcggcctcccgaagtgctgggattataagcgtgagtcaccgcacccagtcccatttctaaatacaacatgactcttctttaaaaataaatgtatccatttgtcattctaaaaagattataaatattgtaactttaaaattctatttgagctgaaattaatttgtctagacaaaaattcagcctgcttgacttatattgctttatctcattgataaaaataccctctgagccattactcctaatgtttacattttattaaattggccgaatagtgagttgatccatatggcaataacataatgaggatgatcactttctaatgatatcttatgtattattaaatatttagaagcttggtccagtggtggatattggaggaagatttccaatgctgaaagattcttgaccatagcattagatgctattcctgagaacttctaggataaggaggtgatgctattgtttgtttaatgttcaagtctgatacatcaggacaaagaaaaagctgcctggaggaagatttccaaagcgaattttcatggcactgatataatttatttccacccttcttttctactgcaaaaacttgtagagggatgacaacatactcaccattccattcctcggttccactgctcacaaagctcaaagagggtggcatgataatcagctgaggaaatagtttcttgggtggaggaatttgctgaagtctgcacagctgtgcagctgatgagtgtgggcacggggagccaggacctgccccaaacctgtctttccccttcctgttatatcatttgacctccctggatagagagtttaaactggggccaggccctgtaagcaactctttaaactttgacaattttaaatgctttattgcaagaatgcagaggtctgggaactcctttgacttttcctgtctttattactattcacccatccacctaccaagagttattttcaggtgcacatggagagtatagaagcaattaattccaagctgatcacacacaggctgcaagtagagagcagtcaatccatttgaaacactgtgggagtcctaggccttcccagaccaacccgagcaattggaatcctgatgttttagttagtttgacacgtatttctgcaaccctggccctgaatgtatgttagaaccaaaatacaaaaacaaacaccaaaaaatgaacaaaaccatttataattagtactttatcttacttaatatttgtatatcatattgaaaatgaacagttcttggaaaatggccatttagtttgaacatcttctgttacaggtacttgttggcaatgacattgcaatttccattctaggagaatgagaattgctttgcaatttcataattgaattcaatcacttatgaaatataacaacccagtggtgaacagctgaagctatttgccacagcacttatgaaatagattgtctctaccttatttacaaacataaataactcttcaacaagcttagattttaaaaaataatcacctaattggaatgcttattatcagcattaaccatattattactacagcatcatgaatggccccttatggtaggagttattattattattattattattattattattattattgagatggagtcttactctgtcacccaggctggagtgcaatagtgtggtctcagctcattgcaacctccacctcctgggttcaagcaattcttctgcctcagcctcccaagtagctgggactacaggcatgtgccaccacacctggctaatttttgtatgtttagtagagacggggtttcgctatgttggccaggctggtctcaaactcctgacctcatgatccacctgcctctgcctcccaaagtgctgggataacagacatcagccactgcacctggatgagttattattttttaggtggtagggtcttaattgatttttggtaaataagaaaaacaaaaattatactgccagtcattatgctcagacagaaaatctacaataggaatgctgagggggcagaggaaggaaacaagaaatttaattgaacttacacataaagacagaccaaaagagattgatatactagtcaggaaaggcaaaagctgagagggattatgagcaaagagaaaaattttaaaaagcaatggtatgtggagagagatgaagaaagcccagattagttcactaaattaaaaatgccctatcaaaggagtgcctcaaactttgatagattttctcttagttgtcctaaaaatcaataacaagacacacatatgtgtatgttcattacaacactattcacaatagcaaaggcatggaatcaacctaaatgcccatcagtggtagactggataaagaaaacatggtacatatacaccacggaatactatgcagccataaaaaagaacaagattatatcatttgcagaaacatggatggagctggaggccattatccttggcaaattaatccaggaacagacaaccaaataccgcacgttcttgcttataattgggagctaaaatataagaacacatggatacatagaagggaacaacagacactggggcctagtggaatgtggagggtgggaggaggaagaggattaggaaaaataactaatcagtactaggcttaatgtgactgtgcagtgggttcaccttacccactgcctagacagagccaatttatcaagacaggggaattgcaatggagaaaaaataattcatgcaaagccagctttgtgggagacccgagttttattgttactcaaatcagtctccctgagcatttagaggtaggagtttttaaggataatttggtgagtaggggctcaggaggtggggagtgctgattcgtcagtttggagatggaaccatagggggctcatagtgcggttttcttgttgtcttctgttcctgagtgggatctcagaaatggttgactcagattatcggtctaggtggtatcaactgattcatcaagtgcagggtctgcaaaatatctcaagccctgatcttaggtttacaatagtgatgtgatccccaggagcaatttggggaagttcagactcttgcagccagaggctgcctgacccctaaactataatttccaatcttgtggctaatttgttagtcctgtaaaggcagactggtccccaggcaagaagggagtcttttctagaaagggctattatcaatttgtttcagagtcaaaccatacactaaattctttcccaaggttagttcagcctacgcccaggaatgaacaaggacagcttaaaggctagaagcaagatggagatctctttcactgtcatgatttcctcagtgaaacttttgcaaaggaggtttcattaatacctgggtattttcgaccagacaaaataatctgtacaacaaacctctgtgacacgagtttacctaataacaaacctgcacatgcacccctgaacttagaagttaaaacgaaggaagaaaaagagcaaagaacaatcactaatatttatagcatttgttttgtgtaagctctctctttcatgagtgtatatgtatatatatacacacacacatacatatacatatatacatatgtataactagatatacgtacatgtaaatgtgtgtatgtatacatacatatgtatgtatacgcatgtatgtatacacatgtatgtatacgtatgtatgtatgtatatgcatgtatacgtatgtatgtatacatatccatgtatacacatgtatgtatacatatccatgtatgcatacacatgtatgtatacacatgtatgtatgcgtacatatgtatgtacacacatgcatgtatatatgcatatatatgtacacatatgtatgtatatatgcacacatatgtatgtacacatatgtatgcatatatgtacacatatgtatgcatatatacatacgtttatatgcatatgtatgtaaacatgtatgtataacatgtatatatgtatgttatacattttatatatacatgttatatatatataacatatatatacatacactcataaaatccccatcagcgtactataaatgctatattcttgttctgtagatgaagataccaacacagagagactaagtaacttgctcatggtcacaccataacagagtcagggaatggagtctgggaagtctggttccaggattcatgtaataactattcagctgttctgcctcccccagagcaggagagaggatgatgccccacttatctagaattcatgcacccaaataagaatcagaaaattagtagcaaaagggctctaagcagaaaatggaactctgtgagaattgaaaggggtattgagtccagccccttaactttgtaagttcatgtcacatacagagccttagctacagtggttgtaaatcaaaaaccattaggcatatcagtggcagaactgggcctaaatcttgatctttttcattcctactgcagcactttgtcagatgcctgcctcagtatcttttatggataagagtgtcttcatccttactgtacccacagttttagtaagcttccgattccacatcagaagcagatactgataatggagaaggagcatacactggaaggagtccatgagccacagttataatacctaattttcaccactggctcttcattatcatatctgagcaatgtgatattctgtgtataaatattgtcaccctgcttttatagataaagaaatcagggttggaagaaaggatgtaactgatgaaggacatagaaataggacgttatggagtcaggacttaaacccaagcttactgactctgaagactagaagtgactgcaggttgtctgagagtaatggagggaacataaagttgaaaaacatcataggcatattagagaaaagagtaatgacaaaagtcagtggctaacttattctttaagaataagttctaaccttattctttaagaaaatgttttattctgcttactttattttagaaggtaacagaaatgtgatacatttttaaatattattaattaaaattggcagcttattcatagtagccaaaatatggaaacaacttatgtccatcaataaacaaatggataaagaaactgatatatacaatggaatactattcaacattaaaaaagaagatcctactatttgtcacaacatgaatgaacctggaggaccttatgttaagtgaaataagcaaaacgcagagaaagaaaaatattgcatgatgtcatttacataaagaacctaaaaaaatgttgaatacacagagatagagaataaaacaatggttaaagtggggaggaactagggagatgtaggtcaaggtatagaaagtaacatataggatgaacaagtctagagatctaaattacaacatgaaaattatagttaatattgtatttgtgatctttgctaaaagaatagattttagatgctcttgctacatataaaaatgggtaactatctgagataatgaacatgttaatttgcttgactacagtaagtgtttcaccatctatatgtacatcaaaacgtcatgttgtacaccataaacatataaataacattttaaaacgtttatacaccttctgaaattgagtcagtaataaagaacctgccaactaaaaaaagctctggaccagatggactcatagctgaattctaccagacatactaagaagaactgataccattcctactaaaactattccaaaatatcaaggaggaggagcccctccctaactcattctatgaagccagcatcaccctgataccaaactctggcaaggactcaaccaaaaatgaaaatttcagacaaatatccctcatgaatacagacaaaaaaatcctcaagaaaagactagcatattgaatccagcagcacatcaaaaagttaatacgccacaattaagtaggcttcgttcctgggatgaaaggttggttcaacatatgcaaatcaataaatgtgattcactacgtaaacagaatcaaaagctggaacattatgatcatctctatagacacagaaaaagctttcagtaacaccctatatccttttatgataaaaacccttaccagactaggcatctaaataacatagctcaaaataataagagacatctatgacaaacccacagccaacatcatactaaatgggcaaaagctccaaccattcttcttgagaattggaacatgacaaagatgctcactctcaccactcctattcaacatggtattggaagtcctagccagaacattcaggtgagagaaagaaataaaaggcatttaaataggaaaggaagaagtcaaactatctctcttcactgatgatatgactctatacctagaaaatcctaaagatcctttcaaagggtgactagaattgataaacaactttagtaaagtttcaggatacaaaatcaatgcacaaaactcagtagcatttctacacaccaacaacgtccaggctgaaagtgaaatcgagaacacagtctcaattacaatattcacaaagaaaataaaatacttagggatatagctcacccaggaggtgaaagatctccacaaggagaacgacaaaatactgttgaaagaaatcaaagtgacacaaataaatggaaaagcatttcattcttgtagactgaaagaatcagtgttataaaaatggccatactgcccaatgcaatttatagattaaatactattctagtcaaactactaagaacattcttcacagaattagaaaaaaagtattctaaaattcatatggaaccaaataagagccagaatagccaaagcaatcctataagcaaaagaaaaaataaaacagaaactaagcccaagacatcacactacctgattttaaactctactataaagccacagtaactaaaagagcttggtactgctatacacacagacacctagaccaatgaaacagaatagaaaacccagaaataaagtcacacgcctaccaccgtctgatctttgacaaggctgacaaaaacaagcaatgaggaaaggactccctattcaataaatggagctgggataactggctaactatacacagaagattgaagctggacccccacctttcaacatatactaaagttaactcgaaatggattaaagatttcaatgtaaatctcaaactataaaaatcctggaagacaacctagggtatacttttctcaacatcaactgtggcaaataatttttggctaagttcccaaaaacaattgtaacaaaacaaaaatagacaagtgggacctaattaaactcaagagctcctgcacagtaaaagaaattatcctacacttgatcttcgtggatgaagctggaggccatcattctcagcaaactatcgcaaggacaaaaaaccaaacactgcatgttctcactcataggtgggaattgaacaatgagaacacatggacataggaacaagaacatcacacactggggcctgttgtggggtggagggagtggggagggatagcattaggagatatacctaatgttaatgggtgcagcacaccaacatgacacatgtatacatatgtaacaaacctgcacattgtgcacatgtaccctaaaacttaaagtataataataataaaaaaaagaagctatcaacaaagccaacaggtaacctacagaatgggagaagatattcacaaatgatgtatccaacaaaggcctaataccaagaatctatacagtagggaacttaaatcaacaagctaaaaccaaataaccccctttaaaaacgggcaaaggacatgaatcaacatttctcaaaagaagacacagaggtggccaacaaacatgaaaaaacactcagtattagtaatcatcagagaaatgtaaatctaaattacaatgagataccatctcataccagtcagaatggctattattagaaagtccaaaaacagatgctggtgaggctgcagagtaaagggaattcttacacatggtgggaatgtaaattagtccagccactgtggaaagcagtctggagatttctcaaagaacttaaaacagggctaccatttgacccagcaatcacattactgggtacacacccaaaagaaaacaaataattctaccaaaaagacacatgcactcatatgttcatcactgtgctcttcacaatagcaaagaagtggaatcaacccaggtgcccatcagtggtagattggattaagaaaatgaggtacacagacaccatgaaatactatgcagccattaaaaaagaaggaaatcttgtcctttcagcaacatgaatagggctggaagccataatcccaagcaaattaacataggaatagaaaaacaaatactgcatgttcttacttgtgagagttaaacattgaacacgcatggaaataaatatgggaacagtagacactacagactactgggaaggcgggacattgaaaaactacctattgggtactatgctcactgccaaggtgacaggatcctaattccaaacctcagcataatgcaatactcccatgtaacaaatctgaacatgtacctactgtatctaacatagaatttgaaaaagaagaacattactgtaaagagatagacatacaggtaatgtatttatgcaaaatatcatgcctaattcataagatgttactgtgttgccttagaaagtaggcagtacacagatggaattgattacctagtgagttaagcagagtttggataagcatagttataataaatttttgctggtatattagggggatgatttgcagctaatatcagtgatgacaaaagtattctgcactaaaacatttatccatctatgtttaaaaaagctattaggaaaactgagcagtgatctgggttttgttatgttccttctacttttaacctagtttcctccttggccttaattcccccacatgttcaatggcatagaaatagacaaaaaagtagttaatattatagaataaggtaactgtgggcattaaatgagatggtatatgtgtctggcacatagtaaacattcaattaatgatattgttgttcatataatgagtagtagtattagaaatatttgcagtaatatctagtgttaccttcaacactaggagcagaacagtgcctgggagtgctaattctgacaaattattcagttcctctgagctttccttcttgggtctatttcccacctctggctggacaatgtgtttaatgtttccaagccttaattttaaaatttataaactggggataatatttgtatcaatttcttaaagttgttttaagagattgaattactggcaggcagtaataataaattacagtaatgatgactattataattattgcatacatactaattgaggtgttattctagaatatttaggagtgaggggtctaacacagcactttctgagtttgaatcatttttctgactcttgttagctctgtgtgaccttgggcaaagtgcttagtctatgcttcagtttcttcatcaataaaaggggaagagcaatggaacctactataaaatgttgtcaggaggttgaaataaaataatgtgtataaaacatgtaaaatagtggctggcacatagtgtttaaaatacttattattatatcacttattaaaatgttctttgagataagtatgattttgcccattttcgatgggtacattgaggtacagagaagttgaataaactgtccaaagacacagagtgataaggtttggctgcgtgtgcccacccaaatctcatgttgaattgtaattcccagtgttgggggaggcacctggtgggaggtgactggatcatgggggtggatttcttccttgttgttcttgtgatagtgagtgaattctcaggagatctagttgttaaaagtgtgtagcactgcccccttcactctgtctctcccactccaccatgtgaagaagctgcttgctgccccttcacccgtccatcatgattgtaagtttcctgaggcctccccaaccatgcttcctttacagcctgtgcaactgtgagttaatcaaacctcttttcttcataaatcacccagtcttaggtagttctttctagcaatgtgagaacaaactaatacacatggcgagagtaattctgtcatttgaaaaaatctttgtcccctaaattgtacccagctgcttcattttgcaggcacttcttgctgttgaattgctaattgtgggatccactagaaaccacagctccctgaggaccttttatactcttcctgtttggaattgataggggaataaaaatcatcttttggaatagaatttgagacaataactgagctttatagtctctcatttcctcccacacaacttatgatttaatatcctgaatggtttgctattccctgaatgaagtctgaattgccaacttctgtgtttttgcttatcctatccccactaaatgaacttgccgttcttcctcctcaaccttctctgtctctattctctaaggctcatttcagtggggaaggggcttcacagaggagaggcctcctgagacattcacacaccctgtgcacttgtcacctctgatggctttgtatatcaatgatctctttgaatatctgtcatttcctctgtgatataaacatttagaggcaagagatctatcttggttatcttattaccactaatgcctagtatggcctgggcattagagacaatttattcatttattcattaaatattgattgagtgcctattatgacccaggcattggtcaaggtacaatggacattagaatgaacaaaaacaaccaaattctctctcccatgggcctgaaattctaatggaagagtcaccaattggacatcggagtggcaatgtcaagtggctggatggagacatggttctgaagttgataagcacagtctggctgaagatgtgaatatcagagtcatcactatataagtaatattaagaccatcaaactcaatgtgatcactaaggcggtatacattggcagaaaatataacagtaattctttcttttatggaatgaaggaatacatttaaaaaaaaaaattaaaagggccagggagtggcagggactccagagtaggaaagcccaaagcaggatcagcctagaaatgaccattttctaagaattacttttcctgtgggtttcctctcctggtggcatgtcacagagcttcctgttcatggtggtattcaccaacaagaaaataactgagcagcatggctgtatttaacattcattcaacacagacacagtttccacatggtctttacatattcttcatgtcttcaaacatttgcccagggataaacagtgtctctctttgagttcttttttcctcttagtccaggggcagcttgcatgtaaacatggcatccaaataatgatgcctaaactcatcttgatgtcaccaagatgtggcagtcatgtggcaaaaaatcataaaatctcccacaacattattaagtgaaaagagttggaagtgagttcagagaactcaggaaaaatgctttgcaaaacaaagcatgaaaatttactgtccagactctgctccatttctcccattagagtataatctttcatagtgtgtggtatatcatagcgatgaatccacatacaggatttctgtaatgatatgatgattttgacactgatccttctaacatctgctcacctaaagcattagtttcacactgctattgaaataaatgtgatttttaatatcctcaggaacactcaatgaagaatatgtccacctctaagcagagtctgaaaacactgtaatatgctatgggattgtttttctccccagcctcaaaggagaatggtttgctgaaagataaataaggttttatactgtcagttcatctccagaactcatcttttgttcttctacttcctctttttaatgaaaccttacaaataaagatggaccaatattaccatcaagaattgctgcctgtcacacttggtgcttcaaaacccttggcaaaaggcaatttgaaatgtaagaaggctaaacttgaaccctgcaatctaagcagataaaaaaacaatgctctgtattttatagacctggtggagtagaaaattgaggctctttgaagaattaggttcccatttcagcagaaaccagactcatcgaccagactcatgtttagctcaaatattactttttaggccaatgaaaatggaaaataggttgtatagctcctacgagaagctaccttggttaccattatgaaaatattacataaaacaaagaaggctctcatttatctaacagtctacacagtgttttgtaagtagtcatcattctacccattctggcccaaattaacagtaacaaaagtggaaaaatcaagtgggaagcaaaagacttaatcacataggtaacctgaaaaaaacaaaagatgcactaatcaaaaactaagcttgtttaattcttgtttcaaaaatttgtgttattcaagtatttaaagccaagatgtctaaaataaaactaccatctctccctaactgaccttcatggccttccctctatgttccttatcttgataaatttcaccattatcattttggtggagtcacttcatctctttcctatctttcactcaatatcacaaattgtttttcaatatttccaattacgcacaattccaccatgtgtttcaaatttatcctctcccttccaccacgattgccatgttttgacttttgtcatctcttgtaggcagggcagtctagtggtaaagacactaagctttggtattatgccattgaaggtaaaatccctgctttgatgtgtcataattgttaggtgctgggtgagtgatttaatttctttgtttagttttctcttttcagtggaggttgtaattgtaccttcctcacagacttgcagtaaatattaagagtaattgttcaggcttaaaatagcattatgctcaagtgttagctattgatactgtcttgcacagacttttcaagcagtttccaactaattttcttgtcgtctttctctttctctctcaacaatttgtcttctgacttatttttggtgttattttaccactgagtttcagttggttcattgattcagaagccaatatcccactaagtttggttattagttttgacacctgtctgtctcttgtcttcaaatattgttcttgatcctttgctagtcttttctctaacttcaagttcacatcatcccttctaaaatttggcacatatctagctccctctactcttggctgaccagccatccccaagtgccagacaagatgaaaaatcactcctcaacttaaaaacctaacttaaaatccccattgcctctctgcagagtgaatgcagcatagtgcccaggaaagttttcaaaatctggccccagatcactttgctggctgcttctctttcatacttcttgcccctcctgactggctaagctttatcttttgaagtacctagaatgctcctcctttttttcccctctgatgaaatgatgattcttctccagagggccctgctgaaatattaactctttgtgaaatgcacctaggtgagattgaatttcaccagtatcactacagtagttgtgatcatcgtagtagcaggagaatgacagcaaaaacagccaacatttagtgaccatgtattagccagtaactgttctaaacactttacatgctcattaatcctttgagcaaacttacagattatttactatcatttctaccttatggatgaggaaattgaggcccagaagggataagtagcttaactaaagtttctataactagttagtcacagaatgaggatttgaaccaaataggctaatcccagagttatcacgttcaactttttaactctagtatctctctagttttgcctctcacagcattcacagcactttacttgtattcgttgtgtcttagatctacatatgtgtctgtttatttcagtacaatgttagtcttcagatgtagtgatctgagtgttcccctgtgcctggaactattgcttttcaaatagtgttccataaatgtctgccatattgaagtgaaattcattaaatttgtcaacagaaaacaggtgtcctgacactcctacctctagctttcctatactaaaacctgtgaatgatttaatgacaacttctggtagatatataatggaccaggaaaaaaaacccgcaattttccttttttcactaagtatcaatgtgactttgggcaagccacttcatctctttttttttttttttagtttggaagatagagattataacccttgtgatctgccattatcaaaggggttttatgaaaatgaaatattcaaaagaaagaattttaaaacttgtaaaagcccatacacgtgtaagaaacaaatattctaataggtaaaacatatagccaatatctgaacgatagggccaattggtattacagcagggttaaatggagtttctaatgtttcccatgttctgcctttcatggacagtgaagtaccacaaaaggaggaaatctgtgttagctttgaaacctccaccatttgtcacagccagaaataatgccgtctcaatggctgctgcaatgctagatctggaaagagacttgggcacagtctctacttcttattcgtggatggtgaaaggcccagagagaaggaaaaaaaaaaaactcattcaaggggctaccaccatcttcctgcacaatatgtgctgtgtatgacggtcccatgttgagcaggtaagtggaaaaagatctagtcatatttttttgtaaaactgaccagaacgttgaacgtaactagagaattggtaaagtacagagactttgcagctccactgctgtgttcaatctcttcccctactcccatgcctcttgctgatgatgtgattcagaaattaaataatccctcatacctcagtttcctattctgtaaaatgggtataatcctgtccaccttacagagttatttttaggatataatgagttatactgtgcaagccacttaaaactgtaccagacacatagtaagttctaaatgtttgttaaatagataaaaataacatctgagggtttgaacatgacacttttagggcttaaaatgaaattgaatgaatcttgctttctattaagaaatacgtaaatattaaatttacatttaacatgggttatgcctctgttcttccacagattttcctgactacatgcctaggtcagagcctttagctaaattcaccaaggagttagcatgagattaattaactgtcagaggttaaacattaaaaaaaaaatcctggaggttactgttgtatttttaatgggcaacatgttggccattcaagttgctttttgcaaacaaatcctccaacagccaaatgctgatggtttctctgccaacagagcatctaaaaatttctatgatcaatatgctaccgggaaaaacaaaacacactgaaatgttatggtatatttcatgccaaaaacctgaaacacagttaggaaattatgttttgcagttatgcaaggcaatgtactgatggtggtttattgatgagtggtctagtctcaccataaccttgtcatattcatgctcccatttctgctcaaataaaaaacaaaaacccctggaatgaagctctaatttagtgaatcaattattttgattgaatgagggcactgagatagtgctgggtagatgttgttatgagttaaatttagataaaaatgtgaacacatacaaatatacagataatcaagtgttgaatgttttatcttttgtattatttcctgaccattatctagtaagtgcctttttgtcaaataatgtccattgaatgagtaaggaaaatgactactttattctttggtaaaagaactggggcatagagagataaagtgagttactcagagttattcaataaggagttatagccagagacttgacagcatttattctttctttaaaaaagtgtttgtgcttacataaagtatagtagctaggaatttcttgacattaagtcatccataaagtagctaaatcccttaatcctgtaaatagctactcaatatcaatgtacattcacgagccagctgtcagcctccaagatgccacggaattgggaagaaatctttttttttttgttctgagatggagtctcactctgtcgccaggctgtagtgcagtggcacgatctcagctcactgcaacctccacctcctggagtggagttcaagtgattctcctgcctcagccttccaagtagctgggactacagacgtgccaccacgcccagctaattttttgtatttttagtagagacagggtttcaccatgttggccaggctggtctccatctcttaacctcgtgatccacccacctcggcctcccaaagtgctgggattacaggcgtgagccaccgcgcctggcccatgaagaaatcttataagaggagtgtgactctaagtctgactgactcttagtgtgactgactctaggaattgtcgctgatcctgtagatcacaacacctggctcctaagatctacagactctggaaaacatcttccatcatttagcctccttctttctaaatgctactatggttctggaaggctgacctttgtggacaatattatctggactccttgcccttctggtttcccattgggtttggccacgggtgaagaggaaaagggagaggttgtggtacttatcatctgggctcgctctttggtgagttgacaatagctgcatttcttatccaaggaccagagcccttttttattgttacagctatagctatggctttttccaccttctagtaaccatcaacctagaaatcgtaactttcgttcttgctaacactgaatgtttcatagccttattggctcaataaaccctgcgcatacctttgcaaattgtcccttcattcaactatcccctgttgccctatttaaatatgcctttttttccttcctggaccctgactgatactgaatcatagaatttcagtgttggaaagtactggatttggagttgagtttctgatttcagatttttttcagaagctctgtgattttgagcaaataatctcccttgtctagtcttcagtttcctcatatgtaaaatagcctatattccttatagtaggctattattattactactattgttataatatgctgtaaatcacttaaaatgtgatgactatttctttaaaaaccatgtagtccaactggctctcctgggtgccaaccgtatgaaattttcttttcctctccttgaatttttccagtaagttttcttctatgggtatgacagtctcaaatcttgcagtcagacagtaagcgtatctgtatcactggagtaaggttcttttgggtataagtttttgtttattcaacttctcagttgtgggattctgctcaaatcattataaccttttcaggccacagctacctcaattgtgaattgggtaaaacctatcctcctgcaggcaaagggccagagctaatgttttctctctctctttttttttttccaatttaaagatttacattaggaaaaacagctactactctagacctataagagctccctcaatcaatatcagaggtcatcagtggagctcagcctgctaaagtgatgaagacagcaggctatggagtcagaattctagctctgccaactggggcatttgttttgtttctatgtgcctcagtttttttagtcattctatgtacctacctcagaaggtggttgggaacatcaactgagttcatacttgtcattgattcatgctcatgatatttcctatactaaatactttgcatggattattcccatgacaatccattttctgataatcgtaatcttttttgtctccaataaaccatggccctttcctccttctaggacactctctccagaccttcacattactggctttccttttattttaaggacttaaaagacatcttgtcaatgaggctttctctgagccaatcaagatatgtcccctgcatatattccctttccatcatattaccacaggtttacttctgctataacacttatcacttcccagattacctttgttttcttgtttattctctctcttcctacataagctccaggaaggtagtaaactgtgttccactcttcactagaaagtgagtgtctagtatcatgcctgccctatatggtctctaaaaatattgtggaatgaatgaccaaataacgaaattaagaggtggagaatttatgtaaataagtttacagtaataaacaggcattttgtttagtatgaggcacaacaggaattcaaacacatgccaggatgatgctaaaacccacaatgcccctctttgcctctttcaatagttcttggaagagatcataaaagtctgagctggctcagagctgtagcaaaagagacaaaaaaaagtgaaattaaaagatattcagagagaacactgaccagagtttagtagccattaagatggtgggtgggggatcattaagcagagagaagattccgacttcagcaactggacagctcttgatgccaatgaatgatataagacgctcagagtgagtgctacagagtgatggtgattaggagactacatctggctgtgcattcatccgcatcctgggatggaggttcaaagagctgcgggcaattgactgcctaggggatcgtgggatgggccaaaaatgtgaacaagacaattctttgttcacagccaaggtactgctgactctatccctgtctcatttcttactctggttgaggcgatactagtgtcaggtggaagacattctaaggcctaaattaattctcattagatgatatctattactcttgctcaactaccaatcaggtagctcgatgggagaaggccattggctatggcatagatctgtcacctcctgtcttgaagccatgtgtgttgcttcctggtacatttccaagacaatggcgctttttgatatttgtctgatagtcttctcaaacatcaaagtcaagatatgtggtttatttaacacagtagtttgggacttagaagttttgcctttgacattttaaaaatgagaaatacatttaattttcaaacatttaagaatgtctatggttcttcatgcagaaaatctttgtcatatgctgcttcttttaatgctttcgtttgaggcacaaacaccagaactaatagtttaaatctgtatttaacaaatgactataaaaggtatataatttcgaagtattaagaatattatgcctaaataacaacagaactcaagaagaaatatgtatgctttgctgaaaaacatttgaaaggccaatttgtggaaaaattttctaatataaattgggaagcttgcattcagataaatcagttcttttatccaataattcaaaatttaggggaaagtaattttaaaagcatagatagatatatacacaaagccatttatcatggtgctatttatattgagagtgggaggtaaaaagaggaaaactctaaatatccaaaggcagagaatgggatcaaatacaatatactagagttatgcaatgtagtattatgcttgccattaaaaatgattttataaaaagttttaatagcagggctgatatttatgaaagtatatcatgtaaatgaaataataaaaatttggtattgatatgacataattagtacatatacattgatgggaaaaaagatattactagttatttgtagttacttcatggtagcagattatgtgtgtgtggcgtgcacgtgtgtgtgggctcttatctttctttgcactttccaaattgactgtcctgaacatgagagacttttgcaaacatgataaaccattcacctttccaaccctggaggagaaggcgaaaaaggaagaggagaaggcaggagtcttatggggtccacaaatcacgagctaagtctagcgtaggttcagtatcagccagtactatacaatcccattagtatttaaagtgattctgatcatttttttagtattttctattttttttcctctcaaaacatccttttccctcacagttagttgaaaattgcattgcatcctctgtgaacatttatttgggggcatggctttatcagacgctggtgcagaagagtgctaacgagacatgacaattttctacttctctacgtgaatacagagatccatttgaaagttacattttacctatctacagtgtacaaatgactatattttcagcaaatatctaataaattggcaattttgattccaacctgaaaggagaaaagcaatgactctaataaccaacaatctttgacaaatagtggcaataaaagtgcctgcagcttcaatatcatgtaggattagggctctggcatttttctagattatggtcttccaggttgctgatgatgttatgttttgtgagatggtgtgcatgtgtgtgcaatgaaagaaaaaaatcacagcaatgtatctaaactataattttaatttttgtatgtgcattggcttagtgctaacgaaagttatttagttctgcctcctctccccacagaatataatgtaagctctaatagaagagctttctttgttttgttttgttttggtttggtttttaatctgttttagtcactgctccatctcccagcacaagaagcaggcagtgacatacaataaatatttgttgaatgaataagcaaattaattaaatcttattatgatgatatatcacctttggtcagtgccattgaaacaaattgctattctattctgggacttttcactgaatgtattatgttgtttgtggttctttccatattttctcatttgtgttgtggagacccatgacattttagtgcattcatatttttaaatcactaattgaatccatgagttcctacaaaatggtgtagcagtataaaaagcgagtaggtggagctgtgggttatagccccaatactcagggaattccacctagatttttaatgttgcattttctcactagcaaataacaccaccttctctgtctgattctaagagttgtttgatgcttgaaaaaaattgtgtataaaagaaagtttgtacacagagaatatttgtcaatgtatattctaagttatatagcatctttataaaataagctgaggatttcctttagatattcctctattttctactctttaagaatgccacaaaatagagaaaaagaagatggagaatgtgatggttaacctcacttgtcaagttcggcaggctatagtacacagtgatttaatcaaaccctaatctaagtgttgctgtgaaggtattttgtcgatgtgcttaacatctataatcagttgacattaagttaagcatagattaccctgaataatgtgggtgggcctcatctaatcagttgaggcttcctgaagaagaaatcctgcctcaagactgtgacatcaaatccttcctgaacttccagctgccagcatattctatgaatttcagacatgccagtccccataatggtgtgagccaattccttcaaataagtctctttacatatatgcatatgtacatgtgtgtatatgcatgtgtatgtatgtatatgatatgtatatgcttatgtgtatgcacatgagtatgtattggttctgtttttctagagaatcttgactgatacagggaaagaatcaacaaagaagaaaagtcacgtttatttaaatgacactttgtaatcttttttctaatctagtgatatttctgaatttgggcagtgtccactgggattatagacccagtggatgagagtcaaacaatgtacaaggtcatatgttaaagtgtccagctgctctgctaacaaggcaagcaataggaattcctacagttacttgagtccagtccccatcccttacatcaaacaaaaatgtcccagtgttttgcaggacaggctcctgtcactaagactgtgctgtcagtctgcaaaatggaaaatgactcctaattgcccaaatgttctcctgggtatttaggtaaacatgagtacatcaatagattgcttttgtagaatatactgattctttgtagagaacggcaatgcatgcaggcctaaagaaacgaaacaagagtttcggaggaaaaaaaaaaacaaaaaaacaaacttgctttgaatagcaggagacgacgttttggcagctgagcagggcaagagcttcatgagccgctctttaatgctgcgcttggtgctgttctgagcgtacaggaaacc
